United States Patent 7,745,391 (HUMAN THROMBOSPONDIN POLYPEPTIDE) - sequence listing, part 222

SEQ ID NO: 572086 - DNA, 495 bp, Homo sapiens
  misc_feature (123)..(123): n is a, c, g, or t
  misc_feature (318)..(318): n is a, c, g, or t
ttctcgctatgaagtagtaattggtataaataacaatcttgcaggcgttgtatccactaagaagacactgacaagatgtaggagatcaattctatacactcttcagatgtcggcccgaatctnccatcgtgttcccatgaaagcaccatctcctctctgtgttagaacccacgacctctcctctaaaaggaagaaacaaagaacaaaccattttggaacttttctcacaagtcatttaacacccaatctcacagggacgctgtattcgagacattaaacacaagagcgcaatatagattgatgtcaaccttctctacnaagatcttctggtcagcctcctctcatatgcgcccctctaagaggaatagatacactggtgtttcttaggatacacccccgtccccatgggaaccaccctcatatcctgggcataccccaaggaagatcgcccaaaattggaagatgggcctcccaggaatatggcgattagaaagc

SEQ ID NO: 572087 - DNA, 138 bp, Homo sapiens
  misc_feature (135)..(135): n is a, c, g, or t
tacttttcccagggcatacaaaaccaagcaaattcaagaccataaactgaagcgctcttcggcactgtctgatatgaatgtggcatctaatactataagaaacactatacacttttcagatatatgttgtctccntaa

SEQ ID NO: 572088 - DNA, 441 bp, Homo sapiens
  misc_feature (29)..(29): n is a, c, g, or t
  misc_feature (54)..(54): n is a, c, g, or t
  misc_feature (109)..(109): n is a, c, g, or t
  misc_feature (146)..(146): n is a, c, g, or t
  misc_feature (406)..(406): n is a, c, g, or t
cagccaatccccaacccaacccgaccaanttccccccagccccgccggccaatncccccagcccccacccctggcttccttctggcaaaaggcatgaagggaggaaatnatttctgctcctgcccactcatccacttgctgccctngtcccttccagtgcagtgattcttgctggtccctaaccaaggcttgggtgagatagggctgcgtggtgcaattcttctcaagccgtagtgactgtactgaggctggtggtaccgggtggcaggacctgcgttcagacctataaggagtggtctggatcttttgcttagaactctgacgaatggttcacaacacactccatgcgtatctgtagtgatgggaggagggggttaggagcaggacgttggggagaggaggaggngttggaggaggagcactccactggtcaacattatt

SEQ ID NO: 572089 - DNA, 417 bp, Homo sapiens
caagacttacacctacaagtgagttcagaaactgcaccccaccctcctgggacacgcccattggagtgctgtggttggggctctgtacaatgttagacccagtaactgcagaaatagaaacaaatggtcagaagacatatcgtgagagagagcgagagagagttcacaaaaccagaaaacaaagtaccttaatatttaccagtgaccaaaagatgtgaagtagcaggaacggctcctgagcccattgccagctagactgtgtggaacactcggttcataccagccatcctaggggtggggtgagttgttgtcatccttaggaaagtgtgttgtagtaggatcaaccacatccttcacaaagccattgatatgcataatgatgtaatgttactgatctgtgaaatcacgggaagggta

SEQ ID NO: 572090 - DNA, 405 bp, Homo sapiens
cctacagtggcaacctccacagccacagctaaacctaccaccacaggcagccagatgtggagcagaagaatacaccaaactctgggtgggaaaagcagccacagggtgactcgggacctcacatccactagggtagaacatcggaggacccctcaccctacaagtccactaagccccggacaccccatttcgaggcttctgggggccacccaaacaagctcgggacatgcacatcttatgaaaatttcaagcagtacaagcacggtggttatcccgggttacaccttcacaagccgggggatgaccaccaccctaatagagacagtgtatcgccatgtcagccaggcgggtcttgaactcctgacctcggttgacttgccacctggtgctcccaaagtgcgggaa

SEQ ID NO: 572091 - DNA, 221 bp, Homo sapiens
gtggcatataactcgtggcattcatacaagtccttatttggagaacaatgtgattatgctacctttgcacggtcagaataccgctggcgttaaactggtgtcactgggcaggcctttggcttctaatactagtaatgctagaggtgatgttttttggtaaacatggcggggtattgtgtaggcccgagttcccttttaaccttcttttaaatcctttcctt

SEQ ID NO: 572092 - DNA, 109 bp, Homo sapiens
cactgctccgccggctggagatcgaggcggagaccattactggctgagcatgcctacatgaccctgggagcaggagcgcggccacgccgtgtgcgcagggggaggcttc

SEQ ID NO: 572093 - DNA, 230 bp, Homo sapiens
  misc_feature (18)..(18): n is a, c, g, or t
  misc_feature (99)..(99): n is a, c, g, or t
tagcaggatcctcattgnagatgtgcatactcatgatgttccacagtcatccatgtactgtttcaggtctttatccagatactcaaacaccaaagtcangatttatctgtgtgaacaatgtcatgtaaggttactatatttgcatgttttaaatcctttaatagtgaaacttctcttatagctgtgccagggtggcaccattctttccaatggggtaccgaggctccgaa

SEQ ID NO: 572094 - DNA, 129 bp, Homo sapiens
aactgagaccggaacaagcaaaaaattctctctggcttacaagcaaatgacacttacagtctaaagacaaaagtgaacctgatcagccttgagaaggggccggccagacaagaagaggctccttctgag

SEQ ID NO: 572095 - DNA, 109 bp, Homo sapiens
cgattccgtgattgacactcctcctccaagctgctgatgaggctatttttcctctcagctcgttgcctggcccgtggcccttgtgcttccactcatcttcagccttggt

SEQ ID NO: 572096 - DNA, 1466 bp, Homo sapiens
  misc_feature (783)..(783): n is a, c, g, or t
aagcccctacaagtcacaacacatgctataaaaatgaaacgacgacagaaaagaacaaagatatgtgccacctcacgcgtggtgacaggttgctctgtctctagtacagtcgcgtctctgtagtttggtttgttagccaccacatatctgttaatgcttggggcgcacaacacgctgtgctatagggtgtgctcttcgggtggcacaccttttcttatacaattaatcaattatgttttccccacgagtgtcacacaggggggaaaattggtgccgcagagaactttttttgggggccccccccttggtgtttttttcgggaggattttctcgcactgttagagtccccccccccctcaaggggggtaattcctctttggggcccaccccactgtgcccccccctgtgttattttccgggccctttttcgtctatatcctggggtccggcctcttggtatcgcccgagaaactggggtttttcgcgcgccagaccgcgtgggggttgtgcccttgaatagtgtcccttctcgggggccataccccgggccccatttttttttccttgaaggtgatattcctgtgggaagaaatgggtgtccgcgtagtttcgacccttgtgccccccgggtggtgttcctccccccccctgggagattctatttgccgcacgagtccacagggaggggggtcccacacattctttttctgtggttgtcccccgctttttaagaaaccacccctttcggtggaaaaactggctttcacgggccactctaacagngggttaatggcaactatttttgcgcgcaattatgcccccccgcccagtattttctgtaaaaaagagttggttccacactctttacacacgagaaacacacgcctgggtggtgaccccccattttcgcgaaacgctggtaaaaccacatggggtgtgagattttgcgcacaggtgtgttgcgccacagagcccccacagccactttgggggctctggaagcacacaacagggttcgggtggggcgcccccagaaaagaggtgtgctcgaatatttttttgctccgcacacacaggagttttataaaaccccccgaggatgttatatccttgagaatttaaagaggtttatagatagtaagattttcttcttggttcacttgaggcataattcccacattggaccccaggcacccttagagttgccccgcccgcgagcctataccgaggtttcacttggtccggagtttaacccacaaacacagaggctcttccctgccaccacttgagatgagtcctttcgggaaagggacacgagattgttcctataaaccacgaaagaaggagaggtttcccacagagaagagaaaaagatattcccacgagaagataaactcgtaaagaaacccacaaaacttttggcccgggggttaattccgcctttaaataaaagtaatttaaaggga

SEQ ID NO: 572097 - DNA, 161 bp, Homo sapiens
  misc_feature (38)..(38): n is a, c, g, or t
tgtatagtaggatcccctgtggagacggggcctgatcnatgtaccaggctagtctcgaactcttggcctcaagtgatccaccgcctcagcttcccaacgtgctgggattacaggtgtgagccactgcacctggccacaacataatcattttcactccaaca

SEQ ID NO: 572098 - DNA, 665 bp, Homo sapiens
cctctttccttgccctaacgcagccatggctcgtggtcccaagaagcatctgaagcgggtggcagctccaaagcactggatgctggataaattgaccggtgtgttggctcctccgtccatccaccgggtccccaacaagttgacgagagtgtctccccctctatcattttcctgacggaacagcacttaagtatgcccgtgacaggagtatcgaagtaacagcaagcatttgcatgcagcgagttcattcaaaatcgatggcacaggtccgaactggatataacctagcccgtgttggattccatggactgtcactcagcacttgacacagaccgggacgagacatttcgcgtctagatctactgaccaccacagggctccgcttgtggctgtcaccatcggtacttaccaccctgacggacggccacagtacaacgttgtcgcaacacgtgacgaacagactcttcgtgtgaggcaacaacaagggaactcccgtcgatcgtggatgacctcaactgactgccacgacacacattcgcgcgtaaccccggaatccctctcattcacaggtgacatgactagccattcagacttgatcttggagacttggccacgattacgtgatttcactcaagttcgacacctggtaacctggtgtatggtga

SEQ ID NO: 572099 - DNA, 1317 bp, Homo sapiens
gaaagagggactcctctctccctccgtgtatagtctctatgtttgtgctagttaactttatatttctctgtgtccagtcagccacagggcccgcatccctgcaggaatcacggggtacaacgctataggtgtggacggggcaagaaaccacactgactgatagaggggtacacatggaaccaggtagagccactccggcccagctgtcacccatacagacacttctttccgcagctgacagacatgttcacgtacaccgtgtgaggacgctaaataacaaaccagagccttgcaggacagtgggggcctcaaagtgggcattcacgtgatccctgtacctgggtcgcccctagtgcattacatgacactcaaccaaactcccaaaagggatggttcaccagacaaaacgctacgcccactggcgacatacgggcaacggtacacacaaacaaaaccacggacccgcacgcacacgccacgacaccaacggcgaagggcaccccataatgcttgcccgtgctactccttacacatatgtacaaccactaacggcacattgtgcgcgatccctcagccctggaggataactccacaatacaagacaccttctcggcatcgacacgaccagacacggggtcgtcagcacctccgtgggctggacacaattacacacccaccggtgagcagcacacgacaagcgggcaatgcaataccgtccccctctagacatgaggggcccccgatgctaaacatacacgggggggacgcgcggaacaaactggacacacgacgcaacgacaagtcactacggagagacacacacagtgcggcaggaggaacaaagctcagcaacgcagaaaccacgaccaccgggcgcattctagggcaacaccccccacggtcataggacacacaaaggggaaggccaacaaaagggcaagtgtaccacacaacagcgcgacgttaaaccaacaagacgactaacaacgacggggtcacaccacatcaactcgggccaccacggcgcggcgacaacacggtggagacgcggagtgtaccacacagaagggaagtatggacggcagatcttagtcgagccacaagcgggtagaatagcgaactacaacgaagagtatgtatgatagcacacagcggatcgatacaccaagcgcgacgatcgaagcctacacgtcaacacaagctggtatcgtagcgacattgttgttattctattctcacttcttcccttcttcatcgtcaacggcgacgagcaccgtaagctcactccagtccacatgccacatccagtagcatagg

SEQ ID NO: 572100 - DNA, 451 bp, Homo sapiens
gctgagctagaggacccggcttaggaggtatacactgcgacccacttttgcttatgagaatccctagcttctcaaagtaacaagaaagaaagaaaaaagtaataatcccacctagattcacaactaagaagcgtaccctgatctcacactatcaaaacggaaataagtcgcaccttgtatatttcattctctcttatgtaaccaatttctctctgccccccgccctcgtcatcagtgtctaagcgccttgtaccaacacccagatcattttgtctttgtttctcccaggacctagcacaccatcttgtgaaagagtaggcaccagattggagcttcttcattgactgacccacagttcctagttcagttctctactctgatggaagattctcatggctgatgaagcttataagttaaaggccttcagaatgaatttcttgaccattatgac

SEQ ID NO: 572101 - DNA, 484 bp, Homo sapiens
tgatgctgtctcatacacacacacccacacactacacacacacacacacacatatgttctgttgtctctgtctctctggagaaatctgactaatacagttatatgaacctcattgtacagtatctcaggtcatacagtagacttatattggccatttctctcttcagtattatgtttcttcattattagacctttatctgtaactttctagtgtgtgttcgtgaaacttcgttttatacaaaaaaaagaaactcacgcatcttatttctgatgcctatagtactatatagtatatgtatatttgaataatataatcatctctgtgagtgcgcaataatagacttaatatgcccctccactataactcatcacttattaattcaacatatagtttgagattcgtgtagggagtgtgctaggcagtcgtgggatttatatcctttctgtgtatagatgtgtatattatttagtgcctatttgtgta

SEQ ID NO: 572102 - DNA, 415 bp, Homo sapiens
  misc_feature (356)..(356): n is a, c, g, or t
  misc_feature (362)..(362): n is a, c, g, or t
  misc_feature (399)..(399): n is a, c, g, or t
aactttcccacatcgtcctgtctcctgagtcctccaagtctccaggaagttccaaactttcccacattttcctgtcttctgagtcctccaaactgttccaacctctctgcctattacccagttccaaagttgcttacacattttcgggtatcttttcaacaacaccccattctactggtaccaatttactcttttagtcagttttcatgctgctgataaagacatacttgaggactggggcaatttacagaaggaaagaggttcattgggacttaacagttccacgtttctgggggtggggggggcctcacaatcatgggcaggaagggcaagggagggaggcaagttcatggtcnttacanggggtgggttggccaggggcaaaggaaaggaggagcntttgttgccaggaaaa

SEQ ID NO: 572103 - DNA, 391 bp, Homo sapiens
aggcaggggtacggaattggtcttgagtcagacatcttgatggaagtccagtatatagctggtcacagctgtgataagtgctaccagagcctccagtgccttttactgtagctacttcctacgctagtataaggtaaccagtcaccacgtgagcacattctttcccctgggggaagcagaccatggaattgaggaactaataagctaacatgaatctctcaggtataatcagaatcaattattcctgtatgtacagtgacacttcttaaatttgaactagaccttccaagcaatagaccaactgttcctgagggtaaagggcccctaactcccatgaggaccttctttggtggctccccaggaagtaaggaaatgggaactgtgctacaga

SEQ ID NO: 572104 - DNA, 425 bp, Homo sapiens
  misc_feature (395)..(395): n is a, c, g, or t
  misc_feature (423)..(423): n is a, c, g, or t
atgaggcaaaattcacataacatacaagtccctgtatgaaaccatacacttcagtatcattaaatacattcacaatattaagcaatcatcatctctgtctagttccaaaacattttcattaacacccccgccccccaaaaaaataaccctgtatccatcaagcattctccattccctcccctttcccccagctcctggcaaccacttacctgctttctgcctctatagatttgcctattctgggcctttcacataaatggaatcatgccatatatataataaccaaaaggtagcgacaacccagatggccatttggttgacgaatgaacaaacaatatgtgcggtatccatacaatggaaatattggtgcctactacatgtggatggaccctggnaacatcatgctaagtgagagaaagcctngg

SEQ ID NO: 572105 - DNA, 302 bp, Homo sapiens
ggggcggagtgtggaattcttctcgggaggcagtgctgggtccttccaccatggccctagaaagcaagaagagagcggggcgcaatccaaggtctcatgtcgaacagaccaatccaggattaaggaggcttcactatcatggacaaaaggatggtcatgacagacgatctgaagaacttgctgcctggcgatgacgtgaaatgaagaaatgtgaatgtcaggaggctcggtccatactttatggtcctcacaagttgggagaataaggagcggacctgggaccatctcaagctcaagtgtga

SEQ ID NO: 572106 - DNA, 246 bp, Homo sapiens
tcacgcatcaggtaaatttggctaattaaatatacttgtagcagcgtgtgtgacagagcagtgggaaagctacatcattgaatatattgataaaactatacgacttgagttggtttatttttcccttttcctaaattaactaagactgactggaaattaatttccctgtttcacgtctctccccttccattctgcaggagtttcagctatttggagatcgggggaccatcaaggtttggcatttaa

SEQ ID NO: 572107 - DNA, 512 bp, Homo sapiens
  misc_feature (66)..(66): n is a, c, g, or t
  misc_feature (80)..(80): n is a, c, g, or t
tcgggccatctggacttatcaaataagtatgtcctgaataaaatccagaaggacttactataatgnaaacctatgttccnacgcaaatcaatcatgactttcctaatgcttattagatggaccttaactaggaattaaggtgggtgggtggggggggcctcaccggttaggaaactcagacacacctcctaatattgcctccagctcttcagacaataaaaaggttttgcttgagtatgaaaacattagagacttcctggtgtcttattttcaacctctcacagaatgctattatctccttctaaatctttgttcattcttcccccgtatggtgtgtattctcatataacagaactctggcaatctcatccattcaaggttcattttagaaatcatgtacacaaagaaattttcttacctgtgcaccctcactaggtaaggtgcctcaccctaaggacttaccaccatcctggtatgtcatactatatgactattagcttcttcacagacat

SEQ ID NO: 572108 - DNA, 794 bp, Homo sapiens
  misc_feature (683)..(683): n is a, c, g, or t
  misc_feature (794)..(794): n is a, c, g, or t
gaggcttcacaatcatggcggaaggcaaggagaagcaagtaagtcatgccttacatagatggcagcaggcaaagagagcttgtgtagggaaactcccccttataaaagcatcagatctctttgtgtttttttagattaagtctactctgttgtccaagctggagtgccagtggcatgatctcggctcactgcaatctccacctcctgggttcaagcaattctcctgcctcagcctcccaagtggctgggataacaggtgccagccaccatgcccagctaattggtgtatttctagtagagatggggtttcaccatgttggccaagctggtcttgaactcctgacctcatgtgatccgcccgcctcagcctcccaaagtgctgggattacaggcttgagccaccacgcccagctgtagcatattttaataggagaatacaatatataatagtagcaggttaagtaaggcatccatcatctgtagcatttctccttgttttacaaacaatccaattctacacttaaaaaacaaacttttaaatgtacacttaattttatttacacaggtattttatcgtcatatagcagtttttacgagtataatgaatcatttctaaatcttataatatttttcatgcaaaaaaaaaaaaaaacaaacatgggaaaagaaaaaaaaaggttggngccgccgcaaaagttacactctgtgggcgggccaaaatagaagtaatgtgcaaacagggagggggtccaaaaccgggcggtaacaagttgctgggtagcgtaaccgggggn

SEQ ID NO: 572109 - DNA, 212 bp, Homo sapiens
ttatacttatcgcatgtttcattatatgctacctctcattacctctcaacacccactccctctatatccgatattgtgcctatagccatactaatctatggcgtctgcaaagtaatgatagtcctagtcctactaatctctatctccatcacatatagcctagataacgtacataacctatatctactcttacacccttactcttacacact

SEQ ID NO: 572110 - DNA, 392 bp, Homo sapiens
  misc_feature (392)..(392): n is a, c, g, or t
ttctttggctaccgcatccttgcatcgtggtcccaagaagcctttgacacggctgacggttccagagcaccgaatgctggataaatggcctgtagcggtgcttgcttgtccatctaggggaccttacatgcttgagccatcgtaccgctactcatcattgacttgaggaacaggcctactgttgaattggcagggcatgagattattgaccattcgcttccttggaaacgttggatactccttgtcagggtggttagcaggtttgcgccttttcaaccatcctagccgccgctttgatgcccaatctcttctaccttagatgcctaagtcaggtggggccgcgtgtgaatgatctttgcgtccatcaaagggttcactcaggtgatccctcn

SEQ ID NO: 572111 - DNA, 968 bp, Homo sapiens
  misc_feature (623)..(623): n is a, c, g, or t
  misc_feature (773)..(773): n is a, c, g, or t
ggtgactgagctggtgaagaggaaaataacaaggtagcattgaagaagacctcacagttgacgcctcaagcggggcgtttagctgaaaatgaggatgacgatgatgatgatgatgattcactcatgaacactgatttctgattctgatgaatggatgatagaatcatgactactcggaagaccccctcatgcgaacaacggggcctcatagaccacttggcgagacttgatggacgtcgatgtgtggacccaaggtctccgtggcttcgatagttcataggggaaccttcttgcacgaggtcacagtacagatacgtgtacgacatcctgtcagtgtagcattggtatcatgtgagggcacatagatcatgagaggccttattcatattgccttggattgtattattcaccagactgatcgaggagagtactgtgactgacgattcattaaaaggggtgcctcagaggtaccgtgagtgtgaaacacgaccctgaaggaagccctttgggacgcgtagtttggctaattgtgagattgaacctcgttctaccaaaaggcaggatctaggagcgccgatacgggtgcttcttcacttccctggattaatcaagagaaaagttcnttaaagcagaaactagacactcacaacaaacactagtgaagagatagaatatagggccttaagaacgaatgcatgacaacaggaaactctccaaaaagggccaatttgagcgatcggtgggattgtggaggaatgcaatcttgctagaanagttgacagctcgttgtcctaaggcgcgcccctgtcggaactggttgccaactaagcaaccaaggacgccgcgaatgctccggaactaattgaaccacggccttgaatgccgaggaaatggggtccccccggaagttttcgaaaggagctttgtggggcaagggtaaagccgtgggccacgggcagaagaattga

SEQ ID NO: 572112 - DNA, 262 bp, Homo sapiens
  misc_feature (2)..(2): n is a, c, g, or t
antctacaggatcccctggggaacctatctggggaagggagcctactatggtgtatacatatgaagtatgtgcctgcgttcaggcgttctggctgtttgcctcatcggatgatgatatccaatgtgtcgattactgtggtttcgaagaacatatcttatatgattatcttctgtgtgctgtcaactgttactaaattcgaccgaaatttctaggggagtattgctatatacgaggtaccagttttttctccgctgactcgct

SEQ ID NO: 572113 - DNA, 223 bp, Homo sapiens
  misc_feature (213)..(214): n is a, c, g, or t
gaggcggagtcttggtcagctgcccaggctagagtgcagtggcgcaactgcggcttactgcaaccaccgtctcctgggttcaagcaattctcctgtctcagcctctcgagtagctgggattacaggcacccgccatcatgcccggctaatttttatattttagtagagacaggatttcgagatcagcctggccatggtgaaaccccaaaactnntaaaactac

SEQ ID NO: 572114 - DNA, 574 bp, Homo sapiens
gcctcccttttttggtttttttaatgtgttgtcgtgcaggtaaaggtactaaaagtgtgaaaagtaggtttggataaggcgacggatcctaggataagcgtaaaattaaatggtgaaatgataagtgtaagggaaggttagggtggatatggctaggtgtggcgctccaattaggtgcatgagtaggtggcctgcagtaatgtaaccgtgttaggcgtacggccagggctatgggtggaatggactaggctgatggttcgataataactagtatggggataaggggtgtaggtgtgccttgtggtaagaagtgggctagggaattttaatcttaaagcgaaagccaataatcacggcgcccgctcaaaagggcgattggccagggctaggtccaactacatactgggccggctccgcggtcactgactgagcgacggagctccgagccaggtcagcggggcccacacaaaagacaccggactccaagtatcagagaccaggctccgacctcaacggcgtcgtcacatggacaccactcagtcgcgcggtaccgcgcaaccccacggtgcgtggc

SEQ ID NO: 572115 - DNA, 883 bp, Homo sapiens
gtgggcagatcatttgaggtcaggagtttgagaccagcctggccggcatggtgaaaccctgtgtctactgaaaatacaaaagaaattggctgggtgtggtggtgtgcgcctgtaatcccagctactaaggcaggagagtggcttgaacccgggaggtggaggtcgcagtgagctgagatcgcgccagtgcgctccagcctgggcaacagagtgagactctgtctaaaaaaaaaaaaaaaagaaaagaaaaaagaaaatttgaagaacttaacttttctacttttgaaatagataattttttaaaattggtttaacctccctggaaattaagtgttattttttattactggcagttgagaagatacctttccagaggaaaacaagaggctaaatcccagtgttaagagctaagtagtatttttttcttaacaatttttgccaaaatttcttctacgggcccaaaggaatctaactctacaataaatctacttctgaatattatttacgatgggaaatgtcttcataggtatctctgtataatacccttaattagatgaattatccctttatcattcccaaaaatggaaatggtcggtgttacatctctccccggcccaagcggtttgttgactggcaccacgtttgcaaatgggtctctgtccattgcctgttgccctgtcccccaagctgtcacggttcgagcaccatccggctgcaaaggccttattctagaaattgccctaaaaagtggtctggcccggaaatccacttgttttcgtgcgcgccgattccccattggaaaccgcgctgaagtagacgaactctcctcagatttaggagcgagaacacaggattataataagccgccgaaatgtctaagaga

SEQ ID NO: 572116 - DNA, 374 bp, Homo sapiens
cagtggctcatgcaggtaatcccagcatgggaggctgaggtgggtggattacttgaggttaggagttcaagaccagcctggccaacatggtgaaaccctgtctactcaaatacaaaaaattagccaggcatggtggctcacacctgtaatcccagcaacttgggaggttcaggcacaagaattgcttgaaccctggaggtggaggttgcagtgagctgagatggcaccactgcactctagcctgggcaacagagcgagaccctaactcaaaaaaaaaaaaggacagaggggaggaaggagcagaacccaaaaatggcatttagggagaaatctcaggaatgtggcatcccatctccctttgagacctatcactg

SEQ ID NO: 572117 - DNA, 392 bp, Homo sapiens
cccttgaccacgtgcacacgcaggttgttaagtaggtaacttgtatcacaggaattagctgtacagattattgttcgtcacccaggtactaagcctagtatccaacggttattattctttttcttttctttttcattttgagacagagtcttgccctgttgcccaggctggggtgcagtggcacgatctcagctcactgcaatctccacctcccaggttcacgcgattctcttgcctcagtctcccgtttagctgggaatacaggcgtgtgccgagcatgcccagctaattttctgtgttcctagtagagacgggttttcatcacgtcgggtaggatggtctcgatctcctgacctcatgatccgtccccccccggtctctcaaagtgctgg

SEQ ID NO: 572118 - DNA, 399 bp, Homo sapiens
gacaggccttttcgtatggtaaggttcgggcagcactctctccagacttcctagtcatgggcagaaggggaactctccgaaccagtataaatttcacttctctagttatgagtcagcttgaacaatcttttcacatgtttaagcaccagttttatatcctgtgtgtgtaaattttctgtttgtgtcttttgcctgtttttttggtttgagttcattgtagattctggatattagccttttgtcagatgagtaggttgcgaaaattttctcccattttgtaagttgcctgttcactctgatggtagtttcttttgctgtgcagaagctctttagtttacttagatcccatttgtcaattttgtcttttgttgccattgcttttggtgttttggacatgaa

SEQ ID NO: 572119 - DNA, 198 bp, Homo sapiens
  misc_feature (7)..(7): n is a, c, g, or t
  misc_feature (25)..(25): n is a, c, g, or t
ggggacnaggaccaggacagggggngttggagaggctgatgagggggtggcccgtggcctttgagtcacgggggggagggaagtagggggaactctttatcaacttcccacctgtcctgggcctggcccactgtgggcactgctgtttccctgtccacaaccaagctgtaagaaaccccattaaagaattttataggg

SEQ ID NO: 572120 - DNA, 166 bp, Homo sapiens
atctccccgctagcccttaaggggctctaggaaggaagagcaggaaggtattacatgagactgtgtcaggaaggggagaaggggcattagctccctgtgtgtgcccagtccatctgcagtctcactgtctctattacagtgtgatgagctgtcgggctagtcgggg

SEQ ID NO: 572121 - DNA, 868 bp, Homo sapiens
  misc_feature (127)..(128): n is a, c, g, or t
  misc_feature (141)..(141): n is a, c, g, or t
  misc_feature (146)..(146): n is a, c, g, or t
  misc_feature (547)..(547): n is a, c, g, or t
  misc_feature (632)..(632): n is a, c, g, or t
  misc_feature (650)..(650): n is a, c, g, or t
  misc_feature (673)..(673): n is a, c, g, or t
ctccaacccgctaatcagatagtaaatgatcgttcaaacctgtcaaaaaccaaatgtcgagaagagccaggtagctgtgtagcagtgcgatagtgtaagcagagatagggaagggcacctgtgctgnngtgcacttgcttngattncatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaacaagagaaagagaaacaggaattaattcagtgaaggatgattttgctcctagnttctggagtttgaatttctgccaggattgaattcattttgaaatctcctgtctttttaaactttttcaaaataggtctctaaggnaaaaccagcagaacattnagcctgtgcaaaaccatctgttntggggagcacactcttccattatggtgtggacatagatctccctgtggtgggatcttttattccctatttggggggaaggtgggggaaataccccctcttgcatactaacataaattcctttcccgcaacaatgtaagagactaaacccctggtgcgtgaaaatatcacagtgggaaaaaccttgttctttttgt

SEQ ID NO: 572122 - DNA, 397 bp, Homo sapiens
cgtgtattaggtatcacgtagtgtgtattggtatacaaagctacttttaagtactgaaaatatactagtaattatatagtatcaatatattagtatatatggaaatctgaattattgagtgattgttatgtagttaaggcataaaagacaagatcctatattctacaggtctagatatgaaagctgcaatcagccactccattgagtgaaccagagttctgttattagttcgtgaggactctctataccaagtagaatagaacacttgacagcattaatattgtctaggcaatagcatcagactcttcatttatatatgatgaagcttaacacagaaggacaaatgctttcagaaagctatagtccctcactccaaattaagaagatctgtgaagag

SEQ ID NO: 572123 - DNA, 221 bp, Homo sapiens
ctgggagggggccccctttcccccacaaacctctagctccccaccctggttctctgggctggccaattaagactggtctgtcttgggtaaagtactctgaaactcagctccaagtctctctttctaaccaggtgattcccctgaaactccatctatttagaaagtctgtaagttctgaaaatgggggaaaaaaagtgaaaataaatgcaaaggacagtttc

SEQ ID NO: 572124 - DNA, 310 bp, Homo sapiens
ctggttcgttatgaggtacgtcgttatgaggttcggtaaataaatataaaaaataaatagggttattgtatttttgtatttgtttttgtttttgagacggtgtctcactctgtcgcccaggctggagcatagtggtgcaatctctgctcactgcaaggctctgcctcccgggttcacaccattctcccgcctcagcctcctgagtagctgggactagggcaggcgcccaccaccacacctggctaactttgtattagtatttttagtagagatggggtttcaatgtgttagccaggatggtcttgatctc

SEQ ID NO: 572125 - DNA, 918 bp, Homo sapiens
atcattgtgcacccacattcgttaattgtcccccttttttcgcacccctcgctattttaggtcgctctccgcgactcttctttttcttgtctccaacatttatggcacctcgttgcaacgaccacgtgtaccacacccgtataactcggcctcttcccccctcttccattaatctatttggcgtccctgtataaagtacctcacttttttgccgccaatataagccaaaagcagccttcactaatatttccgagcaaacagccctgctattcgcaagacaagtgctccccgttaaatttttcttgatcacaaccaacccgtgcatctggtcataccccccggcttattaaccggtcgttcaccctctaaagcaccctgacatatcgaaagtggtaacattcacccagagggccatttttttctacgggtagataatattattattgactttcttttattgtcccacagaagacaaaaggttagtattaattattgcttgttataaacagaaaggccggaacatgagtcttctcgggcacaggaacgctcgcgttgcggtcgcacctcactatgggaagcgagcttctgttattaatatcctagcggccattgctccccctgtgtttcttcggggcgacaacccacatcatcatcgcctcttcggcttttgatacccacccgttattctaaattatcatcttgtgaaggcacttgattgttcagagatattcccacaattatgattcctcctcccccagaagtatgacgcatttggatggaatggtaccccacagttattttaaatagtgacaataatactcccacaaaagtatcatactaaacagtctctatataaaaattaaggctctcatacctccatcatcaataatgttaaaaaaaaaaacccggccacatgaa

SEQ ID NO: 572126 - DNA, 140 bp, Homo sapiens
gtactgagctcgggtcactatgtacggctgcagttgtctggaatctgtgcttagggcagtggttcagaaatgtactgaatgcaatccttaccatgtgtaaaaccagtctcaaaagaagtaaatgtggattccttggcagg

SEQ ID NO: 572127 - DNA, 270 bp, Homo sapiens
ttaagggctgttaggctcagaggatggggttggaagggaacttgagggtcccagagttcagctccaccccaccagcattgtagagagagctgaggtgcagagagaggaagagaccagctaacgtcacagagtcagcagcaaggccaagagccttccagtcatcctttgaatccagggccaatccagcaacacctgcagagtggattgagcacagcttagaaggaggatgccacctccttcccgagtctccactactccacatctgccagg

SEQ ID NO: 572128 - DNA, 697 bp, Homo sapiens
cccaccatttttcttggggccggggaaaagaagagggccaaaagggttaaatcaccctcccctctgtcccttaaaaaaaaggaggccgccaccattgtacccggaagggttccccccccggctgtcctggggaatgacctctttggggaggccagagggaaaaacattattttagaaccctttactattaaatgaggcccaccatattattttggaatcacctattttaaatgagacaatcatttttagttttaaggtaacagaagtgaccaatgtaatttcccaacacccaaggattttttggttgaacagggtaccggagatttttaccgattgtcccggaagaatagactgggctttttctttttcccccccctccttcgtggtttcccatagtataaaaagcaagcatactttaacttctatagttttcccctttaggggggcctcctcagttttaggggtttacttcccccttgcctttgacccattggactagggcaggggctttaagtagtttaaaatgggcttttgcttttccagggcattaacgttttttatttagtttctttagcccatagtggctgggtttcccccttgattttcaatattttatggtaagaaatggcaaactgctttggttcatttcctaaacaaactctgccttttggtaactattaaaggttgttaaggtgga

SEQ ID NO: 572129 - DNA, 341 bp, Homo sapiens
  misc_feature (12)..(12): n is a, c, g, or t
gaattggtgagngggataacaatttccaccacggggaaacagcctatgacatgattcccgaatttaaatacgacctcacctatagggaatttggcccctcgaggcccaagaattcggaacgagggccctgactctcccactgtttgtccttccctgatcagagcagataaacatcaccgtaccatagatgggacttctagaaattccccacacaggactgggttaattctaaggtattgctttagctctgtgaagaaaatgtagtcaatttgtaaaattgaagtcaatttgtaaaatgactcaatttgtaaatgaagtcaatttgtaaaataaaaaaaaaa

SEQ ID NO: 572130 - DNA, 453 bp, Homo sapiens
atgggtgctctggagatgcaggacgaggaggacagaatcgaggccctgaaacaggttgcagataagctcccccggcccaacctcctgctattcaagcccttggtctatgtgatgcccctcatcagcaagaactttgaggtgaacaggatgggctccagccatatggccatatgcagtggacccaacatgctcaccatggagaatgaccagagcctgttccccatcctcaaaagtccagacaaccaaggatagtatttggcccattaagccaatccccttattagttctagccctggcttcctcattccagccgaatcggaggtcaaccagtaagctaccctttcaccatcattgggcaagtagcatccgcactatgcttctctacaatcttaatcctaataccaactatctccctaattgaaaacaaaaaactcaaatgggcgtaaaaaaaaa

SEQ ID NO: 572131 - DNA, 428 bp, Homo sapiens
atgcacctgaccgacacggtgaaaccctgtctctataaaatacaaaaattagttgggtgtggtggcgtgtgcctgtaatctcagctactcaggaggctgaggcagaatcacttgggcctgggaggtagaggctgcagtgagctgaggtcacaccattgcactccagcctgggtgacggagcaagactccttctcaaaaaaaaaaaaaaaatttagtcaggcatttgtggcaggcgccttgttatcccgtgctacttgggaggcttgagcgcaggaaaatcgctttggaccgtggagaggacagaggtttgcaggtgacgccaagattggcgccacttgacactccaagcctcggcggacaagaagcgagcattctattcaaaaaaaagaagaaaagaaatttttagggctacgttacttgaacccatg

SEQ ID NO: 572132 - DNA, 82 bp, Homo sapiens
accaatagtaagaatgtggctgtaatcagcagagacccctctgaggggtatctcgacgaattccggccggaattccggccgg

SEQ ID NO: 572133 - DNA, 183 bp, Homo sapiens
gtgggtgtacaggtgagtaagcagtgcattacagagtcagagtaaggatgcagtaattggtgggaaatggagcagggatccattcacgtttaggtgattgtgggtctgccaagaagcatggcaaaacatgttcttttctcctcattcttttgccatgcttcttggcagacccacaatcaccta

SEQ ID NO: 572134 - DNA, 454 bp, Homo sapiens
  misc_feature (236)..(236): n is a, c, g, or t
  misc_feature (243)..(243): n is a, c, g, or t
  misc_feature (345)..(346): n is a, c, g, or t
  misc_feature (362)..(363): n is a, c, g, or t
  misc_feature (436)..(437): n is a, c, g, or t
atctcggtcactgaacctccacttcccacgtcagtgattctcctgcctcagcctcctgagtagctgggattataggtgtgcaccaccatgtccaccatgaccctcttcccacgctgacctgtgctccctccccaatcatctttcctgttccagagagggtggggctgagggtgtctcccaatctctggtctcaacttcatggtgggcactgagctggtaactttcttccttccctnattaaanattagaacctgaggtataaatttactcttcttcaaatttccttgccactgaagaggtgtgagtgaggttaatataaaaggaagaaagatttcctataaattnntgaagagacacaaatnnaaaatgtgaacaccatgaggagacccttccacgagtaaaaaaaaacaccaaccaagggcgggggccgctctanngaggtatcacctaagag

SEQ ID NO: 572135 - DNA, 151 bp, Homo sapiens
ggttcacccctacttaggcaacctggcggtcccccgctcccgggaggcaccatattgatgcgcgaacttagtgcggacacccgatcggcatagcgcactacagcccagaactcctggactcaagcgatcctccagccacacggtgcgttgg

SEQ ID NO: 572136 - DNA, 666 bp, Homo sapiens
ctttcatcacgctgacaatcgacggtgtcttgaggtacaggtccgggttttcttcgtcagcgaaggtcagcacctgttgcagcgcttcaatggtgtaggggcgcggggtgatgacgttatcgaacacggccagttggtcgcgctgcttgtccagctccggcgtggtgttgcgcgggtagccgtagaggctcatgcgctggcggttggtcgactcgccgatgaccaagacaagtgtggacggctggccggccatgctgtccttgaggttgttcaagggcgggatcttgcttgcactggtgagcatgccttgcatgttgtccaactgctcggtgtagcgacgataggcgacgatcatctgccaaggcacggcaggctcgatgcgggtttcgaaacgatcgatggccaattccatggtttcgctggtggcgatctgcttgaccagtgggtagcccaccaccgccaggacgatggctatggctgccacgatcgactggccgcgaggcagatacaccgggcgcaagcgcgtccacaggaagatggcgaaggcggtgtgggcaatgaacgccagcacgatccaccaggcaaagtattgggtggcgtattcgccggcttcagagatgttcgactcgaacatgatgaagatgacgctctgggagaatcctgctg

SEQ ID NO: 572137 - DNA, 464 bp, Homo sapiens
agtactcggaccgtcgatctagatagacagtgtggacggctggccggccatgctgtccttgaggttgttcaagggcgggatcttgcttgcactggtgagcatgccttgcatgttgtccaactgctcggtgtagcgacgataggcgacgatcatctgccaaggcacggcaggctcgatgcgggtttcgaaacgatcgatggccaattccatggtttcgctggtggcgatctgcttgaccagtgggtagcccaccaccgccaggacgatggctatggctgccacgatcgactggccgcgaggcagatacaccgggcgcaagcgcgtccacaggaagatggcgaaggcggtgtgggcaatgaacgccagcacgatccaccaggcaaagtattgggtggcgtattcgccggcttcagagatgttcgactcgaacatgatgaagatgacgctctgggagaatcctgctg

SEQ ID NO: 572138 - DNA, 369 bp, Homo sapiens
  misc_feature (160)..(161): n is a, c, g, or t
  misc_feature (212)..(212): n is a, c, g, or t
  misc_feature (221)..(221): n is a, c, g, or t
  misc_feature (224)..(224): n is a, c, g, or t
atcggaggagaacccagcccctgcccacctcaggggtcttcttccaggccactcaggacatttttagcttctgttatccccgtttccctcttttctcaacttccctgtggctagcctccccaccaagaggggcacccataagagggggtgttctgaggcnnccctatgggacaattccacttttgaagtgtcagtgttggggaatatctgtngcctgcaangcnatctcaggtttggggatcccccagtccctatgatcagtgttggggtatcccctgggagcctaggttctttgagccccagccctcttttaactacccttgagtgggtggtccctgtatttatagaaataaaagatccatttcctca

SEQ ID NO: 572139 - DNA, 159 bp, Homo sapiens
  misc_feature (108)..(108): n is a, c, g, or t
ctatgtcgatcgttagccatcagagaaatgcaaatcaaagccacaatgagataccacttcatacccactaggacagttgtcattaaaaagataacaaaaacagctgangtgacagtgcctcacacactgtaatcccagtattttgggaggccaaggcag

SEQ ID NO: 572140 - DNA, 315 bp, Homo sapiens
gtcccttgccttcttaaaagcccccccctttttttttaaggagaagggcccggtcttttcccaagtccccccagggggggggaaagcattgtttttgggtaaattatgtaaagccaaatttttttattttggcccaaaaacttttttattttgtttttttttggaaaaaagggccttggggcccccccttcccccttttttttcccccaactttaaaggtttgaagggttttggtttccctgggggggggggggggcagccagggttttcctgtccctttattttagaccagttgaataaaaggggcccccttta

SEQ ID NO: 572141 - DNA, 153 bp, Homo sapiens
tatcccccgcaagtggattcactggacatcgtactacacgacacgtactacgtagttagctcacttccatctatgtcctatcaataggagctgtatttgccatcatatgatgcttcattcactgatttcccctattctcaggctataccctat

SEQ ID NO: 572142 - DNA, 424 bp, Homo sapiens
  misc_feature (149)..(149): n is a, c, g, or t
  misc_feature (240)..(240): n is a, c, g, or t
  misc_feature (252)..(253): n is a, c, g, or t
  misc_feature (267)..(267): n is a, c, g, or t
  misc_feature (314)..(316): n is a, c, g, or t
  misc_feature (329)..(329): n is a, c, g, or t
  misc_feature (396)..(396): n is a, c, g, or t
actgagcagcaaggaaggtgaatgataaatagaaagggattcttggaaactaagacttttattgggaatgaaaaaccttaaaaaatctcttcatcgtgaactgtgattttccctgattttttccaacaaattttgtgggggttatgtantgagcatccacacatgacccagtgcaggcgtcacgtaaaggcatatcgtactcgaaatctgaagacctgcagcagatttaaattacaactnctgtcacaactnntaaaagattgtggnaaaatcgaaatacacatgaaaccaggtttctacaccccgcatcacgnnntgaaggggggggngggggggggggaccgggggggggggggggatatcttctccccctcgccccactctacctcccctcanccaaccgaatcaaaaaaaaatatatggg

SEQ ID NO: 572143 - DNA, 108 bp, Homo sapiens
gacgagaagctgagcccctacggcgacggcggcgacatgggccagatcttgtcttgccgcctgcaggacaccaacaacttcttcggcgccgggcagaacatgcggcct

SEQ ID NO: 572144 - DNA, 224 bp, Homo sapiens
tttttcactttcgtagcgcaggatgacgtgggcggatagctcacctcgtggcgtgagcggatagcccggtttaacgcgctggtgaggcgaataaagtggcctcttccagcgccggctgttcgccaaactgcgcggtgaccaacggacgcaagatcttcaggaattcatcgccgcgcgccagctgcatttcgaacagcaggcttggcgattcgtggatagcggtg

SEQ ID NO: 572145 - DNA, 1636 bp, Homo sapiens
  misc_feature (627)..(627): n is a, c, g, or t
  misc_feature (693)..(693): n is a, c, g, or t
  misc_feature (1098)..(1098): n is a, c, g, or t
  misc_feature (1177)..(1177): n is a, c, g, or t
ctctatcgttgagttagggagtagctgagtgggcactgtctcttcatgtcattattttctactgcccttgtgatcatcgtctgctgcgttgtgtgctgctttcgtgtcattttagtactggctttggctccgttggtgtgttatcttgtcgttcgctttagtatctctccttcgtgtgttctgttctctattgaaatgtttctttctcttcctaccgagtgttttcttgcgtccttctttggtcccccctcttttgttgttcgacatattaatgagcaccagtgtttgggtagtccaccgaagtagcagcctggttgggttttttccgacattggggtggtttcgtcattactctgcggcctgtttaagaggtgttgtgatagaacagttgtgttgtgtccacaaagagaataccgtgtgtaaagctcgtgtttgataaaatgtctctccaaattttataagaaaacttcttttttgtgccccaattgtgtaataccgcccagaatatttattacgtttgtttctttctagaaacacacatgctgccaatcgttctcgtttgtccaaaggggggagaaaacatttttttgcgggaaatatgggggggaaccatctccactgggaggnggacctcctccttgtgtgtacacgctatttgttatgttgtaagttcgctaagaatttcgttggggnttaaaatttctccaaatgtttgttaattttaaaccctcccgaaacctcgttggggccctaagaggtgttataaccctcctacattatttttggaaaaacttttcaagtgccttaaagttccgtcgcgtgtgaaaaattgtttgtgtaaacccagctgataaattctcacaacgctccacatttggttttgtaaaagctgcctcttataataaatagagaagagtgtgccacggttcacatccaccatgtgcaaaatatgcccctcgtgcggttttctcgattttcgctccacaattatccaccgtatacaattgctgggagagctgttataggagacaccccacaatgtgagatacctctcgtctcgttatatggagaaaactaaactttctacactctatatgngtctccacattgggtgtttgtggtgacccacaatagtttgtttaatatgcacacttccacagtggcaacagtgcctctngtccacagtgtatacccctctatactctttatatggagagtataacgcgtataaatatagaccgcacacactttacacacatctttctgttataagacactcgtgtttatctatactatgggcacactcttgagtataaaatggtcacaggaaaccacacctttaactggcacaaaagggtgccacatgtaaccacccacatgtgtctggaggcacattctgtttttaacacatcgtggaaaaattctaatgagatggtaaatgttttccttcacatgtatagtgcctaattcagaggtttcagaaattttaaaaatgccacaatattttcacatggtcactttgcacatgtagtaagccagaaaaataattcacaaagaggagttttgagaaacccattgtattttaccagcctccaattgtgccaccctgatgtataataaagaatttgaaaccaga

SEQ ID NO: 572146 - DNA, 588 bp, Homo sapiens
ctatattgatgcaggactgccggttataataaatcaaatccacaggaagaagtgactggccagctcttccctgtaggtctgtactgtagtctgatgcaatctgtattagtagtcttgatccaagttgaatctgggttgagagggccagcctgggtttctccagttgggtctcataatgcatctgcaccctggtgcagacatgttgccatagtcacggtttcgcttttgccgtattactttggcagaatacattctaggccaaataggtcataattctttctcatcgaatctcatgacttggcctaattgtggcgtattttgatggtcctcagcacgattattttcttctctgtgagaaactcacttttgtcatatcgtcctgctgagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaa

SEQ ID NO: 572147 - DNA, 434 bp, Homo sapiens
ctcgagaggatccccgaggctccactgcaatgtttgacaagatatcactacatacttgatgtttaaaggtgaaaagccccaccactgacaacaccaaatgctaacgaggatgtggagcgacaggaacttgattcattgctggtgggaatgcaaaatggtacagtcaccctgaaagacagtttggcagtttcttacaaaactaaacatactcttaccatacgatccaacaatcgtgctccttggtatttatccaaatgagctaaaaacatgaccacacaaaaacctacacacagatgtttatagtaacttcatgcataattgccaaaacttaagagcaaccaaaatgtccttcagaaggtgaatagataaacttatacacctatacaatggagtattactcagcagtacaaaaaaaaaagctggcagggcaggga

SEQ ID NO: 572148 - DNA, 253 bp, Homo sapiens
cattgaggactttgctaagaagctctgctgtattttcctctgttgaacacaagctcaaggtaatcttttcccctagggttaagccacacgataagccattacatttcaagagttcagtggagaatgaacagagagagagagctaaagagtgagagagacagagagagcgagcgagagcgacagcgagcgcgcgagagacacagcgagcgagacagacgctcccgagcgagagagccagagcaagcgcgtgaga

SEQ ID NO: 572149 - DNA, 309 bp, Homo sapiens
acactaggatgaatccttggggctaacaccagaggcttcagaacgtaacctgtactcgggcctacagatcattcctgatggcgacggatacgtctcacggtgaactcgtccagcctatggcagtcccatgtatggtaggatctcacgtgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactg

SEQ ID NO: 572150 - DNA, 398 bp, Homo sapiens
  misc_feature (201)..(201): n is a, c, g, or t
tgagatgtttcccccctcagaaaatgatccagagtcctagacattgaaagtcaagtttgcctaaaaagccaaggtttatagatagaaaagaaaatgaaggcccaaatgcggtggctcatgccctgtaatccccaacaatttgggaggctgaggtgggaggactgcttgagcccaaagagttcaagaccagccctggacagncatagaaagaccccatcttgacaaaataacaataataataatttagtcaggtatagtgatgtgcacctgtggttccagttactcaggagggtgagggaggaggatcacttgaggctgggagggaaaggctgcagtggtgagccatgattgtaccactgcactccagcttgggcaacagagtgagaccctgtctccaa

SEQ ID NO: 572151 - DNA, 460 bp, Homo sapiens
  misc_feature (278)..(278): n is a, c, g, or t
  misc_feature (416)..(416): n is a, c, g, or t
gtgtgccactccacatactgcttatcctcttctgaccttacctctttccatagtcccttctcctcattctctaggttttagccacattagccttctctctgtccctcatacattccaagataatttctggctcacagccctttcacctgcttgttccttcttggaataccattccctccagatcttcaccagactgctgcttctcgataataaaatgacatctcacacagccataaaaatgaatgaaatcatgttgtttgcagcaacatgtatggagntggaggccattatccttagtgaactaactcagaaacaaaagaccaaatactaaatgttctcacttgtaagtgggagctaaacaatgggtacacatggacataaagaaggaaataattaacacttggggctccaaaagntagggcagtgggttgaaaaattacctaatgggggctgggtgccg

SEQ ID NO: 572152 - DNA, 364 bp, Homo sapiens
cagatgtacacatacagtatatactgtcaacattttttctcattataaaccaatttcagctcacatcagacgtataatttcaaagccagacatgatactgggttaaaactgagtggtatgttgtgaatgtgtcttctctccccaaaaagcagcaatagtagtagatctaacaataccatagactcatgactatgaaatcgtggctatttgtgttaacatgttgttcctgttgttgatgtgatacaaagctcctgcaaaacagttggcacagtccagtgcactggcttccctcactggactcggtggactgggtggttatggatcaggagacagagaagatgagaggagtgacagaggatctgag

SEQ ID NO: 572153 - DNA, 110 bp, Homo sapiens
tggcgttgatgtcggtgtagcgggggtgctatacggtaaatactgggccctatttcaaagatttttaggggaattaattctagtgacgatgggcactaaaccgtggtttg

SEQ ID NO: 572154 - DNA, 258 bp, Homo sapiens
gccgggcctctctgacgcctgcgtatcctcttgtgatgagacagctaagcaggcagagccggcctcggagggcggctcagaaggtcagaagataccatgctattcttatttataagcagtcggcacgaagataactgaagagcccagcagcaaaatggataacgcgaaatctcgcgtgtagtttgcctgcaaggacaagttacttaaggtatctacccggccatacccgggctaccgaggctcgacattcagtaatca

SEQ ID NO: 572155 - DNA, 255 bp, Homo sapiens
gatgatgaggttattccaggctcaaaacaggacaacagcttaagactagaattgtgaaactatctaacaggctttgggtattaatgcgtacatagtttcaaagcacctcccatcgtgatattatttactaaggggaaccataactgtatgtcaagaactgaggagactgagagtatattctgctggtaagctaatacatgtgaactgccagttttcatggacactggtaaaagacaagactattacagggttaca

SEQ ID NO: 572156 - DNA, 749 bp, Homo sapiens
cccgcgaattcggccattatggccgggcactttgactcacgccagtattcacagcaatttgaaaggctaaagcagtcacctgactagagagcctgattgctagccagccctcatctaacctggataataccctactatctcaacagtacaaacatttagtccccattctcgcaggacaccggcacccccactctttgacaggctgtcgcagtagtaggatttgaaccaggcagttaaggcttcgcctcatatatcggcttacagacctcagtctgctcagaccatacagactccttgtactactgctatgagacgacagaagcacaggcgacatgcgacaaggcctaccactgcgaccagcgatcattgcgcctcatgacacagactaacagccattgaaggatcagcccttcccattcctacctcatagaaagtcactcgcccactgactcacatatatgccaaatgacttacacacgcagtactattcccccttatcccagctacgacctacctcacagttagatactaaccctcctctcaagaacttcagaccctaccttacatttcctagcttgcgcacacgtactagcactactcacttacttccacctacgacccgcttttcaacctaattggctcaatctcccgcgccagtaactctagctctcccgctccacctcccactctgcctacttagccgaaccccttcctatctcactcgagctctctatacctccctcgccccg

SEQ ID NO: 572157 - DNA, 869 bp, Homo sapiens
cgccgcaactggtagctgacagcacgacaaagcgtcggtgtacgcgcggggtaaaccccgggtggaacgacgggaccagagaaccatttgtggtgcggcatatacttaaaggggcaaccaggccctcctgggaaaggccctctggtgaaggtcgcgcccaacctagagcccttgcgagagactttcataaagcggcggaatgccctgtaaccagagcgccctcaaccggaaccgtgaaagcacgtgggataaactccacgcaaatcaggcgaattccggggcgccttatacagggcaaaatgcacggcccgctaaaaggttacaaagagcttgcccccaggaaaatacttaaagagccggagtaaaaccaagctggccggggccgaaaaccagggccggtcccggacaagacagaccgacgggcagcggcaccgaggatcagccgaaacggcccgcaccaggccctcccaagcaacccgaggggaacaggcgagctcctcccaccggcaaccggcctcttggtttcccgctgccgctcaaacctgggaatacacccatgtttaggcgacgagtcaacaatcgacgaaggagtgttacgcaaaatactcgccggcgtgcaaaaaatgtaagccgcaaatgtccccgaagtaaaacgaagatattagggctactggggggtgaaaaaacttggataataacttatattgttataaagtgccaggatatggacacttctggccaaaatattgttttgcaaaacgtgcttcctcaaaaaaacccctcctgcggtgagatgtagttctcgcccccaaatgaaaaaattcatttaaaggttttaaaaaaaaatttttaatttttaaaggcccaca

SEQ ID NO: 572158 - DNA, 135 bp, Homo sapiens
tggcgaagcatgtctaggtgccggaagccgtgactgctagcaggtaagccgtggtacggggaatgtaagtacaggagtgcggcggagaggacaaggactactgctctggctcctaggtaaccccaagtagagctg

SEQ ID NO: 572159 - DNA, 1244 bp, Homo sapiens
  misc_feature (172)..(172): n is a, c, g, or t
  misc_feature (217)..(217): n is a, c, g, or t
  misc_feature (969)..(969): n is a, c, g, or t
gtggggacctaagctatttggtgtccagaccacagaaaccacttcccagtgcaactgttgtcgcgcattgcccccgctgtgtgtggaactgcgaccgaagggaatgtgccagtctctaggctaagaccacatcaatcgagtagtaagccttactgggtagtgcttctgagtngagagatgaacgcgactggactcgtgtctatgatgttatgctgantatgacacactaggcggggtctcgcgcgaagcatccgccacagtgacgtgggtggctgctttactcgtacgcaattgactgtctgctacacgtggaagggcccataggcctccgtgtgcctgaacagtactactttccttgcatggctgaagcacccttgtttttgtcctcatgtcgtaggaatcgtgcatttgtgtagacgtcggcaacgtcgaggacgcgctcttctctctaagacgcctggccccttatgccgacctgtgcgagacctctgcctaggatgagatgagatacacgaaagcgggcggtgtcagtggtccagttggacgcccatccagggtgtctcttctggatcttgggaaagggcacggtccacatcccatccgtttggggatttgaagggggcacgtttgactctctttgatgtcgcccatgtcctagtgtctcgctttttgagtccaccttggggtcgcgcgcgcatggcggtcttttcctcgtcgtgttgcggccgactcctgaccctcctgccactcaaggtggcaacgcgccgtcacgcaacgcccgtgtggtcccctgaggggcgcgtcattcaactatgtgtagggacccaaagaggcccagtcccaaaaaaccacacaagtgcccacggattccctatttcttggagacaccgcaaatttaggaaaaggccccttgtgcaccattacattccaggggccttttctttgtccacatacgtcgccctctggttncacttttttcccccgaacattggttaaagacttaagggcgaattaagggcggaactcctcatggtggcgaaaaacgcccaggcgcctaggcttttcgcggcttgtgcgcatgtttgcagggggacccaaccttcagaggtctgggtgggtgccccacacgggagattttgcctgcactttggttccaccccccttggcggctttccaaagcgttggttggcacatttccttgggggcgttttacaccccggttgcgttccttatacccctcttag

SEQ ID NO: 572160 - DNA, 563 bp, Homo sapiens
  misc_feature (20)..(20): n is a, c, g, or t
  misc_feature (38)..(38): n is a, c, g, or t
  misc_feature (149)..(149): n is a, c, g, or t
  misc_feature (154)..(154): n is a, c, g, or t
  misc_feature (167)..(167): n is a, c, g, or t
  misc_feature (173)..(173): n is a, c, g, or t
  misc_feature (211)..(211): n is a, c, g, or t
  misc_feature (215)..(215): n is a, c, g, or t
  misc_feature (261)..(261): n is a, c, g, or t
  misc_feature (370)..(370): n is a, c, g, or t
  misc_feature (377)..(377): n is a, c, g, or t
  misc_feature (434)..(434): n is a, c, g, or t
  misc_feature (436)..(436): n is a, c, g, or t
  misc_feature (476)..(476): n is a, c, g, or t
ccaaacgtgtgaatgagcgnggtagggtgattaggttntaatgggatggtaatgggcatgtgatcagttgccagggaaggagtagagatgtcccatacttgtggcttaaggtggggggatacgagaggaagacgtgaaggaagctttgngctgnggagaagggcggnaatganatgcggctgtagtccaggaatagtcagggaagcagatnattnggttaaagtatctcggcctaataagggaactgggcaggtggggatnactaaaaaagagtgcataaaagagtgttgtctaagttggcaccagagtgggggagttttcaggggttttgaagcccatgctatagcaggcgagtgataacaggctttantcctttnaaagcatgctgtgggatgggatattggcgttgagcggggtaagggtgattaggtttnantgggatggtaatgggcatgtgatcagttgccagggaaggngtagagatgtcccatacttgtggcttaaggtggggggatacgagaggaagacgtgaaggaagctttgggctcagtcgaacggactga

SEQ ID NO: 572161 - DNA, 464 bp, Homo sapiens
aacgatcacccgtacgtgagagcacagatctcatatgctttgaagacacttcttttcttatatattttttttatgagaagcagtctcactggtcgccaaggttgaagtgcagagacacaatctcggctcactgaaatctccaattccggggttcacgccattctcctgcctcagcctcccgagcagctggaactacaggcgcccgcaaccacgccgggatgatattataggtattttcagtagaaacaggtttccactgtatatccaggatggtctcaatctcctgacctaatgatttgcctgcctcggcctcccaaagtgtgggaattccaagcttgagccaccgtgcctggtctcagatggaattatacactaaggtgctcaaagtaaggctatagggtactatgacatgtgagcagagtcttacaggaagtgacataatgacgccgtgtgattacaaaaaa

SEQ ID NO: 572162 - DNA, 329 bp, Homo sapiens
tcagtttgttcattttcaaaggtcttgcaaaagttacatgaccttcatttatctacaattgttctcaaataaattattccagctaagcttaaacttttcagtttcatagtattttcctcgtattcccttggttttaaaaaagtaataatgggccaggtatggtggctcacacctgtaatcccagcactttgggaggccaaggcgggtggatcacgagctcagaagatcgagggccatactggtcaacatggtgaaagccggtctctactaaaaatgcaaaaactatctgggcgtggtggtgcgtgcctgtaatcccagctactcgggag

SEQ ID NO: 572163 - DNA, 220 bp, Homo sapiens
agtaaactcataacgtttacagtagataggtaaagcctcagtctggtgaaaagctcccgagtttaaccggggaccctactataatgcgtgcgctcccattgcgaagctgattaaaatctgccaatcataacccatccctaaacacatcagatgatagtggctttgacctagggacagaagaggttaaacgaagaacccccaccaggtatggattgagagt

SEQ ID NO: 572164 - DNA, 280 bp, Homo sapiens
cttcggcgttttacggcccactggagggcgtctgttttgcgactgtccatggaggttcggcctgtgttcccatgagtcaccaggttatgctggagcgtcctgggagagagtcgtgattgggagtagcttgacgaggcctggcactgcccttccctcttcccaaggtcttcatctttgcagaccctgatgattggccaaacaggatctcatatccctcgccaaagggacttcctactttacaggggctaagtggtagcgaggaggctggacagtccctcaa

SEQ ID NO: 572165 - DNA, 190 bp, Homo sapiens
gcaccctgcaggatgcaagcatgtcgtaataaggaactggaagagaactagctctcagggcaccttctcctactcacagtctgtcacatattagtcggtgaatgtatgaattaggtttgtgaaaagctgggatgcaagttatctctgcctattacgagtaaagcatatcgctcccagcagccagcatagg

SEQ ID NO: 572166 - DNA, 136 bp, Homo sapiens
cacgtgtagtggaagttcggatgtcttccttttcagggctgaataatattccactggctggatggaccccatttgtgatggattgtagatggacagctgggttctttctaccctttgactgttgtgaatagtgctg

SEQ ID NO: 572167 - DNA, 136 bp, Homo sapiens
tgcatctgaactgatgacttcactgaatacagcagccctccgatgccgcatcctgcccgtcagagcccgcatgcctgaggcgaggtttcgtattccttccgaatatttagacatgctagtattcccctccttctca

SEQ ID NO: 572168 - DNA, 437 bp, Homo sapiens
cacagagagaactctgtagatctgcagaagattcttcttgagtcttcaactgagtactaacaggcacattcatgtgaagaaatcatatgagacaggagaaagaattacttcaaagaattaagaaggaaaatcactggagcccacagggccagaaatactttctgtttctactagccagactggaaaaatgtgtaattcacatggcttcagataggatactcagaagggttatgcttcagtagtgggtacaatttagttttagattaaatgtttttctggtcttaaaaaagatctgaaggaatcaaactgctgcctagtaacttaactgtatctcaatacagagcttaagtatatttatagggacataaatatatttagcacccagaaagacaaaattcacaatgtctgacttccaattaaaaattgccaggcatgca

SEQ ID NO: 572169 - DNA, 283 bp, Homo sapiens
gctgggactacaggcacataaccactgtgcctggctgtttttctacccccatcatttcaggcaacaggataaatccagtccctgttactccattgtggctggaagcagaaggtccacacttaagtactttaaattcctacaaacctgaacctaaaatatagacctcaacaactgtgagtctctgtgattttgcagatctaagtttgtggaaggctagtgcctgagaaaggcaaggattttggctgaatgatgtgaatttgctcctgattcttatgtaaagctt

SEQ ID NO: 572170 - DNA, 99 bp, Homo sapiens
tcctccaaaagtagttgctgccctattggctgtatgtctgcctgcattcttaattctgccactgccgggtctacttacctacgctcctgaccaaagctg

SEQ ID NO: 572171 - DNA, 348 bp, Homo sapiens
  misc_feature (259)..(259): n is a, c, g, or t
  misc_feature (312)..(312): n is a, c, g, or t
cgagatcgcaccactgcactccagcctgggcgatagagtgagactccatctcaaaaaaaaaaaaaaaaatattgcttaggaggctgaggcacgataattgcttgaacccaggaggcaaagagctgagatggcgccactgtactccagcctgggtgacagagtgagactctgaaaaaaacaaaaaaggcctgtcgcagtggctcacgcctataatcccagcactttgggaggcagaggtgggtggttcatgaggtcaggngttcaagaccaacctgggccaagatggtgaacctggtctctacttaaaatttncaaaaaaaattttagcttgggcttggttgccgggtt

SEQ ID NO: 572172 - DNA, 519 bp, Homo sapiens
  misc_feature (504)..(504): n is a, c, g, or t
  misc_feature (507)..(507): n is a, c, g, or t
  misc_feature (510)..(511): n is a, c, g, or t
ccatcataagttgtgcagcgtctttatgtataggcatttacatagtatatatggacttggtctatatctgcatttttaggcatccgtaggggttcttgaaacatatccccctcggataaaggggaagcattctatatataacaagatccttacttaaggaattggctcatgcaattatggaggctgagaagtcccaagatctgcagttggccagctagagatccagtttaccgactctgtcacttgaccaatactgaccctctttaccttgcttcacgcggacactttgcatccagagacactttgcatccagagacactttgcatccagagacactttgcatccagagacactttgcatccagagacactttgcatccagagacactttgcatccagagacactttgcatccagagacactttgcatccagagacactttgcatccagagacactttgcatccagagacactttgcatccagagacactttgcatccagagantcntcnngatcacta

SEQ ID NO: 572173 - DNA, 232 bp, Homo sapiens
  misc_feature (217)..(217): n is a, c, g, or t
  misc_feature (220)..(220): n is a, c, g, or t
  misc_feature (223)..(224): n is a, c, g, or t
gcagggttgcccaaggcctgaggtcccgacacgtgtgcatcagaggacacttgcagtcagagacactttgcatccagagacactttgcatccagagacactttgcatccagagacactttgcatccagagacactttgcatccagagacactttgcatccagagacactttgcatccagagacactttgcatccagagacactttgcatccagagantcntcnngatcacta

SEQ ID NO: 572174 - DNA, 263 bp, Homo sapiens
  misc_feature (248)..(248): n is a, c, g, or t
  misc_feature (251)..(251): n is a, c, g, or t
  misc_feature (254)..(255): n is a, c, g, or t
tgaggtcccctctggatgcaatggtcaaggacgctggtgctgaagtcggcgtgtggagtgctgagcgcctggtggctggcaagctcaagaaagacactttgcatccagagacactttgcatccagagacactttgcatccagagacactttgcatccagagacactttgcatccagagacactttgcatccagagacactttgcatccagagacactttgcatccagagacactttgcatccagagantcntcnngatcacta

SEQ ID NO: 572175 - DNA, 328 bp, Homo sapiens
aaccccagtctcataactaaggagagcatttgctgcagtaaataggatagagggacatagtctgtgggatgcaagccacggaagcagggtgcctgagacactgagtggagccagaaagatcatgcggcctttttccaagtacatggccaccaagtaagaatggtaggtgaccagacagaaggctaaaacaggaaggcaatcttgtgcacctaacggatagaaagagagaaaggatcaaacttgaaggcaggctaataagagtatccagaaatttcttaaaaacccaaaagtgatattggaaagcacaaaacttacagttaatagctac

SEQ ID NO: 572176 - DNA, 87 bp, Homo sapiens
gtgggtgagtccgctgcacggagactctggtgtgggtacaacatagggtttttatacaagaaaaataaagtgaattaagcgtgttaa

SEQ ID NO: 572177 - DNA, 231 bp, Homo sapiens
  misc_feature (216)..(216): n is a, c, g, or t
  misc_feature (219)..(219): n is a, c, g, or t
  misc_feature (222)..(223): n is a, c, g, or t
aagattaggtctgaattcagaagaaagtacggtagtccctgtactattatatccagcaagtacactttgcatccagagacactttgcatccagagacactttgcatccagagacactttgcatccagagacactttgcatccagagacactttgcatccagagacactttgcatccagagacactttgcatccagagacactttgcatccagagantcntcnngatcacta

SEQ ID NO: 572178 - DNA, 90 bp, Homo sapiens
ttagctaaaggggagatctggatggcatctacttcgtatgactatgcagagtgccatggaagacggggataagcgctgtaagcttctgct

SEQ ID NO: 572179 - DNA, 178 bp, Homo sapiens
  misc_feature (163)..(163): n is a, c, g, or t
  misc_feature (166)..(166): n is a, c, g, or t
  misc_feature (169)..(170): n is a, c, g, or t
ctctggatgcaaagtgtccaatgatggtaaaagggtagcttactggttgtcctccgattcaggttagaatgaggaggtctgacacagccttggacactttgcatccagagacactttgcatccagagacactttgcatccagagacactttgcatccagagantcntcnngatcacta

SEQ ID NO: 572180 - DNA, 421 bp, Homo sapiens
  misc_feature (220)..(220): n is a, c, g, or t
  misc_feature (226)..(226): n is a, c, g, or t
  misc_feature (258)..(258): n is a, c, g, or t
tagtttctttccctcttatatttgtgaatcacagggtctctaaaacctttttaaccgatggttgttctcagagggcacagaataggcagaaataaaggtatgaacttccaggaggaatccgtctaggcaaaatagctattggtatacacaatactatctgtaagacttgtgctgatagtctgctaaaaatatacaatagaaaagagttcacaagcatggnggaganaggggagtggaggatgaaaaattacttagtgngtcaatgtgtcttattccatactaaaagctctgacttcatcctgaagcaaaatattcatgtaacaaaattacacttgtaccccaaaaatttatacaaatatggaattttaaaaaacatattgagttctaaattctgatatttggtataaaatggctgcattcc

SEQ ID NO: 572181 - DNA, 1204 bp, Homo sapiens
gccagcccatgacccctaacagggtgcccgtctcagccctcctaatgacctccggcgctactcgcatgtgatttgcacttccgatcgtctcgataagcgctccctcatactagagcctactaaccaatcacaccgtaaccactataccaagtgagtggctgcgatgtaacgacgagagaagcacagtaccagacggtccaagccacatcaccacactgtctcaagataaggccttcgtagtacggtgcataattccgtactttagttacctcagtaagttttgtttgcttcgtcgaggatttgtctgagaccttttatgcacgtccagtgctagccctcgtatcgcctccagataaggagggcgcacgtgggcgccccctgagcaggcgatctagccctgcgtgaaattcgcccgtagaaggtcgccacttcctatgacactatcccggtagttacttgcgcagtcacggaggtactcaagtcagccgtagagcttcgaaccattaggtggcctataggtagagaaactgagcgcaggacataccaaaataattccacaagtcacgtggcgttcatttactagaatttctagcttggcgctctcgtactctgttgacgccgttcgcgtagcaaagctcgtccaggaggtgacgttgccgaggtcttccctttcacgcgattttgccgacgtgatatcctaacgaggtcacagcacttctatgtaggtaggccagctaggcgttcgccacgggactgtcaccggtcacttgattgggctcaaactttgcctcacgtatctgcttcatccgcccaactaatattttcactttagcatccaaaaacatcaactttggcttcgaaaagcccgccgcctgatacctgggcattttctggtaaggattgtggggtgttgacatcatttgtctggtaatgtcttcccatcctagttttgattgaagcggtcctgtcaacacattagaagggcaaaccatggaccacggcgagacacgcgtcgcgacgcacataggtttgctcccactaggccacgccatgtaatttgcacccagtgaaagccatccgcattgggctgacaacaacaacccaccgcggtgagacacatggttcccacacgagggggacactgtgcggacaccggggcaccacagtgtaacccgaggggcctcccagggtgaggagcccccaa

SEQ ID NO: 572182 - DNA, 165 bp, Homo sapiens
  misc_feature (94)..(94): n is a, c, g, or t
  misc_feature (115)..(115): n is a, c, g, or t
cccggccgccgaacggctgcgagagacgacagagggtggtggaaaaaggcattgaaggacttcacctggaaacttaccaaattctgcctgagtntgggactaatcccctgtagantgggccaagctgtgaatgtggcttcgagatgattctatgaatagaatctc

SEQ ID NO: 572183 - DNA, 360 bp, Homo sapiens
tatggtctgaccctacagttctgtccatgccagggcagataccaaggagctgcagagttcgtcgtcagtggcagcccatgcgagcacccgaggaagtcacaggtgcccaggccggagtcagtggcgtgatctcggctcgttacaaccaccacctcctagcagcctgccttggccttccaaagtgctgagattgcagcctctgcccagccgccaccccgtctgggaagtgaggagcgtctctgcctggccgcccatcgtctgggatgtgaggagcccctccgcccagcagccgccccgtctgagaagtgaggagcccctcagcccggcagccaccccatcttgaggaagttgaggagcccc

SEQ ID NO: 572184 - DNA, 669 bp, Homo sapiens
cgctgcctgggtggttttaaaaggtagaaaaaggtaaaaaggtaattttccttccccggtagatatcacagcttaaaaaaaaaaaaaacaccggaccgagttctctcctcgccgcattggggcagagcccggaggaccaactgaagctttaggctccttcctaatccacttgccagcccataaagaaaggttgcttccggcacaggatataatagctctgtttgtgtctaaggagaataaaaatttgcctcgaaagaaggtttcctccaagaaggcgaataacaaagcatcttgtgaaagatatgcccaatatgccccaggctatgcaaaagcaagggcagtttcaaaggtggtcccccctgggttcctttgtactgcaggagtgagtccttatgatgaccccaatacttccagaggtgattctggcggccccatgatagttcacaagagaagccgtttcattcaagttggtgtaatcagctggggagtagtggatgtctgcaaaaaccagaatcggcaaaagcaggaacctgctcacgccccagactttcacatcaacctctttcaagtgctgccctggctgaaggaaaaactccaacatgaggatttgggttttctataaggggtttcctgctggacaggggcgtgggattgaattaaaacagctgc

SEQ ID NO: 572185 - DNA, 342 bp, Homo sapiens
gaggtggctggggcctcttctgtgtatcctggtaagctgtaagaccggttggtcagcgtggaaggctggatggatggcgcatggagtagagccaagctgatgcgatatctgcaagaagtcgaggtctgagctctgtccaaccaatatgtatcctgtggggagaagaacttcagttctctaccataccctacacaatgcagaaaacaagtttgtatggaggatgcggggcatgctgattgctcttctggtctcctaatgaaggagttggcaaactaaatccacacgaagaagtgtgtaacgagcaactaccaagggacccacacacctagtgggaaggtccga

SEQ ID NO: 572186 - DNA, 130 bp, Homo sapiens
tacctaatggctgtgcgctcgttgtgttctcggcgagcagttttgttgatttaactgttgcaggtttagggctaagcattgtgaggtatcgtatcccagttgtgggtcttagcttttgtgtgttcagata

SEQ ID NO: 572187 - DNA, 297 bp, Homo sapiens
ggggctatgttcgacgattccgtagatcatggttgtagctgcctatctgtgtcaaacaggactcaccagatcgctatgatgctactgagtggtgcttcagggctctgtagggtccaccgtgaagccagggtcccctggaggtgtgcccaggtgtacttagcagagatcccggaagaccccaagttcttccgggatcacaacaaattgcggctctgcttcaaggacttctgcaagacaatgtgaggatgcgctgcggaacagtaaggccctgattgggccggaccagaaggagtaccc

SEQ ID NO: 572188 - DNA, 777 bp, Homo sapiens
  misc_feature (731)..(731): n is a, c, g, or t
  misc_feature (733)..(733): n is a, c, g, or t
tacaggtgtgcgccaccacactcagctgatttttgtatttttagtagagatggggtttcaccatgttggccaggctggtctcgaattcctgacctcgtgatccactcacctcagcctcccaaagtgctggggttacaagcgtgagccactgtgcccggcctgtgcacaggagtttataatttaatggtcttatttattttttttttgttttcttctgttctttttcttctgcttttttttttttgaagtcttatttattttttctttgtattgcttgtatatttggtgtcatagtcatgaaatctcatatatcttttaatttatgagtggtttatatcttggagtatttttctgcttgttgagttaaaaaacacccaggcccactgcaaatgctgcacaagttgtgcaacacagccctgctcaggattctggctttgaaacctgagatagactgtgagttctacaaggaaaaaaaaaatctggcagggtcagtaaaattagagaaaaaaacatcttctttagaaccaagagggaaggcacagcagaattaagattttgctctcctgtgtcctgaaactttaccagaaacatatatttagtgttaaccttgcagaaggatcattcctcctgatataaagggattgctttttctggattgtacctagttttagtgcacccacatccttgacaagatgttcctctgtgtctagttatgacagagctaacaaccngncttaatagggcactcattaatcagaatgaatgatggcagtaacc

SEQ ID NO: 572189 - DNA, 126 bp, Homo sapiens
acccagtatgaatgtgcacagaagcaggaagtataagggacgttgtgagacacgaaataaaagttaaggagtctgaagaccaccataattttggacagcaacttcaacgttgggggtccccagaac

SEQ ID NO: 572190 - DNA, 278 bp, Homo sapiens
ggtctctatgattcgccgtgtctagatattttataaaaataacacatgtggcctttcgtgtctgacttccttcacttagcatgtttcaaggttcatctatgctatagagtgtaccagtgcttcattacattttatggctgaataataccctatggtgtggatataccgcatttagtttattcaccagtcgatcgaaatttagactgtttccactttttggctattatggatgatgctgctatgaatattcgtatatgaatttttatatggatatatgt

SEQ ID NO: 572191 - DNA, 1439 bp, Homo sapiens
gtcctaagtcctcgttgtacccagttctattcgcgagtggctttcactaatagcattcaccgaacgaggaatgcctaggctatagtaccatctactggaattcggccccaaacgtgggtaccggtgccgtgagtaggcgctagctagcataggccgtgtccgccttgatgccagattaaatcttctgtcaacgcaacatgacgccacctaagagaaccctgcacatagtctagccactcacccgtcgtagatcaccgaccccggagcctgacggtctcaggcatcggctctgtgctactagtgattcccgctcgatctgtgataccccagaccccccgtggcatcaaatgtgttcggagactatgactctgcgctgagtagtaatggctaagggcgattcctgcttagccctaatgttgtgttcatgtcatatttgctgctggagtaccgtggtgtagatgttcaggacccccacagactatcgtgccccaggcactcggggtcgtggagaatggtgcagttcacagtgggccgccacatgccaatacatacggctactgtatagtctcaacaccgtagaggcagtccagtggctatagctagtcagaacgaaataccagatttcccgggtggtgctccgtgttgacgccattttggaccccggttatcagaaccacaccagtagagcaaacatcgtgacctttaactccactgcaaccacgggtgaccgccgtttggtaccctgtgttatgcagtgtacatctacccgaaccggtggaccagatagcaaccgagacggaaaaccctcgctgtcgtacagcaagtggcgaaagcccgcagtctccctaaatgaaaaaacttgggaacctctgagagcaggacctgtacagcgaaggtgccggtcagggcgaaaacctgcgtaggcccagtagggtgggacgtgattagggcaccaaggggccctgacgcggcacggactccacagcagaccctaagacgggaagacacgccggaggggtcacgcagcagaacacacgcgcgcagaagaaccccgggtctacagcgccggggcgccacaaagtcgaagccacaaagcgcgggcaacgggctcacaccccataggtcgcgacaagaagagcgaccaaactcataggcaaacaagcaacatcgcgtcagtggagccgacccacactcctatgcaagcaaacaacaaccgggggagacacatctcgacagacgcagtagcaagtcacgaacgcgaccacccaggcatacgacaacacacgtcatcgacctcatcacttgctgtgtctgcggtcctctgttgtttaaccaatcgtcagcgaaggcagcacgtacaacaccgcgacgcgaacgcagcagaacataaagcagcgaaacacaagaccacacgaaccgaacagaagcacaacaacggt

SEQ ID NO: 572192 - DNA, 755 bp, Homo sapiens
  misc_feature (755)..(755): n is a, c, g, or t
cgggtcactggacacacccgggcctggagctggatgccggggatcccagagacgagcccggggtttagtgtgcgcgacgggctcgcctgaccgtggccggccctgcacctgtggggcgcccgcctgactggagcaacgctggcagagcggttttcctgacgcggcgctgtgtctcgatgtctgtgctgggagctaaaccggcagctgcggggctgctgggcgctgacgatggcgctgctggctgaatgcagatggctgccgcacgctgaagaaccgcggctacgcgcaggcctgtcgctccaagcggcttgcagcatgctgtgctgctgtgtgctgtgatggcctgatgctgctgccctgccttggcctgcccagctggactgcggcttgctgtgggccgatgggtgtgccctgcctgtgccctgtggagctgcgatctctacaaggctctgctgtgacctgggctaaccctcgagcggccccgtggtccggggacccctcccacctcttcctctgagccgttcagagcaccttgtggtgtagtgggggctgggtggggtggctccgcccaggaggcggctgcacggttctctgccatctgttaccagagcgccttctggtcctagccacgcctgtatgaccgcgcaaatatcccaaagctttgggtcctcaagtcatgccggaatttagatgctggtcattttctggagaaggggtccccttcccttagaacacaaaaacccagccacataatn

SEQ ID NO: 572193 - DNA, 168 bp, Homo sapiens
aggatccgtaatgaagcaagcggcagtggacttatcgtagtgggggaaaggggtgtccgaataatatccgggaagtgatcaggacacctattttaaatataggccggaatttggtaaagtactatttaagggtggtccgtgtatacttaaataaacatgcttaatggt

SEQ ID NO: 572194 - DNA, 102 bp, Homo sapiens
aatcttgcactttgaaaccgcgggaccgaggcagggtgcgcgcgtgtggttgtgtgcctttttttttttcttcccctccctaaacccttctgtcgtcttctc

SEQ ID NO: 572195 - DNA, 465 bp, Homo sapiens
atgctccttccccccggcactgagccctcccagctgtgctgtgctgggaacaggccaggcgtttgtgaaatcctcgggtgagcctgacccactgtcatgaggacttgcctgtggaagctggtgccgggagggggatggggggctgttcccagaagcgggtagaactctggacttcccactcctgagcgctctgattgcagcacagccttaagcaacagtagcggcctggaaggctgggctgcaggctggaaggctgggatgcagcctggaaggaaggctgcgctgcaggctggaacactgggttgtaggcttcaggctttttttcagaaaagaaattagggttctgaatgctaagacgttgggctcttccagttaacaccatcactgccggtattcacagcactattcaggcccagcctcaggaagcgactgcaaacccagatataaaaaataaaaataaataaa

SEQ ID NO: 572196 - DNA, 211 bp, Homo sapiens
gactcgcgggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagtc

SEQ ID NO: 572197 - DNA, 282 bp, Homo sapiens
ttcattcacctgctgaagaacatccagtttttcaatattaagctgctatgaacatttgtgcacaggtttttattggaaggttagttttcatttatctgggataaatacagagtgcaactgctaggtcatatggtaattgcatgtttcacgtcataagaaaccaccagccaggggatgacggctcatgcctgttaatcccagcactttggggaggccgaggcgggcttgatccaccttgagggtccagggagtttcaaaaccagccttgacccaacatgggtt

SEQ ID NO: 572198 - DNA, 831 bp, Homo sapiens
tggtcctggccctgtgctcagtgaccgaaggctctggcttgctggtggatgagccccagctctgcaacgtggcacatggggggagcctcccggcgggttgagatgtggggcatgggcatacctgaaccccctggtgcgtgcgtaaggagctggagtctgcttggtagagaccgagggcatgtgaggtgctggcagttgccatgagctggctcttctgtcccgaccgccatcatcgtacgtggagaccattttgtggtatatcgcgatatcggctactgtccttgccctatgtattcttagccaggcactggtgcgtgtgcctccttgtgattgggcctttcgacattcccatggcccctatgtctcctttgaggtaaccccgtgatcctagccgtctgtttcagggtacgggatgcgtgtgaggtatgtacctgaccacctgaaccgctaactagcttgcccacactcttctagtgtgcatcaggatgggtccacgagtgcagtcttggtatttaggcctgggtggcggatgggtgggtcccataccccagaggggctcagtgattctggtggccttctttccgtttcatccatggccgagatcccccagcgagtggtatggccatggcccgtgtacctgcattcccttagctgttggcatcgtgttcgtgagtcagtgctgcgccactgtgggactcaatgacagtgcacaaggctgaggggctccttgctggaaagctctagggccggctaacaaaatgggctgacctgcagaggggaatctaccagggagatcattattcctgacaatggctgctctgggcaagggac

SEQ ID NO: 572199 - DNA, 180 bp, Homo sapiens
tcctgtccgcatgtttaggcgggttgcttgttcccgaggatgcgggagctcagggccaggccgtgttgcgactggctacagcagacagcgggtaaccgacattctcgcgagtaggaggcatgcgtcgcagtactgctttcgggtgaatttgtctgtatgctacggagctggttttgactc

SEQ ID NO: 572200 - DNA, 115 bp, Homo sapiens
gacttatatcgcaacgagataactccaggtttctccatcataatggcgatgatgggtacttgaagaataacacatagtagatattccccaagatagtcccagtccaaccaaaagt

SEQ ID NO: 572201 - DNA, 140 bp, Homo sapiens
tcaacagggccattgggcatagccaactggcaccagttgggctgcattcatctcctcaggcacagcaggctgcacattctgcaacacaccattttgtcatcatgccacatgcccccggcataggttcaacaggcagcagc

SEQ ID NO: 572202 - DNA, 477 bp, Homo sapiens
gtgactctgaggatcgtacgctctcacccaccccgtataggactataaatcctgaggaaaaaaagcacttaaaagaacaggctggaaatgtttcaggaaacccctttctctacttactctccacttgttcattcaacaaaggcccaaaggtgacaggaagagaagcaaggagcagcagacattagctctctgtagcttttccctggccatcaactagcttctctattaccactctgagatgactgagagagacaacggcaaggagacaagaaccctggactgtcagacaaatccagggaatgcagcagagaaagcaaaagcagcgagaaagcaaaagcagcaggggcctggtcagggagcaaagatggaaatgaggagagcaactgggaacccctgtgagaaagcatggccagagaggaaactaggacatgggaccggacggacagcaaattgtattggggggtgggtggagagcgg

SEQ ID NO: 572203 - DNA, 245 bp, Homo sapiens
  misc_feature (227)..(227): n is a, c, g, or t
ttacgaatcgagctcggaccgaatgcgagagctgtgcactaccacacccagctgaatttttagatttctagtggagatgaggtctcagtatgttcccaggctagagtagaactcctaaggctcaagaaatcctccggcctgagtctctgcaacagtgctgggattagcaggcgtgagccaccacacatggcctgattgcacaactgtgtcgatgattgcggggatcnctctagaagtcgaccgtg

SEQ ID NO: 572204 - DNA, 645 bp, Homo sapiens
  misc_feature (116)..(116): n is a, c, g, or t
ccaaccactgcttaggcctcccacttctccccaggccaagtatgggccctgctgtgttctggaagttccagacacttagtcctcccaccagtgggtggaagagctgccaggtctcnccggtccagatggagaccgccagatacctgctggtggccagactggggccaggtcctgacccacctgcatcaggggatgccctgagctccacaggtcttcatgggccggggttttgggtcctggtgaaggaagtgcatcctcaggcctgggctgtagccagctgtctgcccttgggttccagaacccgactgtggagcccaaggtgaccccacgggggcccccgggctggagcccccaggataccctcactttgcatgaggagctgaaactgacccgtgtcccgtgttagcccccccctggggctgctcttgcttctactataaagataccgccgttacccccttatcccccggggatacccgtggatatctaaacccgaccccccgtggatgtctaaaccccagataataaccaaccttatacatactgttttttcctatgcatacatacctgtgattaagtttatgaattaggccccttaagagattgaccaccataactaataataaatgtaacggttatactgta

SEQ ID NO: 572205 - DNA, 111 bp, Homo sapiens
cacgaggtgacatcctgtctgcctctccatgttgtcaggcccgcctgacctgtaagcactgtgggaattcggtgatcgacttgaggatcgggatgcactacttctccgaaa

SEQ ID NO: 572206 - DNA, 387 bp, Homo sapiens
tcccgggtggaattttttccacaataaaatggttaaacccccgtccctcttgggactccataactctcctgtgggcctaatccttggagagttctctcctctcctctccgcgaattcttcgaaggtgtgagagggtgcgtctcgcgcgcaaaaactgtggtgcccgcgaaaacctgtggtctccccctctccggttctcctatacttctgcggggcgcgaacacagctgtggcccgcgaagagcgtctcctctcgaggggacacacacgcgcggaacaaccgagtgtataccccagcgtgcgcgcgagagaagagagggagagccgagagagcgaaagcgtggcgagttctcgtgaacacgccccacaagagcgagagggtataaga

SEQ ID NO: 572207 - DNA, 349 bp, Homo sapiens
  misc_feature (299)..(299): n is a, c, g, or t
  misc_feature (340)..(340): n is a, c, g, or t
agagagctagcagaatagaaaggattaaaatctaactagcagccccagggtaggccggcgtgagtcacctatgagctgggcctgggctggactatcccctaggtttcctcttggcgctcttctcccttccctcagggctctgtgcagtggtctccacacagagaggtcttcctggacacatgccctaagatagcgttctcagcactgttgctccttgccctgccttatagcagcaacgtcaccacttcgtagatgaaggactcagctctgatttgctccctgcgtgatccccagtaccngggcatcccccaggccttaggagtaggtgctgttcttgatnacattgggt

SEQ ID NO: 572208 - DNA, 150 bp, Homo sapiens
cgccgctatagacattctcttttcttttcttttatgttattttgcttgaagaaataaaaatttatttctgtaaactgttttgagtgcagatgttttcaccaccccaacacagcacagacgccccctgacgaaatgagcaaggacctcgtt

SEQ ID NO: 572209 - DNA, 530 bp, Homo sapiens
catagctgtttcttgagggttaaactacgtcctgacacaccataaccttgaaaatagtttttccccagaggaaaaaagaactccttagcaatcagatctactgcccacctgagactgccggggtataaagatcctacgctgtgcaggccatttttgttgactacaacaaagaagtcacaagtctggctacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagtttaaccccaaagattggctttccttggagtgaaatcaggaacatctctttcaatgacaaaaagtttgtcattaaacct

SEQ ID NO: 572210 - DNA, 284 bp, Homo sapiens
catgtggacaattgaatgtcccacataaaatggtacaagcatgcagtctcaatgagtcagtcatcgttgcaactattacaaccaaagctcccatttgcattgtaatcttgccaaacatcatcaatggatgtctccatgcaacttggggtataagcaataatatccactagtgttgttatcagctactgtaaccaagtggctggttccatttgtgttgatgctgcattcatggccattaaaccatggtggataatgatagatgtgtaataacatttccaccattt

SEQ ID NO: 572211 - DNA, 132 bp, Homo sapiens
atagtggtgcttcaggctacagcattgggggcaaattgggcaaatggggcagtgactgctcaatgggtcatagggcttctttttgggcagcatgcaacaatgtcctgcaagttgactgccgtgcatggctgc

SEQ ID NO: 572212 - DNA, 820 bp, Homo sapiens
  misc_feature (38)..(38): n is a, c, g, or t
  misc_feature (128)..(128): n is a, c, g, or t
  misc_feature (539)..(539): n is a, c, g, or t
  misc_feature (542)..(542): n is a, c, g, or t
  misc_feature (545)..(545): n is a, c, g, or t
  misc_feature (556)..(556): n is a, c, g, or t
  misc_feature (558)..(558): n is a, c, g, or t
  misc_feature (569)..(569): n is a, c, g, or t
  misc_feature (573)..(573): n is a, c, g, or t
  misc_feature (602)..(602): n is a, c, g, or t
  misc_feature (610)..(610): n is a, c, g, or t
  misc_feature (624)..(624): n is a, c, g, or t
  misc_feature (632)..(632): n is a, c, g, or t
  misc_feature (636)..(636): n is a, c, g, or t
gccgcggggggaaaatggcggacgggaaggcgggagangagaagcctgaaaagtcgcagcgagctggagccgcggagacctgaagaagaagcagaaaaactgtgaaaataagatgtttcttccagtantggaggggaaagttccagtcgcagcgttgaggaagggatcagtgaagaagaagtgccggactcccaaaaaaagcctaaagagatctccaagtttgtgattttgccataggtagtcagaggaaaagaaggcatcagccatatccatcaaattgtggatcaggtaggcctaaagaaatgttccaattctggttccaaaaatctttcagtagcagcagttttaatgaagatgagatagtgaaccagaggaagatgctccagaagcaaagatgaggatgaagaattatgggagggatacaccaaatcagttgacaaattcttcaataaaggaaagcatgggtttctgataacagaagctgtgggagggaatataaaatctcatctgtgcgaattgtccatgaccaaggacaattnacntgntgtttgaaatngngggtgtgcggntggntgtacagttaaacaggaacagttcctttnttaacgantgcttaagactatntgtggagncggntttaattacttttgcatttttacacgatggggtggtacctaattacatggaaggttgacttcgacggtatatggtcatttcagattcagcattggcattgggttcatgtatagtccaggtgacgtataaccggaaggctttaagaatgtttttgacattaaataagggaattgtttaaagagat

SEQ ID NO: 572213 - DNA, 322 bp, Homo sapiens
  misc_feature (13)..(14): n is a, c, g, or t
  misc_feature (162)..(162): n is a, c, g, or t
  misc_feature (191)..(191): n is a, c, g, or t
  misc_feature (231)..(232): n is a, c, g, or t
  misc_feature (236)..(236): n is a, c, g, or t
  misc_feature (250)..(251): n is a, c, g, or t
ccggttttacttnntttttttccctttaagttaatttcttttttggtgtgggcaaacggcccatccagatggtagaatttcacctgtaagcaatctgaaacgataggttaatcctgacatttaatagagcttttttaatttccttttcacacagtacaactnaagtgcagaataacggctcaagataatgnttccttttttttttattctctttaaaaggcggcttctggnngggnatggggtctttttnncccccaaattttgagattgggggccccattaaaaattcctggggctttaagggcatcttggcgtggtattg

SEQ ID NO: 572214 - DNA, 259 bp, Homo sapiens
  misc_feature (57)..(57): n is a, c, g, or t
  misc_feature (132)..(132): n is a, c, g, or t
  misc_feature (141)..(141): n is a, c, g, or t
  misc_feature (175)..(175): n is a, c, g, or t
  misc_feature (179)..(179): n is a, c, g, or t
  misc_feature (192)..(192): n is a, c, g, or t
  misc_feature (204)..(204): n is a, c, g, or t
  misc_feature (224)..(224): n is a, c, g, or t
  misc_feature (246)..(246): n is a, c, g, or t
  misc_feature (251)..(251): n is a, c, g, or t
tcggagccaaggcagtgtgagtccattcattattctgtcttgagatctaaggcaaanccccgggccccttggagcagcaccaaggttcccgacacccccaccgacagggtcgaacgtgcacaggctgggacnacgccgganttcattaaaccctcgtgggggagggcaataccanggancaggaagggattnccgtccagtgtnaggttatccacctcgggcanctcgtcaggctgcggcgccctnttcantctttttc

SEQ ID NO: 572215 - DNA, 427 bp, Homo sapiens
gacaggattccaggacagtgtttgatgaagctaggactgaggagccgcgagcaatcagagttcgtggtgaatataggaaaagagtccgacgtgagccagtgcgatttgtgtgaaggaagctaggaagaaggaaggagcgctaacgatttggtggtgaagctagtgatataggattccaggaatgagcgattgccattcgttgatgcacgtcagcaggcggtttggtttgaaaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaa

SEQ ID NO: 572216 - DNA, 247 bp, Homo sapiens
tgctgtgaaaatatacatccgctgagagtggaaagagagtgagcgagacactacaggaggtgtcttgagattatcatccgctgagggtggaaggggagtgagcacacactcgggaggtgtcttgagattatcatccgctgagggtggaaggggagtgagcacacactcgggaggtgtcttgagcattatcatccgctagagggtggcaaggggcagttgagcagcacactcgaggcaggtgtacttg

SEQ ID NO: 572217 - DNA, 216 bp, Homo sapiens
aaggaaaccaaaggttttaaaactggggtttgggggaaggtttcacctttcccccctccccttgccccacacccttttttccccagcccagagaggcgcggttttttccaggaaagactattgaaaaatgtttttttttttttttttttgccctttccccccttgaaaaaatggggaaaaaagaagaaaaaagccaaatttgcccttaaaaggcca

SEQ ID NO: 572218 - DNA, 190 bp, Homo sapiens
aaacttcctctcctcccacctcgaggctgaggcaagagaaccgtttgaggctgaaaggcgggttgagagagccgagatcacaccactgcactccagcctgagcgacagaatgagactctgtcacatacacacacacacacacatgaatgacatgaggctggcacagtggctcactcctgtaatcccagca

SEQ ID NO: 572219 - DNA, 835 bp, Homo sapiens
  misc_feature (74)..(74): n is a, c, g, or t
ggacaactctgctcctcctctatggaaacacacacccccacccacgcccagcccacaaaatttttatttctatngcgccgcgggcctttttctgtgccacaaaacttttttggaaacacacactccgggggctgtttctaaatttatctttgttgggtgtccacctcaaacacctttttttcctgaaaaaggagcccccacacccagcgggtctcctctctccttttaagacttttcaacagatttttttgtggaacaaacaccacaaggggcccggccccctttacaaaattggggcgggaagaaataaaaaaccacaccccccttctcttctttttccaagggtctttaaaccaagaaatttaaattttttttggtccccaagggggggggggggggggggggaacccccccacagttatttccccttttccaccaccttaggtcctcccagggcgggggggtgaaaggttgggattccgcttccccccacccttccccaagggtggtttgggacaccccacaccccctttttttttttccccggaaaattaaaccgggtccccccccctttttcaaaatcaaaaatttaaatgggggggtttcgggggggagggttttttccttaccccccctttccccaaaccgttttttggggagcccccggggattttaccccttcccttcccctttccccccaaaaattttttttgttgcccttttcctaccgggcccatccttggcccccgcaaataaaaaaaattaacccaaatcccccccccccggggggttttttttttttgggggggaaaaatttttaaccacccaaattcca

SEQ ID NO: 572220 - DNA, 231 bp, Homo sapiens
  misc_feature (144)..(144): n is a, c, g, or t
  misc_feature (153)..(153): n is a, c, g, or t
  misc_feature (157)..(157): n is a, c, g, or t
  misc_feature (193)..(193): n is a, c, g, or t
  misc_feature (223)..(223): n is a, c, g, or t
agtccttgtatcagtcaaacatgctttggagctcccctagagcgaccagcctaccttctgtctttcagctgcattcaagtgccttcatgtagaaatgctgctcttccaggaatgattaatttccattcttgtgttgtctgctgnatgaacgtntaangtcacaaactgccatctttatgcttcctttgctccntttgcaaacatcatcttgtgaatcatagtnggataaga

SEQ ID NO: 572221 - DNA, 404 bp, Homo sapiens
acccttaagaaaagctgcatcatttaagtctgtattctccaatgcttcttaaggtgcttgaatcaaggagacaatcaataagagtttgtttgagaagtacactgagcccctgtagcttttttctatctgtgcctggcacccatcagtcctgtgacagctgcttgaacagtacaaatatgcccagagttaaagaactgatatcttccacttccccaacatctgttatgctcttccacatcttcgcccctttaaaacaaacaactgaaatttccatccctgaagtacactttactcaatgataaaatcaaccaataattactgagcactttttatgggctcagcattctttcaagtgctttgcctatattgactcatttcatctactgagcaactctataaggtag

SEQ ID NO: 572222 - DNA, 461 bp, Homo sapiens
ggctgcaggaatccggaccagcttgagactgatagcatttggtgggaatcagtacacggtaataagtgataaattataactgagtgctttgtacactccaggtgctgagctgtttcgcatgtgacgcacctcgtctgcattgatatcgacgtacgtaattatccccaattgaccgatgatgaaaggcagattgacaccacccgtaggctgcacagctgatactcacagagctgaatatcgccacatgctaagattctagctaatcctaacatctgtttttcaccagacgacaccggacgttacggcttgtcgtgcaacacggcattatctggaacccaccatttgtatcccggcctcatatatcttctccctaccttgttgccaaggcacgtatgggtccctaacggatggacaccatttatgtacgacatcctatgggataccagacggtcgatatttcg

SEQ ID NO: 572223 - DNA, 835 bp, Homo sapiens
cctgtgaccgctgccccctcctcgagtctcgcccgccgcgatactgttgtcacgattaattgtgagctgggggccaaaccgctgtggggggaaacaaccaccaacagtgggggaagaggagtctcccccggcgctgctgacaaaaaagcggtggctctgcgcggaaaaacctgggggtgccccccacatatcggttaggaacgcgctggaaacagggggggcccgctctctcgcgtggtgccgccgttgaaccggcggaactccgtttctcacagccaggggggaccatcggaaagctgcccctaacgcacgtgtagagccgctctctagcccccgttgtcagctcccccttcgggggacgtcagaacccctcttgcggcccccttacctccgttcccctgtgccctatttaagtcccccggggggaacacaaccaatgtcctatagtattctcaataaccgcccccgccccacccgatgggcgggcctcaccaagatccccctacacttgggacccactccagtgggggcccttccacttgtagtattctttcatggaaagctcatgttggcctcccccccgcaggaccatcccaccctgcggtctgcccgctcaccgccccccgagagtggggcaaatagttgtcgcgcagccccacttatagtgcgcacacaatggggtataagagcacgatatgttaccgcagctggcccgcccggcatgttagcgcgcaattgaacaggcgcactcgcccgcccacagatacacgtggggcgtgggagacaccacacggccgccttttcatcacaaaaaaactttttccccccacatgtc

SEQ ID NO: 572224 - DNA, 259 bp, Homo sapiens
cccctttttggaaatttaaatttttttcttattttttgggggggacaaaaaaggggtaaaaatttatgccaatcgggcattttttgataggggcaccccataggtaataattcccccaattcccccgggggaaattagggaccccttccttggaccctttattttttcccacccccccaattaggcccttttggtttttttaaaggggccaattaaattgctattggcggcagggttatttttgggggaaaaaaattta

SEQ ID NO: 572225 - DNA, 323 bp, Homo sapiens
aggcccacctaggattggactttcccaggactaaccagactaaaagaatcgagcctttttgtctggactaaccagacataaagaatgacaaaagcccgctatggacgggacttaagacaaactctcctgaggtcttggcatattcagaacaaagagtaggctgcttaatatgttacatgtctcggagttcccagtcttttcaggctggccaccagacatgaccgaaaaatcatgtcccctagagggtggaaaccaagagcaggtattcctgtttggtcacaaagcaagctctcaaggatgtaaaataagatgagagggacgct

SEQ ID NO: 572226 - DNA, 168 bp, Homo sapiens
  misc_feature (26)..(26): n is a, c, g, or t
  misc_feature (87)..(87): n is a, c, g, or t
  misc_feature (168)..(168): n is a, c, g, or t
ggtgtgggtgcagtgatttggatcantgcccctactcctcatagcctcttcccaaacgaaccgggtgtggcgtgctgggcctttatncttctgggacacaaacacgggactgctgattggtctctgatatagaccctggagtctgctccttttgtctggggcaaaaan

SEQ ID NO: 572227 - DNA, 153 bp, Homo sapiens
taggcagggatatgcctacaggacggggtctcactgaggccatgatggacgcctgtgtgcaatgatgctgtccagcagtacctgacagaagatgcgctggctgaaggcggaggggcctgtggcgcggggtcgagcacccccgatacagcgaca

SEQ ID NO: 572228 - DNA, 110 bp, Homo sapiens
gaggatcccggctatcacattatcctaagcgaaattacacaggaacagaaaaccacataccctgtgttctcacttataagtgagaactacagcattgtgtatacacgaac

SEQ ID NO: 572229 - DNA, 211 bp, Homo sapiens
  misc_feature (9)..(9): n is a, c, g, or t
tccgtctgntctgttcttggctaagcgtaacagcggtcgcgcatgtcttccttgacctcattcaggagggcaacctcggtctcattctggaagcgcacgatggcgctgtctcatgtttccagtcttcgattccgcccgctttccgagtgagaaacgcaggcctctctcttccgtgaagcagcgtcttgtcctcttgcaccatcctctgtgc

SEQ ID NO: 572230 - DNA, 167 bp, Homo sapiens
ggccggcggggacggggaaaacggagactgtcaaagatctagcaaaatccttaggcaaacattgtgtggtcttcaactgttttgaggatttggattataagatagtgagaaaatttttctttggactagttcagtcaggcgccttgggctgcttcgacgaatttaac

SEQ ID NO: 572231 - DNA, 116 bp, Homo sapiens
ggggttccttttcttttttaaaaaccctggggtaatcccccatacttaaaggaacagtttgttttccaaaagcccgataaaaaatatttttaaaaaaagttttccttttctaatta

SEQ ID NO: 572232 - DNA, 287 bp, Homo sapiens
aaagagactctagaatcaggaaagaagtgcatctgccctgtaatcacaccttcctaccatcattcactccacaagcactagatcccagagttcaggctgcatcaactatgcattaggtgaggcaagaacatcgaacagtgctgacagaacgcagccggacagttcagaaagacttgccaatacgcagaactcttctacactgtgtggtggacagaattattgctcctaattcctcacctctccttgtgctccgcatatgtttaagacatgccaagccccagctgcgg

SEQ ID NO: 572233 - DNA, 511 bp, Homo sapiens
  misc_feature (108)..(108): n is a, c, g, or t
tagctgtggaagacgggccagatgactacgacgaggaagatgaggatgaggtggaagaggaggagaccaacaggctccctggtggcaggagcagagtgctgctgcggngctacacctgcaagtccctgcccagggacgagcgctgcaacctgacgcagaactgctcacatggccagacctgcacaaccctcattgcccacgggaacaccgagtcaggcctcctgaccacccactccacgtggtgcacagacagctgccagcccatcaccaagacggtggaggggacccaggtgaccatgacctgctgccagtccagcctgtgcaatgtcccaccctggcaaagctcccgagtccaggacccaacaggcaagggggcaggcggcccccggggcagctccgaaactgtgggcgcagccctcctgctcaacctccttgccggccttggagcaatgggggccaggagaccctgacccacggcccctccccacccccaaccgcatcacccgttcgg

SEQ ID NO: 572234 - DNA, 115 bp, Homo sapiens
actctaaggatcccgctccctggttgctgtattaaatgtccaagcgcggatagggccggggaatggttgagcctctggagatcacttgtaaccaaatcctgctctagaacctgtt

SEQ ID NO: 572235 - DNA, 1712 bp, Homo sapiens
cctgtattgtggggagaatggtgtgggtgggttgttcccctgagacacagccgcgcggttgtatgggggttggcccaccacctggtggtgcgccccgtcgtaggtgcaagacagttgtttctccctcccgcggggtggtaggtgtgatatatcctgtggttccggtgttagtgggtcgccccctcctggtggggacgctcgtttttttggtgagagtgtcgagcaccttggtttttctcctcctcggggcggggcaccacctatatagtgggggcccggtcttcctcacaagtgggctccccagagggagataatgggtggtttgcttctgttgtccacagccacagggtaatgtagttgtgttcttgtttcggttgggtgccctagaacccgtgtttgtgctcgctgtgggggttgttcaccacaagcgccccgttgaagttgtgggggcccccccccgccccccgactgtgggggggaagcgccctacagtccttgtggcgcttttttccataacattggggctttctcacaaggggttgggagattgtaatgcttctcccgtgggtgcacccccaccgtgtcccttctgtgggccgccccaactatttattattggcccccctcctcgggccgttttattattgccggccccccctctgggtggatttatttttggggaggatttttcgcccccccacaccccaccaggagccgcttccgtccacaccaaagtgtggccacatatacgacgcccaaggatgttgtttggtcgtctggtgtggacctttgtgtactatggagggagtaataataaggatgaaggtttggtggagttctccccgccccgctgttcttcttggggggttatcaataataataggaccctcgtggtataaagatattagcggccgctcccctcatgagtagtattctcgtgtggagataaggttctctggggttgatatgcgccgccgcccccactgtgggtgtgagatattgtgtggttgtcctctctgggccacacaggccccccactgggtgtgtgtgtttgagagagagcctttcttctcacagacacctatatgtcccccccccccctcttgggggttctcgcgctgtgtgcctctctgtgttctgtggagattattttgagagacccacacacccacactgtgtgcgcgcgtgtgggtggtgtgtcactctcacacaagcccacactggggagagcccacacagagagagagcttctgtctcgggagagtctctgcgccacaaaggttgtcaccccacaagtgttctcggcccacagcagagaaggctccacgagagagcggctatataatgagaataattatatccctgctaatatacctcgccacaccccacactctctgtataatccacgctgggtggagaagaaccgcgttctcacgagaactcgcttgtggttgtcacaatgtggcccactcttaaagtttagtatgttaaaagactcggttatatgagtaacccactgcacttcgtataaccctctcacgaaaggaaaaggagaattgttttgtggagcccctcttggtttttctctttttgcgctgtggcacgcttttatagagttattaggtttttataaatccgtactttttaatgggaaccacctgtggccccaaatttgtccccgaaattttgagaccccctttaaaaagtttaat

SEQ ID NO: 572236 - DNA, 865 bp, Homo sapiens
  misc_feature (244)..(244): n is a, c, g, or t
aaagaggcaaactgtggggcagccaaaggtggacagtggcccgtgcaggggggtgtgaagagcatgccggtaaaaaagggttttccccctgcgggctcagtgaaaatagtgcccgcgtttttggaatatagagaaccgttcgatcttcgccccgccaggcgttgtttcccccctatgttgtgaagcgagcgttcgtgtcccgctataccacccccttcttgttaaacagagacttcgttgtccncgcgagaacactcaattcgaccaacagtgcgggcatatctccttgcgagacaaattattagacccccctgttggcccacacccttagatcaccatcagcgcggggaatttgcgctccaatatgagagggggaacaactttctgcgtgtataatcccctccttttcaaatgattgcgtttttctattactagggggatcacgcacaccacacactgtggtatggttcagaaatagtggcgagaggatcgtcacacatctctagttcttagggatcaatgggagcgctccgctcgctcccaccataaatgttccgccttttacatagttgggcgaccgtcttcccccaccagagcgtctatttaccaccgcgcgacacttcgacacaccgatggtttattagttttcacgatcgaggtacttcttgtcactcgaataacagatgttttttgtttcgtgtagcacatgtgcttctataaaactcgttctgatcccccttgcttaaatcccgactttttttcgcgcgccgcatatccgcctcctcaagcacgaaccgccgcccaacgtcgtaaacaacttcgtgcttccctataaacaaatctacccttttcccccaaaataaca

SEQ ID NO: 572237 - DNA, 234 bp, Homo sapiens
ggagtcggtacccaattccattccagcgtactactcaaagctcaaaatatcttactggtcaggtgcagtggctataagcccagcactctgggaggctgaggcaggaggactgtttgagcccaggaatttaacaacagtttggtcgacatggaaaggcccccatctctacaaaaaattttaaaaaaactagccaggcatggccggacacagtggctcatgcctgtaatcccagca

SEQ ID NO: 572238 - DNA, 244 bp, Homo sapiens
ggacctgtttgagcctgctgaggatgctgtgcctctgcccataacatatatagagtatgctttcaaaacaatataggccgggtgtggtggctcacacctgtaatcccagcacttgtggaggccaaggcgggcggatcacgaggtcaagagattcagatcatctggccagcatggtgaaaccccatctctactaaaactacaaaaattagctgggcgtggtggtgcatgcttgtagtcccagcta

SEQ ID NO: 572239 - DNA, 339 bp, Homo sapiens
ttcacatgatgttgagctattcagacagataaagtgatcttggaggtatacggatgagtgccgcagccactcaattccctacgcgtcggcatccgagcacatttatgcatacccatactccttgcatgtgccatgacgcagatgatgataaaatgttctcttattcttgtttaatcagtagtggtagtgatgccagaaactgtgaaaggcaaggctttcagttcactttcttctttccattttccaataatccattccccatccccagctgaagaaaggggtgttactgagtccagctgataccacacattgaaaggtaaacattaatatttcaaatct

SEQ ID NO: 572240 - DNA, 503 bp, Homo sapiens
atcatagtgttttggcctgggggagaagtattaaaatggctaagaaaatagcaagtgttcattatagtttatttcaagtctgtcttgaccagtttcaagtgacttatttgtaaaatgcattttaaaataattctaagtagattatattgccaattcatcacttaatagatacctacatttgtgagattcttttcaatctgtgtctatcattggcatagtgttttcttagagacaatcatgatgtaaatataatttgttctccactttttggataacagtttagataaatttttgtatgtgtctaaatcacttattgcttaccattttattgctgcaggctttgattttttaaaggtttactactgtattatctttgaattgaggggcagtagttcttgatgcttatgtattttgaattagctcccaagaacaagtagaattagtttaaaagacttctctctggtttctgttgatccaagcacaataaacttatctgcaatgga

SEQ ID NO: 572241 - DNA, 182 bp, Homo sapiens
aggtggtgtgatctcgactcactgcaacctctgcctcccgagttcaagcaatactcttgcctcagcctctcgagtagctggaattataccgtccaccaccatgcattgctgattttttttttttttttgaaattagagttttcgcctcgctgcccagcgctgaagttgcaagtggcacagat

SEQ ID NO: 572242 - DNA, 111 bp, Homo sapiens
  misc_feature (40)..(40): n is a, c, g, or t
  misc_feature (106)..(106): n is a, c, g, or t
tgacacagtcgctggtgactctggcggaggacaacatagnccttcttctcgagtccagggtcctggggaaacggtcccagcggctgttcaggcgtttttgccggtntacgg

SEQ ID NO: 572243 - DNA, 153 bp, Homo sapiens
tccctgtctcgtttcgggacgttcatgtttttttaatgttttttatgtcactaattattttaacatgtctgtacttgatagacactgtacatagttctattaaactttacgttcctgctgtttatatctgttgatttttgtatttgataggct

SEQ ID NO: 572244 - DNA, 945 bp, Homo sapiens
agcgggggggcggtccgcccgaggaggctttgtgaagacagcagctagggggcctggcgtgtcgtgaggggagccggtgagaagacccgctgccgtgtcccagcgtgaacaagggtcggtgggcaccatgtgctgcaggtccagaacatctcacgtcatgaacaatatctagctcgctcatcgtttgatctgggcaaggatagaccagcgaaaggagaccttagtgcgaagcgtgctggctttggatggtggagatccgcaaagtggcccacgattgcgtcgaagcgcgaccctctaggctacagttgggggtcgcgaagatcctacatctggctcggtaccagcctcgtgtactcacacggagggaggcatcggatgaggtgacggtctgtttgaggatgcttagatccagactgcctcgagatggcacatagtcccctttggcgtccatccttcctctgaactggtacaagtctacttttggactcttgtttgatctagatcctatgtacagagacgccaagtttaccacaacaaggatataattcgatatccttatagaccatacttttaggcctcttagtttaatcccaagttgtaacgtttgcgtattcggagaaaagggtaagatatcgccaatactcaggaggttagttgccataacaaattttaccttaaaatagtgagggtttcagcaacttactctttaaatttatagggcgtgagggttatataggagagaaatactcgttaaaggaaattagaggttggagggtaccaaattggctatcgtcaaagggtaacttggctttctgttaaggttataccttgttcaacttaattttaacgcttggttgtattttgggtacaagaaagagagaagatataacttaatgattgattaagaggatcagggagaaaataggcaagtggagctatttggtg

SEQ ID NO: 572245 - DNA, 672 bp, Homo sapiens
  misc_feature (110)..(110): n is a, c, g, or t
ttcgaggaggtgagcgtgctgggcttcgaggagttcgacaaggcagtgaaggagcatgagggcaagaccattttcgcctacttcagcggttctaaggataccgaaggaangagctggtgtccggactgcgtggaagctgagccagtcattcgagaggggctgaagcatgttaccgaagactgtgtgttcatctactgccaagtaggagacaaaccttactggaaagacccaaataatgacttcagacaaaaactgaaaataacccgcagtgcctacactacttaaatatggaacacctcaaaaacttgtggagtctgagtgctgtcaatccagccttgtggagatgatcttctctgaagattaagatttgatgaccttgccggactgtggtggcacatgcctttagtcccagcactcgggagacagaggcagctggatctctttgagtttgaggctacctggtctacaagttgagttcaaggacagccagagctacagagtaaaaccctgtctggaaaaaccaaaccaacccaaaaaagcctgatgattgcaattttgtattgattgcctggtttgtttaaaagcagccacattattgctttgaattgatgagtaaatgatgttattaaatcagtgtatatctaaacaataaagaattgaaatacaaaccaa

SEQ ID NO: 572246 - DNA, 407 bp, Homo sapiens
taaatttcaagcaaatttaagataaaacttgtaatggctatgccattgaaaaacttaattttttatttttgaggcccatgggccaaggtaacccctaaggggttttcttaggcttcttggagcttagatttgtatgtacatcaaaatgtctttaaaatgttaagttgggcagaaggcagttgaagtgagctttcaaggtatgggaggttttctacattttatactatttcaatctatgcctttaaagttgcttatgattttagctgtacactcattttttaaggggaagaagtttccttgcaccattcgccttttttagatgtcctcactccctgtgatttcataaaactgcctatttgacatctctctctagacatttcattaaagctcacactcaaaataaaaaa

SEQ ID NO: 572247 - DNA, 168 bp, Homo sapiens
ttcaatccatgctagcttcagccctctcagcttattaaaacatataaaagctgaaccactcagaatatatatatcagctagctgaacatttacacagatggtaataccattcaatccgggacatctctctgagttcagtcttatggtattaagatcaaaaccccattt

SEQ ID NO: 572248 - DNA, 673 bp, Homo sapiens
cgctcgttgactctagcatgatccccttaacaggcggatgcgcagcgaatggatcaacgaacgggagtcatccggccagtctcggagaaagaagagagagtatctcgcagggtactggaggctcggctgcaagctgtactggggcgacatctaacagactccgccgagagaatgctgccctccggcggcggctggaggccctgctggctgaaaacagcgagctcaagttagggtctggaaacaggaaggtggtctgcatcatggtcttccttctcttcattgcctacaactttggacctgtcagcatcagtgagcctccttcagctcccatctctcctcggatgaacaagggggagcctcaaccccggagacacttgctggggttctcagagcaagagccagttcagggagttgaacctctccaggggtcctcccagggccctaaggagccccagcccagccccacagaccagcccagtttcagcaacctgacagccttccctgggggcgccaaggagctactactaagagacctagaccagctcttcctctcctctgattgacggacttcaaccgcactgagtccctgaggcttgctgacgagttgagtggctgggtccagcgccaccagagaggccggaggaagatccctcagagaggccaggagagacag

SEQ ID NO: 572249 - DNA, 247 bp, Homo sapiens
  misc_feature (165)..(165): n is a, c, g, or t
ttttttttagaaactaaaactgtcataatccagcaatcccactaatgagtatatatccaaaggaaaggaaattcacattttgatacctgcactccccttttcactgcagcactattcacaatgaccaagatatggaatcaacctacgtgtccatcaataaatgantggatttaaaaatttaatacacacacacacacacacacacacacacacacacacacacaaatactatctggctaaatttaga

SEQ ID NO: 572250 - DNA, 468 bp, Homo sapiens
gatggcaacacaataatagtgagggacttcaatactccactgacagcactagacaggtcattaagacagaacgtcaacaaaggaacaatggatttaaactacaccctagaacaaatggacttaacagatatttacagaacattctacccaacaactgaagaatatatattcttctcatcagcacgtggaacattctccaagatagaccatatgataggccacaaaacaattctcaataaatttaagaaaattgaaatcatatcaagtatcttctcagaccacagtggaataaaactggaaataaactccaaaaggaactctcaaaacaatgcagatacatgaaaattaaataatctgcgcttgaatgatctttgagttaacaatgaaatcaagacggaaattaaaaaattttttgagctgaatgacgttagtgacacaacttatcaaaacctttgggacaacagcaaa

SEQ ID NO: 572251 - DNA, 101 bp, Homo sapiens
agcagattcgggacttgtatgaagactaataagtgaaggcatggtacgatgtgatagagcggtaggaacacctgattatatttcccctgaatgtatcgtga

SEQ ID NO: 572252 - DNA, 118 bp, Homo sapiens
ctgtcagtatctcatgttaggaatttttgagttgctgcttgtgcggtgggtaaatgccaagataaaggggtgctggcctgtggggatttgggagaaacgagagtcgactttagactgg

SEQ ID NO: 572253 - DNA, 1629 bp, Homo sapiens
  misc_feature (417)..(417): n is a, c, g, or t
  misc_feature (1629)..(1629): n is a, c, g, or t
tggccttttgaacccaaatttttaatattttcattaattggtttcaatacaatcttcaggcaatatgccaatcgggaaaaccaagcccagaaaatttcagaggaaattaattctttccaaacaaggaacaccaagggtgatcttcttctccattctccagccacaattacgtggtgtgactcataagtgggtgcatagctcagtattctccagatttattcgagtgtgttttcaccacatctcaattctatattttctcagaaatgtgcctccgaaacgagtttctcagttgtgcaagaagtctcagaagcccacgtgacgtgaattaccaacgagagaggcgtggacacaccagttctccctccaaagatgtgttgtggaaatataccacccctttctgcggacattaaaatgtgnccgtgacaagatttatttctctccctgtgggacatttgtcgcgagtttctctatagatctctgttgtataccgtgagtaaaaaatgtggagattctcagggcgcggaccatttttctcaaggcatatgtgtgtgtagaatgtggacatgtgagcctctcacatataggacatctctgtgcgacaaaagccaagcagaaacgcgccaagtatagagaattctcacatataacacaacagtcaggtgtgttccagggtggaaatatattctcaacgtgatgaaaactcaggatagaggggggcccaaacttccatatttgttttctgtggaaaaggacaccacaaacactttccctgtgcacaatatagagagacgcccccctctcctgtttctttatacacaacttataacacaacagcggaaattttaaggcaccaatctagcggggggccatcttcatgtagaaaccgttgtgaagcccggccactaccagagacataattcgtgatcaaaagtcacaccccacggtttgtgtgcttctaataacccccagagagaaaaggaccaacacatgttgttgtaaccccgtggatttatctacccccacggggggaagtgtggacaagcacagcgacgcttgtgataaaatttcgtgtggaacagcaagtgttgtgtggcccaagaaaaaccctatatattataacgattttgtgaacgcattccccactcaaagaatttaaatcaatcaaaggagtaagaaaaacacccactcactgttttgttttcaagccagcactacaatactgtgcgggccatcattatatattaacgcagccacacatgtgggtcgtctgatgtagttcccccaaatgttgggtcttttcaacaaccggtaataaattcgccaggagcgtacgcttcttgtaaacaaaaaccccattaataacccaccagagataactcatacgctatttattagttacagcaaccaagcgtatattgtgaagagaatactaacttaggaaaaccacctctttgagcagagaaactttcgtgatgagaacaagaggcaactaaccacgctgtgatatagatatcggtcagctaccacagactatacaaaacatagaggctcctttccgaagcaacatagcatactgggtgttagtacaacaccaagcagtagtacttacgtagtcgagagggaagcacn

SEQ ID NO: 572254 - DNA, 486 bp, Homo sapiens
  misc_feature (196)..(196): n is a, c, g, or t
  misc_feature (302)..(302): n is a, c, g, or t
  misc_feature (348)..(348): n is a, c, g, or t
  misc_feature (358)..(358): n is a, c, g, or t
  misc_feature (406)..(406): n is a, c, g, or t
  misc_feature (465)..(465): n is a, c, g, or t
  misc_feature (476)..(477): n is a, c, g, or t
acagtgcaaggagctcccctcaagtggtaggaaatgaatggcccagccatgccttccaaagaaccctctgagaggcgcccagtccctcttctgtgcttccaaacaatccccccgcccagcgtccacatcctcgcattgtggggtggtaggcgacccggtgtctgtctcccccagtgagctgtggaggccttgagancaagggtctcagtcgcccgagtgtctgcccttgggcacaggacagaggatgcgtcgccatcccctgaatgaaaggcccagctggacctggcttgagaagaggcttntattgaccactcagtgcccacaaaacctttgaggttaactttagtntgccctgttnttagcagactgtatttcattttgagcaaccccaggagaggaaaatccnaatttctctctcaaatattgaattaatccatacatgagcagttagtgatttttataaanagattcgccanngaaaaaaaa

SEQ ID NO: 572255 - DNA, 87 bp, Homo sapiens
aaggaacctgattcggactagttttctgttcctgttttttttttttatctaattttgcaaataaaaatttattttgaaaccttaaaa

SEQ ID NO: 572256 - DNA, 968 bp, Homo sapiens
  misc_feature (45)..(45): n is a, c, g, or t
  misc_feature (158)..(158): n is a, c, g, or t
  misc_feature (205)..(205): n is a, c, g, or t
cttgagacaggttctcactctgttacccaggctggagtgcaacgncatggtcttagctcactgcaatctctgcctcccaggctaaagcaattagtgtgcctcagccttccaagtagcttgtaccacaggcatgtgccaccatgttcagctaatgtttntctgttttgttttggtttggtttggtttggttttggtagagacaggnttttgccatgttgcctaggctggtctcgaactcccaaagtgctgggattacaggcgtgagacatcgtgcccagcctatgatattttctagtttatttcatcttgttttaaatgctgataattgcctaatttcataacccactagtgggttatgacctgtagtttaaaaactactgtaggaaagaatatagacaaaccaatgattagagcacagtttaatagcctctatgatagatgaaatgcagaacacttagtactaagagagaataaaggaatacccaagccagttctaagcagttagaagtagtgctcagaaaaaaacttcttggaggacatgctatcaaagttgagttaaagtttgaacaaaaaattttaaaatactttatccattatacaaaaaaaatgtttattttgcatctctttatgaagacacaatgaagggacaaaagtagtaggtgcaataaagaataagcctagagaaaagcttcaatatatagaatagcggtcagcaaactttttttaaaggaccagatagtaatatttttggcttgagtgcccaagttgcctttgtagtagtcacagacaataagtaaaagaatgagcatggctgtgttctaataaaactttgtttacaaaaactgaagccaggcacagtagcatgtgcctatggtcccaggtatgcaggaggctgaggcaggaggatcccttgagtctaccagttcaagaccagcctgggcaacatagcgagaccctgtcttatttaa

SEQ ID NO: 572257 - DNA, 130 bp, Homo sapiens
  misc_feature (8)..(8): n is a, c, g, or t
tcaatatntgttagtgtacagtgcaggactgaagtggtgggggaggatgggggcgcaaagacctcagccttgtcatcggggggagggggcacgagatctgctctcaagaaatgtatgtgacaaagtctca

SEQ ID NO: 572258 - DNA, 220 bp, Homo sapiens
gggtcttagggagcacactgggtcagaagggagcctgagactctgggagcagaaatggcaagggtggccaacgcgtgcactggtttactggttcaacccttccgttaacaggccaggaaactcctccaggccgtgtggccagctgaaccacagttccttgcgtggaagaggtttacttggaacattgttgtaggcacgggcttattgaggagggccagcc

SEQ ID NO: 572259 - DNA, 161 bp, Homo sapiens
ctcaccaccattctaccttctgtctctatgaatctgacaactctaagcccctcatatgagtggaatcatacagtctttgtccttccgggcctggcttatatgacgtttacgataacgtcctgaagaaataactaacatttgcttgatgcttgaaagtttac

SEQ ID NO: 572260 - DNA, 84 bp, Homo sapiens
ttggtttttttcccccccccccccccttttttcccccaaggttttgcccttttgattttttttaaaatggttggggggctgcca

SEQ ID NO: 572261 - DNA, 517 bp, Homo sapiens
cgttatgttctgacccacccactccatgttaccaagaagacgcgagtctgtccattttcagaacgtgggcccttaatcactttcagagctagtctttcagtgagggctgggccaagaatacacaaacaacaaaagcaaagcaaacaaccgaataggctagtgatggggaaggacccggggttgggtctggacggatgagcaggccatgcagctagcacaagagaaggccatcgatgagtatcgcccggcgattttccctgacatctaggcccgctccgtcagagagtctcatctccctcgttctgcctccctcttccatcacagaggtctccataggaacagtgctagtatcagcctgtgggtccttccccagattgctgacatcgcatgaaccagaccctggaagatcagtgggccagggtatatgtgagtgaggtgggaagcaggagcacagaggggccagctcctcaggtttcagtagcaggagcttcaggtgtctggtgggtcagaacataag

SEQ ID NO: 572262 - DNA, 175 bp, Homo sapiens
agagagccgtatcaactatcatgtatgtgagcctgtgaaagtgacttcccgtctcagtgcccggttcttcagctagagaaggaaactgatactcacatccagcgaggattaactgcaggaatgcatgcaagatgctgaatctaagatgctggcacagagtgagcgctttaaaatg

SEQ ID NO: 572263 - DNA, 335 bp, Homo sapiens
agaggatcccctggcaggctctctacctcagcccaaagaaaagcaaaatctccatggtaaggggaagaagcacggagacgatctctggatatattaaaaggtagatcacaattataagtatcaagacaaaccagggtgtcatcgaagggttcatcttcttcttcaacggggggctgaggagattgggctcggctagtactggttctctgtcaaggtactcaaaattatccagggaccagtgatcttcgtcggggtcttttaacaccccttctttttatctccgccgtttcggttcggtcgtggccgtcccctaaaacacacaggaggcccttggg

SEQ ID NO: 572264 - DNA, 806 bp, Homo sapiens
catctcagacacattgtaagcctaccattgaagcgcattgatgtttaagctgcctgaatcttcaggacccctatctattccagtcctatccattttgctgattgagtcgatatgtattgcagcctcttacgtaggagcataagatgacttttggattgtgaatactgatttaagatagctgaatgttctcctaagtaaagcattcccagaggagagaagaaagtttgtactactgggtggtcatacacattatcagatggtgcagcattaacatagggcacatgagatttgtcggagactagctttcagaatccttttagatgatccaatgcatcgaaaaccctctataacatacttctcaagtaatacctgtactaccagttaactactagatgttgtatatactttcttttctggtggtcttagaactttagacgaaggcgatggaacatgccattcggtgagtaccgttggaagctatttcaatttctaggtacaagcccgcatatatcagtccgaaatagatttcgtttgcagatctcagtttcagaaatgctcactgaacactacatatcataactcaaagatacggactcagtaacactcaacatcagtaagaaagagcattattcttatcataagtagataaaagttgagtacttgatgtggccaacaagaaccaacagtagactggtagtagtaattaaacacgtggaaacgggccagtatttctactgagagtccaccttgggacagacgcctcaaaagcagaaacaaaagtaggccgtaacgtacgaattcgtaga

SEQ ID NO: 572265 - DNA, 363 bp, Homo sapiens
ggctgtctgcaacaagtaagactgattgctggtcaagtcttcatttgcaaagaagtataactttgtaacttcatcctagcctctgattggttgctttttgcaactcatcagattgtttgcacaggagtgtgacttttgtaacttcacttcagcctctggttggctgctttctgcaaccaatcagactgattgcggctaccatttcagttacatgaggtgagcatgaagtggccgatgggaaaattctggtgggtatttggaccaggaagattctgtatccaggcccctgagctgctgctcaggcccactcccacactgtggagtgtacttttgttttcaataaattcctgctttggttaaaaa

SEQ ID NO: 572266 - DNA, 346 bp, Homo sapiens
actcaaaacagagattgtggttatggcaaaaaggtcgggggatggtgtttatcttttctcttcatggcacaggggttagcagccttatagataaaggcagtcctgatcatatgtctgactgcatttgcacaaaatagtagagttaatttatcccttcatggagtaaatcctgatgctgacttttctccttactaacatatgtaatgttattttatttttagtggagatgagatctcactatgttgccatggctggtctcaaattcctaagctcaagccatccttcctcctcggtctcccaaagtgctgagattacaggtatgagccaccatgcccagcctccacaa

SEQ ID NO: 572267 - DNA, 758 bp, Homo sapiens
agggatcgtaccttgcctcatggcttccttgtttcgcggtccgattttataaaggtggtgattccactcggagcctggcacctgcgcattttttcttgatttttggctcctgtgcttcgcaatacttcgctgcagttctttgtgattcgagaggacatatggtccttggcaggcttcgacgggctggcgcattcgcaactgtagttatcgctgagcgtttgtgctatttatcactcgtggtgcagagtctttttgtaggtcttttgtgcatttgtttgatgccattatcgccacaatggtttgtaccaaggtgccattgtaggcactgcacatgaccatgtgttggtgtcccatctccagcggcagcccgtcctcgtcacgttgcctgacgagctacaggcgtgacgccacagcattggcagatacttgtacactttaaatgtagtgaacttaggatagaagtgttatatcatcaatataagcacattgagttaaaaatgactgtgaagtgagtctgggacgtcggtgggtcatattcaatactgcagacactgtcttgggaggtataggtgggaggatcacctgaggtccggagttacaagaccagctaggccaaaatggtgaaaccccatctgtattaacaaaaaaaatacaaaaattagcacgcgtgcattagcacgcctgtaatcccagctactactcaggaggcttacgtgggagatcacctgaacctgagatagcagggttgcagtgagcca

SEQ ID NO: 572268 - DNA, 380 bp, Homo sapiens
aaaaaaaaggaaaaattgaaggatgcataaaaatattagttcattttcaacccaacttgttttaaattttgatgaggtaatttcctgtttgattatagtcgtaaaattcaaactacgcttcggctgattcggttttgttaaataatacaatgagtaaaacaaataagtttgtagtttagcttttacttcaagacggaaaaaatctttgtacgtacaacacccaaatattcaaaacttgtacttttggtgtttttagttttgcagtttccgaaatattagcagactttgtgtacatttttgcctaactagggatctaaatatgtccaaaatgtgtccctaccagtttgtcaataaagcatagtttttcttttacagcctta

SEQ ID NO: 572269 - DNA, 167 bp, Homo sapiens
gtactctaccgatcttatggagaccaggctgagtggggcgggaagtaaggatattacttaaagagaaggcgcctccttctaatataaatctttttttctttttgagacggggttttgctcttgttgcccaggctggagtgcagtggcgcgaatctggctcactgcaa

SEQ ID NO: 572270 - DNA, 301 bp, Homo sapiens
gcatcaataggaaggtcccagcgtggggaagccccagtgaaacattataacaattgtgtatgacacttattcgatgatcgctgatcatcaacacctgtgtgtacattattccttataaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 572271 - DNA, 263 bp, Homo sapiens
cgtcttgaggatccccttcactgacggggtggtgaggagcccctgttagcactgcctgttacccctgaacacttggcctgttttggaagggtcgtgactccctcccctgtcttgtgggtgcatctgctcaaactctgtcggcccctcaagcaaaatggtgtgatctgcaaccctcttggagtgacaagccgccagccctactggagggatggggcatggggtggatggcccctagcctttcccttctgagctggtttgtatca

SEQ ID NO: 572272 - DNA, 1032 bp, Homo sapiens
caaatagagtggtgacagtggactcacatgttacaaagtaagacatgtattagacacacatactcatgtgtagtgggctaccaaaatgtcgcagggacatgtgattggttgactaagtatgattattatcagggtatatttaacttgttctgttcatgtggcagaaggtgtacataagcgagttcccatcaaaaagggctttataactgtacgagttatatatctaatatattatgacatcccctatggcgggtagaatgcgcttatactgttttacaagccgtgttcggcgctcgcgtgaggtacaatgtcatctttgtttcaccaaatgatgtcatggagttagatgctaagctctctatctctctcagggcaactctcggggtaagatttcccccaaacatgctgatgcatatgatggtacatctccagttgcaagaggatggactgccagggcacaatacggagattgatataacatgtcggggtgtggatgtggggatacgacgcattgtgcgtgtcgggagaacctagtgtgagactgaatggagggatgaagggtcgtgacctaatggtgcctcctcaataaggaggatgacgcaatgcataagtgagggtatggttatgaacagtgtggtggaggagaatcctatgatcctatttgtactgtcgagtaatggtacagtataaacagttttgggacggcaagaataagctcgagttgtccactccccccctgggtgttcctctaatatgcgtaaatccttttgtttggccaacatggacgagagaaacagcactcacgtttggggacggctccgtactataagttacaaaacagggcggtatgggcggccagtagaaggaacccggacaaggcttattagaggcccgcgaacagagtggctcgcaccgaacacgggggcaggcgtctaaacccagggagggtacggcaacagatctgacagcaagtagccacggagtacagaccaataggcgcgacaacaagagcaaacaagcaaaagacaacga

SEQ ID NO: 572273 - DNA, 108 bp, Homo sapiens
  misc_feature (17)..(17): n is a, c, g, or t
  misc_feature (26)..(26): n is a, c, g, or t
  misc_feature (39)..(39): n is a, c, g, or t
  misc_feature (43)..(43): n is a, c, g, or t
  misc_feature (68)..(68): n is a, c, g, or t
aacagtaaaaattatancatttacgnaagctaacccaanaagntcatttaaaccaaaaattagctaantacattatccatctataaatacaggttgaattctgggatc

SEQ ID NO: 572274 - DNA, 271 bp, Homo sapiens
gtggctcaatggctctcgaagaccgacagaccagattaacagacatcgcttgctctttttactactcaatgaactctaccccttttttaccccggttactgaactctatacctgacatctgcccatcctaccttgtgaccaccacaccagaggtccgagccaccctgaggacttatactaactttgcctggctatactagagtgcatcatatgagcttattgatatcacttgcggccacggaactaataacattgaatgtgctcttctata

SEQ ID NO: 572275 - DNA, 826 bp, Homo sapiens
agcgggaggatggagaccaacgagtctacggagggatcgcggtcgcggtcgcgatctttagacatacagcccagctccgaaggactggggcccacttcggaaccgtgtccgttcattcagatgacagtccacagggtcggccctggcagatgcaagcggagcagctgcagcggctgcatcagctgctgcagcgtacggcagccgttcaccacgtgaccagaagtcagctggacgattcatctaacaaatgactcccagcgaccctgttctgagttcatggagccgtgcctctgacgcaccagccttcttgagggagccctgtgcgggacccggctttatccacaagtgatagcccatggtggagtcgtgggcgtttgagacccggtctatgttatccatgtatttgctcgagagacacatttgcaacgtaacaaactggagccagtagattcgtaagtgcctggaccctgattcgcaggtctctagcatctgggtcctgttcttggtttccagctcaggtgctggccatgggtctggctctggctctggtcctgggcgtgtggctctgtccctggctctgggtctggtcctggtcctggctctggtcctggcatctggtcctggtcatggctctggctctcatcctggtcctgcctctgggcctggtccagacgactggccctgactctgagctcagcccctgtgattcctccagggttcagaaatctggtggcagatcgggtgcctaagtaatagctcctgggagtcagtactgcccctgggagccccataaacaacaacttggggaattttgcaagtcttagaa

SEQ ID NO: 572276 - DNA, 195 bp, Homo sapiens
  misc_feature (118)..(118): n is a, c, g, or t
tcatgagcagtttctgtatgttaagactgtgggtgttattaaggtactggttgataaatgtgtacgggtccttttgcaataaaactggttagattgatccaggtttaacaattggggntttaagttgaccaatcactggtgatggggctttttcaggggagtacattttaacccgtgtaaaaacgtttcctttta

SEQ ID NO: 572277 - DNA, 252 bp, Homo sapiens
ggggggttttttttttcccaaggccaaaccccgggaggcccccttttggggggttttttcaccccttagaaatatatattaattttttttttttagccccctgggaaaaataaaaaacttgtttgaaagccctttttcccctttcccttaggtaaggggggggggggggattccccccccggggaaaaaggggttcccgtttttttattaaaaaggccccccttgggaattaaattaaattttcttgggcca

SEQ ID NO: 572278 - DNA, 352 bp, Homo sapiens
  misc_feature (68)..(68): n is a, c, g, or t
  misc_feature (248)..(248): n is a, c, g, or t
  misc_feature (321)..(321): n is a, c, g, or t
  misc_feature (341)..(341): n is a, c, g, or t
  misc_feature (345)..(345): n is a, c, g, or t
atcgggggtgggggaagatggtggccaaaaagcaggccgtcccttggatagggcagctgggacagctntcccggagcagctgctgtacctcacccttatttcctgacaatcattaaaattcaatttcaaagtttctgtctttaacaatttcctaaggggcctatgaaggatgccaaaagggtgggcctcctttccagtggcagtgctttggcagcaagtagacactggtcaggttgcctgaggctgtncccttctcacaatagtcctgtggagagtgtctagaatggacactgcaggacagctctgggaaagttttaaggngggccaagaagtggacaagnccancacctct

SEQ ID NO: 572279 - DNA, 589 bp, Homo sapiens
gaatctgggtgctcctgtatgggtgcatatatatttaggatagttaggacttcttatgcattgatccctttaccattatgtaatgcccttcttgtcttttttgttttttttaaatcttgttagtttaaagtctattttatcagagaatagaattgcaacccctgcttttatttttttgctttccattgcttggtaaatattcctctatccttttatttgagccaagatggctgaataggaacagctccggtctacagctcccagcgtgagccacgcagaacacggtgatttctgcatttccatctgaggtaccaggttcatctcactagggagtgccagacagtgggcacaggtcagtgggtgcgcgcacagtgcgtgagccgaagcagggcgaggcattgcctcactcgggaagtgcaaggggtgagggatttccctttccgagtcaaagaaaggggtgacagacggcacctggaaaaatcgggtcactcccacccgaatactgcgcttttccgacgggcttaaaaaacggacaccacgagattatatttccgaccggtcctccagcctggccaccccggtctccctt

SEQ ID NO: 572280 - DNA, 427 bp, Homo sapiens
ggcctgctgttctcctcctcggacctccatattccctgagacacaacaacactgaaatcaggtcaattaataaccagtagtgttgaagtgaaaggaagagtcacatctcttaaaagctagaaatgagtcagcttagtggggaaggcatgtgctcagacaggctaaaagccaggcctctcatgccaaacagttagccaaggtgcaaatgcaaatgaaaagttcttgaaggaaattaaaagtgctgctccagtaaacacaccaatgataagaaagcaaaacagccttttggctgttacaaagaaagtttgaatggtctggattagaagatcaaaccagccaccacattcccttaagccaaagcctaatccagagcaaggccctaactctcttcaattctgtgcagactcagcgaggaggagaagcagca

SEQ ID NO: 572281 - DNA, 117 bp, Homo sapiens
ccgggtgctgtgattagcaggatctgaagctctacaggagaagaggctacttagatggtacttattttctttctatggcagatgtcatggagcggtattcaggctcatattctacgg

SEQ ID NO: 572282 - DNA, 570 bp, Homo sapiens
  misc_feature (3)..(3): n is a, c, g, or t
  misc_feature (31)..(31): n is a, c, g, or t
  misc_feature (41)..(42): n is a, c, g, or t
  misc_feature (152)..(152): n is a, c, g, or t
  misc_feature (155)..(155): n is a, c, g, or t
  misc_feature (158)..(158): n is a, c, g, or t
  misc_feature (214)..(214): n is a, c, g, or t
  misc_feature (220)..(220): n is a, c, g, or t
ccntgggtatggggggggggtataaaccatnctcttcaggnngccagtcttaccggtcaggggcttcctgagaggactaaacctgaaggaaaagattatgcccttcatgggctagtgcgtggggactcatacgtctgatgagcaaaatcatnctngtngttggggggggggcatattcccaagggtgatgcacaggagggtgcttcccatgggnacaggnacaagggtgaatttggtggctttggttctgtaacaggaaaaattggatgggaaattaaaatcaatcacgaaggagaaggaaaccgggctcggtacatggcggagaatcctcacatcattggtacaaaaacaccatcttctgatgggtggggttttgactatacaaaacaccctggtaaaccagacccaaggggagaatggaatcctgatctcagattaagagggcaccagaggggagggtaggggctctcctgggattcaaatttgagggacatctcctaagggcatctgatgaccatactggttggctgggggatataaacgcaggggcaaaagaaggcggggcctggc

SEQ ID NO: 572283 - DNA, 1004 bp, Homo sapiens
gagagcctgtcattaggaccaatgaaagcttatgtacctcatcccctcaggtgactaagaatgtgcagtatattaagaggtcgcaggaatggtgctgcgagtggttgttcgcgtttctccatccatgaagggcacagctttcagtctagatctggggtatcactgagctgaagacgaacagaagggggtcgaataacctagtcagtaccgacactaagttgtgtctatgaggtaatggtgtgcaacggtatgtcaatcagtgatcaatttcttcctagtggtcggaggcttctgaccacatcacctgatgctattctgactggacttagattattttattgctctttacgtatttgctcaccacatgggggcatacaaccagaaattgtatttggcactcgcgtgatgaataccaaccattctagacactgacttcagatcgcttgggttactcttatgtctggacaatcgatagggacgagtagcgaccgtgacattgactgactcccgtgctcacagcaatatctgtactctccctttgtggcgctggagacatgtgactgatctggcgtcgctgtgcatgcttggtggctccattgtaaaaacttggtggccaaaatcggattgttgctgattggcattatcccttccttgtagttgggctaggctcttcaattttggaacattgcagggaatcctcgggcctcactcgctgctccatctggtagagacacagaccactttggtggcttcagcaacgcaaagggagccacttatggtcctttggattcccctcggacccagctggggaaccttaccaaccattgtggcccaagcaaccggaagagggccagttacaccttcctgcgagtacccttcaccacatggttccgagttggcacatgaaacgccagagcaaaattgtgggacatggcgcatgctttcatcctgaattagctatcactccttgggctccttgggcacgacatctgcattcaatcttc

SEQ ID NO: 572284 - DNA, 107 bp, Homo sapiens
tacgcaaagaagcgaaaagtcctactagtagacgaacccaccataaacctggagtgactatatggatgcaccccacactaccacacattcgaagacaaccgtataca

SEQ ID NO: 572285 - DNA, 157 bp, Homo sapiens
caagggggggacccaggtgttcccccccaacccccgggcgccttttttttttttgggggggtttttttcccgggggccccccggggggggttttttttggggggtttttttaattttttttcccgggccccccttaagattgggggggttgggggga

SEQ ID NO: 572286 - DNA, 1403 bp, Homo sapiens
  misc_feature (220)..(220): n is a, c, g, or t
  misc_feature (497)..(497): n is a, c, g, or t
  misc_feature (546)..(546): n is a, c, g, or t
  misc_feature (593)..(593): n is a, c, g, or t
  misc_feature (814)..(814): n is a, c, g, or t
gagggagtggtactcggtgtcctaagaggtgcgccgttcagcaggccggcgcggggggtaggtggaagggaccggggtcgggagatgtgcgtgcgggctgccgcgcgtcgctgcggcaggcgtgcacagggcgccgccgggcgcctgggcattgaggaccggttgcccgggcggcctggagcgatgtgtagacagggctccggtgctcgacgcttgttancgtcgtcgttcatagttctgagtctgctctacggcaccgtggtggctgtctcagttcgcatggcgcgcggacggaggtatgcgaaggccggccagaggagcatgcgacagtatgacgaaaataggcctggtgtcgacctgtgtgccttgggagctgtgagcaaggctggagtgtacacgtcgcgggccgcttctgcatgctcgccttccattgttgtcggcacgtcacacgagtgcagcacacggacgagcactggtgcccaaccctagtcgagacntgggcggcactcttggcatgcgtagacgatgtcgccttgttgatggcangtggcagtggacttgaccacacacatgactgagtgctctccacctgncacgcttctccactgagtgagcacctcatagacagtgccaccgtgggtcagagcaatcgtgtcacgtaggaaatgggttgcggcgcggttcacaacacgcgtacgcccacgtggcgactcctgcgcatggacaaatgcgcatgggagtgcatgaccatgatcctcgcgaatacccagcgatgaaaccgcagagcatggtggtgcacgttgtgggcaaacanctcactatgggggaccggcaggcgagcgccccttaggggacacacttctcatgagcggtcaccaatgcaacacatatctaaggaacggtgggttgcggttgcgcaagtagcgacataagctttgtgcacattcctctccagtagtccaaaacctagtgtagaaagatatcgctctgggtcggtggacttttcgaacaacacagagttgatgcacaattacccggctttgggccattctcgactcgagatttgtgggcccctgggtggaattggaaggcaaggggggactcaaccggactccaccagggttttgcgttcgtcggaggagtaggagagaagtggggcgcacaaacggcacccctaggtgaaaccaagaaaggggttgccccatcgtcgaggggatacccacacaaaggggacccccaaccgggaacacgtgggggggcaccactcttttgggacatgtgacccaacatggggggatatgtttcaacagcggggcgcgcaagtcgacactgtggccagcgacactactattagggcccacaaagacccagcatgggagagaccattgtggacgcgcccgatg

SEQ ID NO: 572287 - DNA, 410 bp, Homo sapiens
  misc_feature (153)..(153): n is a, c, g, or t
  misc_feature (217)..(217): n is a, c, g, or t
agtgccccttacaaaaaggggcccagagaccctagcctagttcctccttcctgcccatgtgaggatacaatgagaagtagacagttggtgatatggtttggctgtgtccccaatcccaagtctcatcttgaattgtagttcccacaattcccnacgtgtggtgggaaggacccagcgggaggtaactgaatcaagggggcagtttccctcatgctantcttgtgatagtaagttctcacgagatctgatggttttagaaggggcttcccccttcagtcggctctcattctccttcctgctgccctgtgaagaagaacatatttgcttccccttctgccatgaatgtaagtttcttgaggcgtccccagccatgccaaactgtgagccaattaaacctctttcctgtacaa

SEQ ID NO: 572288 - DNA, 105 bp, Homo sapiens
gagtggtacccggtgatgtgatctggaatctcggcacgatgcgccactttcaaatggagcccctgccccatttccgtgccgccatggttcatatgcaccgagccg

SEQ ID NO: 572289 - DNA, 217 bp, Homo sapiens
ggcaggcactgaagcgtcaggctgtgcggcatactgaggctttagttccttaagctgtgagccctagaaagccagtggagaaagctgatcctatgtagggcagtctctcatttcaactgcaagggaccgatgtgtgctagaagtggcagatggcctgttttagcagtgggtcagccctgtgagagagacgtcaggctttctgagctcacacacccat

SEQ ID NO: 572290 - DNA, 1747 bp, Homo sapiens
ctgacgttcctgcgaaggcctgaccaatgacgcagactaacgcgctgcgtggacatccagtctagtggcctgagccaatgggagcttctgggccgaggttcctgcgtgcgtgtgcaggccatgtgaggaatgcgcgagagcagggagcagggagacagggtgagagcggccgccggtccaggtccccgttccaccttgcacatcgaaacgtggagactgcttaggaggtgtgtcttaccgtggatgctcatgtcgattgcctccttggggatcaataccgcactatcaatggactcgacccgcatgcatgcagcggaatgactcctgatcgtactgtcattgcatcgacgccaaatgcaaggtgtcactacacgaaagcaatcatgtcggactgttgcgtgcgatggcggaaggaggatacctcttgccatggggggattcgcacgcgcttgaaggtacacaattgcagtgggcacaccatgggtagggatacggcctgggacctcgcttaaagcggcccactagggagggcatgcggagtggaactagggggacggaatccctgggttagacaaagttctgtgtagtcccattaccaacttggcaggcacaggaattgcagagttggcgggaacgacgggtgatggaggaaggccttatataaacccgcacgggaatgagcctcggagcccgagacgtttcccgggcaagcgcaatgtgccttgtgctttcagctggcgaagcgcaatccccaggaggcaacagggaatgttgcaccttgaacgatggaaccggtaaacacttgtcgttttaccattccctggaccgaggggacacagagtgggtccttaattgggaacttgcccccacttccaagaggcattggtgtcaccggtactcggcctaagttcgaaggaaccaatgatctaccctggagcgaggcccggggcgaatctcctgtagggccaccaaaggcttagagtaggcacacattatcaccagacattacatatttacaaaaggcccaaagaagagtgggaacttccgattggtgtcaacaatttggaggggggcaaagcgccatttagaattcggggggccgttacacgctttatggggaaacaccgcacgttcgaccataaccacacatgaatgataacgccagggtgaggggataggaaaatgagcccagcccacggtaggaacctattggatcggcccaccaaagttgtgcccgcagagggcatgggaaacaccatgggggcataccctgtgagagaatataggagaccggacgaaacagagtctgggtgcggacacagtccttgtgggttgcgacacggaaccacataccagaacaccgcgagcgcaggtatttagaacgccgagaaagaacgcacgccaggaggaccaccccttaacacgggaggggaggcaaaagcgtattctcgggaagaacacccgagcaagacggccacgatgacgaacgacggggtcaaacatacgaaaagcagcgaactacaaattacgaacacccctgggaggcacagaccgagcgcaccagcaagggcacaggtgcgcaagcacagcgggcccataaaggagaggccatgataccacaacacagtagagagtgccacagggatgacaacagcccagcacacaactaacagagcataacaacagcagacagcagcaagcgcagacacaaagaagctggaacgacagaaagacaacgactaagcaa

SEQ ID NO: 572291 - DNA, 1038 bp, Homo sapiens
ccgcgctggcggtcactgctgccggtggtagatgggccccagatgttgcgctactctggcctgttccattacacttatgcttcaggctccagtgccagggtgctgtagtgggatcatggccaactcgtggctgcaaggactgtcacagggtccagatgcaggagagttttctagtactaatgcctacggcagcaacctgctgacagcagaggatccaacatccgaaaccccatcgcgcggctgtccttctgctgtggccctgcatgcaaggcattttcaagcttgactattggccaatttccccaaggcgacaccacacgctcacaaccttgcgccatgcgcagcgcggctcacgcccacacaattacaaacacgaacgtccctggacgccctgcaaacgtagatggcgcgcgcacgctacgctcactgcgcacacccctggaaaccaacaccacgcccgacacccccacaccttccctccccgcgcatcgccagcccccacgcacacgccgcgggtccacaccaacgtggccacatggtactggtgccgggacactcccgcacagtccaccccggcgcgcacaacgatcgcaacgccaaggggaaaccagaaccaaaaacaccaccggacacggaaacgcctacatccgcggcagtgagcccgacaagtacacacgaccacacccgacctaccaccgcacccaagcaccgccgccaccaggccacctacacaacgacgcacatgcaccagcgcggcaccgagggcgcctggccaacaaaggggacaacagcgggcgcccgcgcccagcgccatgggccagctatcacaccgcgcaggaaaacgacgcgacaccaacaacacacgaaagaagaagccacgcaaagcgtgacgacaaactaccaccgggacacacgcgggcccacacaggcacagcacacaccccgccccaaaccacacaatgcaacagcaacaacaccaggcggggcgacacaaacgccccacagcaatcccataacagacaacacacgcaccacaca

SEQ ID NO: 572292 - DNA, 210 bp, Homo sapiens
attagtagatacctccctagtatttttattcatgaacactaacgttctttctcccaaagcaatcacatatgcctcaatggtataaataatctattagtgttacttaacttagtccatcatattcatctggcgatgttaaaaaacaaaaacaaaaaaacactagtactatgagagccaatttgccaacaaatcaatatgaggaatataggt

SEQ ID NO: 572293 - DNA, 107 bp, Homo sapiens
ttttgtatccactttaatgtctacaagccacagcttcattaatttgatgccttttgattgacaggtaaacaatagcaaaggaatgagtttccatccagtgtggagag

SEQ ID NO: 572294 - DNA, 1231 bp, Homo sapiens
  misc_feature (20)..(20): n is a, c, g, or t
cgcccacgcgtccgcccacngcgtcgcccacgcgtcgcccacgcgtcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagaggagggggggggcgagcgacaaaagaaaacacagcagagcagagagagcgagcacgcgcagaaaaaacaacctacccaacgagagagcaaaaaaaagaaacaaacaaaaaacacagacaaatcgcaaagaaacaaagagggcgcgccacaacaaaagagagcagacgaaatataataacacacaaaaacagaacggagggacacagcaagcaaaaaacaacaaaagcagagagaaaaaaagcagagagcgaacacaaaacagacaacagcagaggagagacaccaaaacgagaaagaaagaagaaaacagccaaacaacaagacaagcaagagagagcgacaaaaccacgaagagcgggcgaagaccacacaaaaccagccacacacaacgaaaaaaaacacggacgcacacacgagacagaccgaacaacaacacgacagacaacgcacacaaccaagacgacgcagtaacaaaaaacaaaggagagcggagccacaaaacacaaaccaaacaacaggaccaacacaaaacacgcagaccgcaaaacagagaaagaaaaacaaagagaaagaaagaacaacaagcacgacacagagcagacaaaaaaacacaacaaaaaggaaagaaagaaacaacagccgagacacgacacccgccagcaacagcagcacacaaccaaataaaagcacacggcggggaggaataaaacaacagaaaacaggaaaaagaagaaaaaaaaaaaagaaaaaacaacagcaaacagaacaccaccaccaacagccacgaccagcgacgacacaagcacaaggagagggcagacgaggacacacgcgaggggaaggaggcggggagcgcgacggagggaaagcggcgggacgggagagagaaaccgagagacggcacgggacacgagagaggggccggcccagggaccgacgaacgagcggaagaggagcgagacggaggacacggcggacagggcagggacgagaggagacgcgaggacagcagaaaaccgagggacaagaaccaacagcaggagccacgcagacaacaacaaggcaggcgagcggcgaccggg

SEQ ID NO: 572295 - DNA, 131 bp, Homo sapiens
ggcaggatttcttttctcacaaggttaatgacagaaaatcagaggacagaacaggcacagtggctcatgcctgtaatcccagtactttgaaaggcagaggtgggaggattacttgagctcaggagttcaag

SEQ ID NO: 572296 - DNA, 638 bp, Homo sapiens
caggggaaacccaagtgtacagggtgcgcacagctccttccatcagaactacagctccacagaccagcaggatatctccactcgcgggggcccctcgtggtaatccagcgtgcgctctctggtgacagagtggtcattgccttgaaccctgagcgtgcgtctgctgtcatctaatgctgctgaagttccccagagcacctcctggtaaaactggccaagggtccttccaacgtgtctggagaagcggtcagtgtcacgcagaagaacccgaagcccctccccgcggccatcccagaccaacaggccaatggtcactttgtctgggtctctgagcagcagaagacctgtcttgtccatggtcatcttcaggccgggcatcattgagaatagcgtctccttccacttgtacgcagagcttcttcggttccaagtcaccaccacgtgttcagggaatgcgtgaacccataccagggggttcttagaggcctcttcgatccttgagaacccagccttctccctctcatactggccagtcacctcaaccccttgcacagggtctgagagcaggttctctggcccctggctgtgtctggggtccacacagaggcgctccactctctgcacagacagtgacagca

SEQ ID NO: 572297 - DNA, 730 bp, Homo sapiens
gcagcggctgcttgggggagcgcgggagcattgagtcgggggcagagagcctggggcgccggggctgggcgcagcgaggcgcggctggactccgggcttggtggcgcggttgagagagacgcgcagctggcgaaatgccccgcgtctaaggccttcggagaccatagtctccgcggacccctgtgctggatgcccaaagccggtcggacctcctccctgcgtctccccttccgctggctcggagaggaaggcaggagagcccccaaatatacccctcccgcccttctagggaaacttgaagctgaaagaaccacgcgaaatgacaaacagaaatgtctcggacgtggggcgtgccgagcgacctaatgggacggggcatgttggcagcgaccgagggacaattacgtcggcgggtgggggacacaggggacgacaagccccccagaatttacgggaaactcctaaattctactaaaaatacacaaaattacctgggcatggtggcgggtgcctgtaatcccagctacttggggaggctgaggcaggagaatcgcttgaacccgggaggcggagggttgcggtgagccaaggatccatgccattgcactaccagcctggagaacaacgagtgacactaacgtctcacacagaacacaggagacatagaggacgcattgcagtcaacgcgggattggtagcatgtggtgtgaaagggttgaagccagagaac

SEQ ID NO: 572298 - DNA, 359 bp, Homo sapiens
agtacgcttaatatatttaaataaagcacaatttatattaacgaagaactagtcttacagtagatctagcatattttctaagaaatagtgaagaaagcgtggatttgcagaacaagtaccaaaactacagaacttaagttgcctcataagacaactaaagggatatactataaaacctagatgatcgaggccgggcgcggtggctcacgcctgtaatcccagcactgtgggaggccgaggtgggcggatcacgaggtcaggagatcgagaccatcctggctaacatggtgaaagcccgtctctactaagaatacaaaaaattagtcgagcgtggtggcgggtgcctgtggttcgcagct

SEQ ID NO: 572299 - DNA, 527 bp, Homo sapiens
gtatcaacgcagagtgcccattatgggggaaggttcgttgtaaaaaaaaaaaaaaaaaaaaaaaaaaaaaaaaacgaaaataaacaaaccaaacaaaaaactacaaacaccaaaaaatacgtcgtcggcggcgccccgcgccaccagaaaaaaaggtttcttcatacaccctctcctgtgggcgggcgcgcagccgccccagtcagttgtcgtccgcgacgacctcgtgtcctccacggtgtacccatgagaagaaccccgcgaacagacacgagggcggcgcggggcgtcctttcccaacccaccaataaaaaatagaaaccgcgcgcccgcggggagaaaaccacccgaccggcgcgttgcaacaaaaacacacacccccccaacgagaggagccgtcaccggaagcagcgaccacacacaaccgcggcgtccacctacaaacccacacaggagcgaagcacccacacaagagggcagagcccccaacacaaccacaaaatatcccccgccccgcccacagagga

SEQ ID NO: 572300 - DNA, 399 bp, Homo sapiens
  misc_feature (9)..(9): n is a, c, g, or t
  misc_feature (12)..(12): n is a, c, g, or t
  misc_feature (70)..(70): n is a, c, g, or t
  misc_feature (74)..(74): n is a, c, g, or t
  misc_feature (94)..(94): n is a, c, g, or t
  misc_feature (104)..(105): n is a, c, g, or t
  misc_feature (127)..(127): n is a, c, g, or t
  misc_feature (154)..(154): n is a, c, g, or t
  misc_feature (174)..(174): n is a, c, g, or t
  misc_feature (193)..(193): n is a, c, g, or t
  misc_feature (201)..(201): n is a, c, g, or t
  misc_feature (212)..(214): n is a, c, g, or t
  misc_feature (242)..(243): n is a, c, g, or t
  misc_feature (256)..(257): n is a, c, g, or t
  misc_feature (283)..(283): n is a, c, g, or t
  misc_feature (334)..(334): n is a, c, g, or t
  misc_feature (357)..(357): n is a, c, g, or t
  misc_feature (368)..(368): n is a, c, g, or t
gcacgaganganctttcacaagagattttatgagaaaaaacagcttttctcatattatgagcacaaagcntganactttaagtcagcaaatgangctcatactnngggttattttatgacacggtanggtcaaaagagaaaaggtgggaaatgnaaagtggaggagaaaaacangaaacagtggaataaaggnaaaaggcngcacttaaagnnnagaagttcaaaggaggcgaaagagagcnnaaacgttccatgnngaaagctgagctgtgttcttcacatntagcattctgttgagcacaggatagcccagaaattttcatgtgttcaaagntctctgaaatttaaattagcagncttgaaccagncctgcgtttttttttcggtgggttttttctg

SEQ ID NO: 572301 - DNA, 267 bp, Homo sapiens
gtagctgttctagagtgataccagatgatggctcacgcgtccaagaatagaaaacgggaggcggggcgcagtggctcacgcctgtaatcccagaggctgaggcaggcggatcaccgtgaggtcaggagttcgggatcagcctgagcaacatggagaaaccctgctgaaaatacagagttagccaggcatggtggtgcatgcctgtagtcccagctgctcaggagcctggcaacaagagcaaaactccagctcaaaaaaaaaaagaaa

SEQ ID NO: 572302 - DNA, 354 bp, Homo sapiens
ggggggagcatgggctttaattatttcttaaaaaatgggccggttgtaaatggaaaaggctgaattttggtaattgtaaaaattggggatggggccctgaattcattattttaggggctctgaaaaaagctcatgtttttttttttaagccagcccctttttaaaagccatatatgtgcccgggcctttgaacctcaaatgaatgggagttatcccggggttttctttttaacctaaattcatctttttggaattaaaacttaattggtacctcccgtatatgaaaattcactttatgggataaaacaaaggcttcctttcctataggaaagattcatgcttgtttttcaaatt

SEQ ID NO: 572303 - DNA, 379 bp, Homo sapiens
  misc_feature (1)..(1): n is a, c, g, or t
  misc_feature (44)..(46): n is a, c, g, or t
  misc_feature (319)..(319): n is a, c, g, or t
  misc_feature (337)..(337): n is a, c, g, or t
  misc_feature (347)..(347): n is a, c, g, or t
nggccagtaactacaaggaggtgcctattaatttatttattgannnggggggtctcactttgtcacccaggctggagtgcagtgacgcgatcacgagtcactgaagtctcaactgcctgtgctcaggtgatcctcccacctcggcctcccgagtagctaggactgcagatgcgtgccaccacacccagctgatttttaaatattttgtaaagatgttgtcttgctgtgttgccctggctgatctcgaactcctgcactcaagcaatcttcctgcctcaagcgtcccaagtgctgaaattacaggcatcagctaccgagnctgggagggtcgttactnaagtgaaaangtgcaggacagagatgtaggagctcaggcttc

SEQ ID NO: 572304 - DNA, 223 bp, Homo sapiens
cgggtgggggcaagggatcaacactgtgtgtgtgtgtgtgtgtgtgtgtgtgtgtgtgtgtgtgtgtgtgtgtgtgtgtgtgtgtgtgtgtagagagatagagtctcacttgttgcgtatgtgtgtgtgtagagagatagagtcacactcttccacaggggagatgaggaggggtgcaactctcctcatcatgtgacgcgcgtaatcacgctgcacacgatga

SEQ ID NO: 572305 - DNA, 195 bp, Homo sapiens
ccagtacggattaggaagcggcgccaatgtcaccacggagaagcgggaggtgctggcggaccagtgactgcagatggctgcgtgtatgctgcctgtcccctgtggcatgctggccgacaatgactgttttattcgcagtatgctgttactcttgcagagtcgtggctgggtgcgccatctatcccgtctcgccca

SEQ ID NO: 572306 - DNA, 1043 bp, Homo sapiens
aatcagagcaggtccgtacttctcctatctctcccagttcctggtctgctggcatcaccttatactactttaacagaccagcaaccatcgaataccgaccgttcattcgatccactgccagcgagggcaggagaccgccattcatataccgaacaccttattctgatttttcaggtcaccctgaatgtttatatggcttatcctaccaggcttcggaataatctcccatattgtaacttactactccgtgaaacaagaggaaccattttggatacatatggtatagtgactagatgctactgatatcaattgggcttcctagggtttatcgtgtgagcacaccagttattctacagtcaggaatagacgtagagcgcacgagcatattccaactccgactaccataatcatcgttatcagacaccggcgttcaaagtatttaggctgactcgcccatactccgacggaaggcgatatgaaatgatctgctgcagtgctctgagccctatggattcatcgttgctttacaccggaaggtaggcctgactggccatagtgttcagccaactctgtcactagaccatcggaactacccgacgcacgtacaaaagtttgtatggcccacttccaatgatgtcctatcaattgggcaggcggattaggccaccatcagggcggtacattccacggatataccctaatactcaggcaacaccctggaccagagtaacccaaatccactcgcgatactatttaacggggagacaatgaggtgcatcgccaaacatttctggccattgtaagacgcagccttcggacacaggatgacccgataagacatgctaggggcaattcgacagcacaacaatttgacacggcaggacgcgagtacacaggtggttgctgcttcatcatatgagtcaacagtcatttgttgcgtgacggtactggcagcgcgacacgacaataaacgaactccatgcatgtcacagacgactcacgcagacacaagcatcgaagacacgagcaacgacagcatcaga

SEQ ID NO: 572307 - DNA, 708 bp, Homo sapiens
tatggttctgtccaaataactcagttcttaaaattcttaaaatgatcgtaaaccattatcctttaaaggtttatttgaagatgctgttaaagtacagaatttgtgtacaggtagatttttccgtccctcattaatagtgccttcttaattaatacagacctggtgttagctataacaaaactccagtaaggccaaagaatcccaagttcttggtggaaaaaaaaaaaattctttatagggtcagattttccctttcctaatatcatggaagatgatgtggcattggattatattcataaaggtatttataacttatgggaactcttagaagataatgggttaggcaagtgatttttttttaaaatatgggtgggcgtaagtggtatttggaaatccacttattttaaaaatcgaagagggatggtaactcagtggacactagactgtgggtatctacctgcccacattttcttaaaaagatatttcatatacagataattgaagaccaagctagtggtgcactgtaggtctgggtaatgggtatgggggctcgtggtatgtggtagaaggtgaaattctagcacatggttcaattctgtattgggatacttatgaaatgtgttaggttactatttggtgtttgtgaaagcataattctaaaactttggttggcatatgtgtggaattttatttattaactcaaactgt

SEQ ID NO: 572308 - DNA, 623 bp, Homo sapiens
agatatcggtatggatggaattttaggtaggcacttggcttccgtagcatcgataggatctcttattgatccttcccattcaggcgtaagtgcatcaccagtaccatactgcggcaacgcaactgacttcatttgtattacgtctttgttgtcttgataaggctcagaaataaagataattgctttcgcaccatattcttgagcagtcaacatttgttggaaaacataatctccgtaatgcactagtaaaataaagtcaccgtttaacagcccttgatcttgcatagaagccatatcgtccaacgatgctttattagcataaatcaccggtatgttgttcaattgaccattatggctcattgggttaaagttctcctcatttaagggaatatcaaacccttctgtatcatcctttgaatatacacgaagtgagacatttcctgggtaattcgaatacgccatgaactcctcttccccagctagccttataccatttttgtcgaacgactctttaatataatgtctaatagcggcatcaccacttgttcctgacatgtggggcatactactaatatactgtaaatctctttctatctttgaaaggtctatcgatttccgagcat

SEQ ID NO: 572309 - DNA, 230 bp, Homo sapiens
cacaagtagagtcagaacgtaggagagagaacgctgccgaaggtcgggttgggtcatccgagatcataaaaaaggggtgaccctaacaataggtacaagaatataaaatgtggaataagaagaatacaaacaaatttcctttttagagtacttttaagaaaaaaagcagggccttggaagttatggttctttagtgctcccctgttgcaaattctcatggttcgggttgg

SEQ ID NO: 572310 - DNA, 154 bp, Homo sapiens
gtctaacacatgatctatctgtgcctgtcatggtacactgtaccttagatgattgaagtagttcttagataatttagtttcctgccattagaatataagcttataaagacaagtttactgtttgtcttgtgcattcctatatccccatcaccca

SEQ ID NO: 572311 - DNA, 201 bp, Homo sapiens
cgaggcttaacctgcagcctctctctgctgtcatcattatttggaggttcttctatgacggcagggcaggtccaccacgtgacactgttggcatgtggggacacggagagggcactgcagatagctccccgttcagctcagggatgaccttgcttacagccttggaagcgcatgtcgaggcaggcatgatgttctggagag

SEQ ID NO: 572312 - DNA, 245 bp, Homo sapiens
tctgcatgtactctcaggatctccggtgtttcctttgtctaccaaaaatataaaattacctaggtgtggtggcacgcatctgtaatcccatgctactcggagtagtgctgactgctgtggagtgactggcgtgaacctggatggcagatgttgcagtgatgctgaggatcgcaccactggcactcgcagcctgggacaacatgagcgatgactcctgactcaatacaatacaaacaaatcagaca

SEQ ID NO: 572313 - DNA, 127 bp, Homo sapiens
actagagatacgcgatttttttttctctttctttatagagcgcggcgggttgattcgagctgtagagatgctatttgagatgagagagaactcagaatgcagtgtggtaaggattgctgagtaactg

SEQ ID NO: 572314 - DNA, 419 bp, Homo sapiens
cacccaaatatgtaggctgtctactagaacgctgcgccattgcacgctgtactcgaatctacgaacacacacactagaccacgtccacacaatcgtatgtttatactgaacacatatattcagacatattccggaaactacgaaacaagaaaataggtaggacactacacatatggaactacagcttgtacaatcatttagagcccatacttctaacggtgtacatatgtagacgtgactgagtaaagaagcaccacatgtgtgtctacactcaagcatcttcctcttaatactctgctgaggataacggacactaagtaataaaggaaatatcatgcaggctacttatagagtatctaagtgtgcgtagtgacttaagaggtcaggtttaagagaagtagcaacctacttctattata

SEQ ID NO: 572315 - DNA, 152 bp, Homo sapiens
attcgcggccgcgtcgactggaaaaacagtttttgctctcacatcatgacaatcaacacaaaagacttctgtgaccaaatgtgtggagttttcttccaccaacaagcaagcaatcaattcttgctagccccggggggggaaaacccaaatcc

SEQ ID NO: 572316 - DNA, 719 bp, Homo sapiens
  misc_feature (327)..(327): n is a, c, g, or t
  misc_feature (481)..(481): n is a, c, g, or t
  misc_feature (506)..(506): n is a, c, g, or t
  misc_feature (508)..(509): n is a, c, g, or t
  misc_feature (545)..(545): n is a, c, g, or t
tattttaaaactttttattgatgtttaataaacacacaagaagtgacagcttactggatttccaccagttggatacagtctgtcaccagcaaccaaaacgtactaccagcaccccagaaatcttccacatgcccctttctaatcactgttcaccctccaagggtaacctctatcttgaccatagattggttctgcctgtttttgaacatgatgtaaatggtatcagtcagtcttactttatatatataatttattttactcaacagtttgtgggattaatccatgttattcgtgtagttatactcaattctcattggtatatagtgntccatttgtgaatatcctatagtttattccactgttggtggaaatttgtatacttctaatttggggctatcaagaatattgctctgtgaaagtagagaggatatagtaaggtgttgtgtaaacagatttacctgaggctttatgttctaaagancaccagtcttataagtatcaccttngnngcagtccatgattttgaactggtcttctatcattgngctctttaggtattttagccagtaccatgtgcattgatagcaagtctccatcctctgcagttagctcttctagttataacattgaaataactagtagttatagagcaatgtctgttggcaggcattgtgccatgaacttttatacactatttcatcttaatcctcacagtcctg

SEQ ID NO: 572317 - DNA, 465 bp, Homo sapiens
  misc_feature (149)..(149): n is a, c, g, or t
  misc_feature (259)..(259): n is a, c, g, or t
  misc_feature (266)..(266): n is a, c, g, or t
  misc_feature (283)..(283): n is a, c, g, or t
tgccagttagccatgacccagcattgtcttcttgtttaattaagctttaaaaagaaagggggggagccaaatggccactattttgataccaaacccatagttggacttgaagttgggtgttagaattgctgcaagctagacacataggntattcatatacgccctcaaaagtgtgtgtgtgtgcaatgtaatgtgcacatagtgtctgttgtggatatatttggtgtaatgtgtatttgtatgtacgtgttattgaaanatatatnttaatacctttggaaanaatcttgggcaaagatgacctactatgttttcccttgaaaaaaaagttgctttgtttattaaatattgtgcgttaaaattattttatatacaccattgttccttacctttacataattgcaatatttccccctcactacttcttggaaaaaaattacaaaatgaagttttatagaaaagaaa

SEQ ID NO: 572318 - DNA, 466 bp, Homo sapiens
  misc_feature (4)..(4): n is a, c, g, or t
attnaccactttgggaaagtttaaaaaccccctttgggcttgcctttggaaaaaatgaatggcatgccttggtaattcccatttggaataaatcaggaaagcctcccctagtcccatcccatattgtgtccagaagtgggattaacaacccctggaagagtcccactgcccaaaagagtagttgctttccctggaatttcccaaagcttttggattttctggatcaagtaacccactttttaaaacctgaggtcaggagttcgagaccagccctggtaacatggtgaaaccccgtctctattaaaaatagaaaaaattagccaggcatggtggcgggcacctatagtcccagctactcaggaggctgaggtaggagaattgcttgaacccaggagacagaggctgcattgagccaagatcacaccactgcactccagcctgggcagcagagcaagactccatctca

SEQ ID NO: 572319 - DNA, 221 bp, Homo sapiens
  misc_feature (53)..(53): n is a, c, g, or t
tggtgggaggcctgaaacacctccatctcctcataggtcgctggactcagccntccgtccgcatgaaatgagaacagcttcacaaatgcccctgaacgacagacatggatctggggcaaggctggagaagattcctaccaaaccacagacccaaagaaaccacagagcatttggtaacaaagagaccagaccacaaagagcaaacagtaagggccgttcac

SEQ ID NO: 572320 - DNA, 275 bp, Homo sapiens
tgggaacccctatttttcagggacaccaatgagttgtatatttggtctctacatatcccatatttctcagaggtgttcattctttattttctttatttttgtctgagttattttggagagctggtctttgagctctgggattctttcctcagtttggtcaattctgttgtttattttgaaattctttttttttttttttttttttttttttttttttttttttggtgggggggcccccgggggcccccccccggattttttttttgggttttttt

SEQ ID NO: 572321 - DNA, 475 bp, Homo sapiens
caggaaataataacatacttttttatttttattttttattgagacagggtctcactttgtcacccaggctggagtgcagtggtacaatctcagctcactccagcctccgcctcctgggctcaagtgttaatttttgtatttttactacagacagggtttcactatgttggccaggcaggtctccaactcctaacctcaagtgatccgcccacttcagcctctcaaagtcagggattacaggtgtgagccactgtgcccggcctcctcagtccatttttaatactgaaggtataaattgtataaagatgtttagaaagttctaattcattttatgcatttttgcaaatttgactccatgaaagtgcattatcacgaagctgaatttgtgtaagcattgtgcatgtatgtaaaaacattgcaacttcctcaataaaatatcttctttttgtaaaaataaaaaaaaaccgcggccgct

SEQ ID NO: 572322 - DNA, 246 bp, Homo sapiens
  misc_feature (6)..(6): n is a, c, g, or t
tcccgntctcttggggttttaaaggttttaaaatttgttttgaaggtacattgccttctacagtataattgtaatataaaattaaatatatatgaaaaaattgtcattttagcttagggttgaaggaaatcacagcttttattgttatgtgataataaaattacattgtaggttttactatcagtcaaaacaaatttcaaattgaaaaacatgagaccgagaaaagcaaaaggagaaggaaggtag

SEQ ID NO: 572323 - DNA, 147 bp, Homo sapiens
cccactctcctctttccggtgtggagtctggagactacgtgcagaaattgcacctcgaaaggggaaggaaaacgaaggaagatacaggtcattcagcctcggatcctcatgtgtggctagaacggagagaattgtattacagtgtct

SEQ ID NO: 572324 - DNA, 375 bp, Homo sapiens
ccctcctagcatcactccccgatcagccctctgttaatctgcgttccttacagtagaaattggcatcatatagtattctcatggaactttcctttgtcaaagtccctacagttcagagacttacacatttaatgtgagatatgacaggcttaaaaagaaacgttgggggccgggcgcggtggctcacgcctgtcatccccgcactttcggaggccaaggcgggcggatcacgaggtcagcatattgagaccatcctggctaacatggtgaaaccccatctctactacaaatacaaaacattagccgggtgtggtggcagatgcctgtagtcccagctactccggggactgaggcaggagaatgaggtgaacctgg

SEQ ID NO: 572325 - DNA, 103 bp, Homo sapiens
ttcccatgaagcacatggaaccaacataagcacatggcttggtgaccaggaagtcaccccacggctatggggaaattagcccgaggggtggcttccctggtca

SEQ ID NO: 572326 - DNA, 184 bp, Homo sapiens
  misc_feature (30)..(30): n is a, c, g, or t
  misc_feature (60)..(60): n is a, c, g, or t
  misc_feature (128)..(128): n is a, c, g, or t
aaatatttttattggttctgagataacagngctgaggcgagctgggacgggccagagcgnaggtgggagctttgccctggggcggacatgctgtgtggggtctgctggcggctccctggcccacccangcagcagcagctggcacatggcccttggcgcctggcatgacctctgccggcttggc

SEQ ID NO: 572327 - DNA, 318 bp, Homo sapiens
ggcctctgagaccttaaaatgacagcctcctctcctggaactgggctctacgtggggacatcaacaaggccctgactggaaagcacatagaaaaagggcagatggaggctgggcacagtggctcacgcctgtaatcccagaaccttgggaggctgaggtgggcagatcacctgaggtcgggagttcgagatcagcctgaccagcatggagaaaccccgtttctaccaaaaatacaaaattagccgtgcatggtggcacatgcccgtaatcccagccactcagaaggctgaggcaggagaatcgcccgaacccaggagg

SEQ ID NO: 572328 - DNA, 1648 bp, Homo sapiens
  misc_feature (1177)..(1177): n is a, c, g, or t
ataccacgtttcatttcacaggtagtcggctaaggacatgatctactcccccgtgcagctcggttccctctaccctaataaggtttatggtgcctctcccagaactcgtggtcctggggtaaatgctcgtattgccctggtccagtccccgacaatacgtggtctgagaacatcggagacgcgtgaataaccgcggagcatgattcctccgaacgtcgtgcggagcgtctgctgtcgcgcgttcgctgctttcgtgcttgcgtgtgtggttgctctcctcttgcggctgctcggatggaggagagggtgcggcatagcaacgtggcggtagccggtcccctgtgtcctctggtggctcctcgggtcgcttcctcagtcccgacgcatggactgcagtgcgatcgtggcaggcgatccgtggtgccctgtccccgtgaggcctgcgagagcgggagcaggcggatgccttggtgcgtgcgtctgcgaggagccctggaacggggcggtgcgccactcaggttgctcgccttactcggcgggggcaaatccttggatgcgcgctgcggcaggacttatcggccgaggtacgcgccggcaccgccaactttcttggcaaaagtcgccggttgcgtgccagtatggggcttggggcatttgactgccgggtgcgtcgccatgtattggacgatccccccgtgcgccgtcttcccaatggccccgttttatgtggcgctgtgggcgcgatgcatgggtgggtcctcgcgtacgtcacggagccttgccggacttaggctgccccctcgtttgtggttcactctagataccgcggatgggcccaccgatgccgttgcgccgggaaatttcagggcaggcggagatagatccaaaagtccgccgggggcgtgcacgggaatgcgcgggggggagacgtgtaccccccgtgtgaacacgcatgcgttgccggaacccaattcacagcgttggggaacaccctgcggatcacgacagagtagcaggccatcctgcgtcgagaagaaaaagttccccttgatagagggggacacaatcgaacaagtgggcacacgcacggaaatgggggcgctataaggttccccagacaaaacggcaggcgaaaccccgtcgggtgaacccggggacccggccccaagcgattgtnggctccgcaacaaggaacactgacggagcagcacaggagaacccccatatagcgcagacagacaaaggagtggaaccccccaatatgagagctccattatggaaaaactatggacagggcagaagaataagcttccgccggatagcacagaagatgaaaggcgcgggagacgcacggcaaccacggagccccacaaccggcgtaagcgacaaaaacgaagagagagaagacaaccatcaaacgagagcgagagcagcgacaaaagaaaagcaagagacagcacaagcacagcagacacaatgctataccgcacagacgcaccgcagcacgacgaacgagagaacgacggagaacaaggactgcacgcgactaaacacgagcaacaacgatgccacagcccaagcgagtatcataggatgcaacaatcagcaacgcaaggccagcacatacagcacagaaagagatgacaca

SEQ ID NO: 572329 - DNA, 439 bp, Homo sapiens
  misc_feature (253)..(253): n is a, c, g, or t
tgcagggtcacgaataaaggaaaaaggctgaagtttcttgttactgcagctactgtggcatgccatcctgctttcccgctgaccacagcgctacagctctgttgcctaaggcagaaaataaacagaaaacattctggaatctgcattttagattgacgagtaaaagaatctgaataggcttatggaggaggcgactggttagggcataaacaaagcagcgagatcaccaaaatagaaactgagtcaagagagnaggaagtaagattgaatatatttagtagctctcaaattcaaagcagaaagaacacctgaaaaagaagaatgaaaaatgacgagacagcagactgaaaaggaggcaaatagtatattggtaagactatggcaatgtgactagatagaagaatttccagttaacatcttaggaaaaacagattgatgg

SEQ ID NO: 572330 - DNA, 244 bp, Homo sapiens
tgtcagaggactcgtgacggtacttggtagctataatttcagacaaaacactttaaaacaacaaagatcacaaaagacaaaaagggcattacataatggtaaagagctcaattcaagaagaggacttaactgccctaaatatatatgcagtcaacacagaagcacccagatataatacacacgatgttcttaacctacaatgcgattaagatagtcatcgatactcatacaatcactggaaacc

SEQ ID NO: 572331 - DNA, 223 bp, Homo sapiens
  misc_feature (67)..(67): n is a, c, g, or t
  misc_feature (73)..(73): n is a, c, g, or t
  misc_feature (79)..(79): n is a, c, g, or t
  misc_feature (128)..(128): n is a, c, g, or t
atcaggagcaaacagaccttgcaaggtcttccagccctgggacagaaagctattgaccaaccgggangaaaanccaggnagcctccctggcccagggcagcccttttccctccagtggcacctcctgnaacagtccacttggcgcaaaacccagtccttccaaatgaggctgcagccccagccatgagctcccgggaatgtttaataaaggcctggccacctc

SEQ ID NO: 572332 - DNA, 1022 bp, Homo sapiens
  misc_feature (51)..(51): n is a, c, g, or t
  misc_feature (137)..(137): n is a, c, g, or t
  misc_feature (159)..(159): n is a, c, g, or t
  misc_feature (163)..(163): n is a, c, g, or t
  misc_feature (165)..(165): n is a, c, g, or t
  misc_feature (172)..(172): n is a, c, g, or t
  misc_feature (190)..(190): n is a, c, g, or t
  misc_feature (196)..(196): n is a, c, g, or t
gcctcccacgagatctggaggtcagaaactctgctccaggttttgttgaantgtggcttcatcactattccttggagatgtatcaaaaaatgcagtcccctcatgccaagctggaggttctgcactaccgactcagntgtctccagcgccctctacagncccngnccaaccnagcctccaggccctccangcctancaagagtcgttcacgcctactgaggagcatgtgttaggtggtgcgcctgctgctgaagcacctgacacgcctattgccaacagcctgaagccagagcaggcctcaccctccgaaccacatccacacgccagacagacccctggaggagttcaaacgggctgctgtcccgaggttcgtaccagcagaaactctacctcttcttgcagcattgcttaggacactggcccctggacgcatcgtacagaggctgtccaggagatgtggctgagctacctgaagccgtggcggtacgcgcctgacaagcaggcatccgggaaagagaatccacagacccgggagtgtagacaggagaaatgggcaccttatgtccaggagaacactgctgatgtacaccaagttgataagtgggcctactgaaccgagcgctccgaacagagcatggtcagacccaagcacgcgctcataggtgtacgagtgggcacagtcataggccagaccaaacctgctctgagatgcatcaaaaaaggtgagcaagctatacatggagccagagtggataatcaccaacagacagaacgaatataaagggcccaacatacagtgggagcagacatgcaaccatggcaacaaggaaatgatgcacccttcaagggacaaagcaagattacaaggctggaaaggcaaaggactgcaaaaacaccccgaaaagtagagcagaagcacgaacactagcacaacacacacaagtcaagacacgccaaacaaaggcaagacatcacgacaatagagaacacagacgacaccagcaccagaggcgtagccaagc

SEQ ID NO: 572333 - DNA, 443 bp, Homo sapiens
cgttcgcaatgtgtgtttaaggcagagccagaagatccgtgtccacccatgtgccataagacagtgggcaacgttacaaatggcatgagaaaaatgggactataaatgcgtgtggaaaagggccttaatagttaagttacggctaagaatgtcatgtctggggtaagaatttccatttttagcaccgtaaatgtaatccacttaaatctatgtaagcaccttgtctccaggcagaacaacaaaccatccaaacattttaaacattggggggaaacactgaaggggaagggtcaacagagagaatcccgggtactgttgggaacggagtggatttccagatcagaagatccttgtcggatatccttctggcttaatgccggaagcagaccggcccaagtcatccaggggcgatgtaacttttcatttgcaacacgggtctcaca

SEQ ID NO: 572334 - DNA, 664 bp, Homo sapiens
tcttcgttcctggaaagtttcaaaaacctgcaaaactggctccaatgtgtaaactccttaaccaaattatgccctggcgaacccatctatcggggtccttacccgctaagggtgtgcataaaagggccagcaatgcaaatcagcgatctgcacggatcctggtgacagcgacgaagctctcagtgtgatagcagattaacatacgttcgacagagtctataggtaacagttcaccttcctgcgaagatatgcactctctctctaaggagaggttttcaagagacaaaatgccttgttgagctcgtggactccaagcgctaggccacaaaaggtcaccttaaaggtgctatggacgatttcacaggttttgtagagcagagccgccagcttgcctgtaaggaggcgtgctttttcaagcagggtaaaaaaattgagtcgtgcaagtcaagccgcctctagggttataacttcctatttataaacaatcccagccgcgcgtcagaataaggaagagcaaatgtagctcaaaactttatgcaactgttgttgtttttgggtggtgtaaagccaacagtttgtcgaaaaaacatatatgtctttaatcgttctccctgttttctctgtgctcagctgttccttgttggaaagaaaaatggaaacagca

SEQ ID NO: 572335 - DNA, 399 bp, Homo sapiens
gacctggagaggggaagttaaggatcttgagatgagtgggttatcgtggattatccagttgggcccaaagcacagttgtctctcagtatcctggagggattcgttccaggaccccccaggaataccaaaatctttggaagctcaaatccctgatagaaaatggcatagtgtttgcaaggaacctacacacattctcccgtattgttcaaatcacttctagattacttataataccaaatacaatgtaaatgctatgtaaggaatttttatattgtttgttgttgttttgttttgtttgagaccgagtctcactccctcgcccaggctggagtctcactttgtcgcccaggctggagtgcactggtgcgatcttggctcactgtaatctcctcctctcca

SEQ ID NO: 572336 - DNA, 1538 bp, Homo sapiens
  misc_feature (498)..(498): n is a, c, g, or t
gctcctcgccaggcagccgtccgggagccagccaagcgagcgtttcgctctgtgttgcccaggctggagtgcaacgggccacgtatctcggctcaccgtaacactctgcctaccgtggttcaagcgattctcctgcgctcatgcctcgccgagtagctgggattacaggcatgcgccaccatgcccggctaattttgtattgtttcgtgcgtgcgtggtgggggggcgcggggtcccgtcgctgtgttgaggcctgggcgtggtccctagaccaccctggccttcgcgtgtgacaccgcacgtgccctcggaccttccttacaggtgcgggctgcttatcgccgcgtgtggccgccggtgtgcccccgtgggcccttgcgcctcagggttgtactcacgccgttgtccgtgacctctggagacatgggtggtgctttcgcatgtaacatgggtacacatctgggcgaagactgctgttgtccgctggtcccattgcantggcgagtatgatcgctggggggtccttgggcaatacatgggcaaaactctctctccacggttgtgttgggccgtggtcttgcgttgagggaggagcagccagaggccttcgtttggggcgtccacggggggggccttagcccaggggggcgcgtttcgcgttatttccctggtgggggggctgtacccccccgggggggggctatgggggcgccggccaagaggggaggtttgatatttccctgggggacgcaggggccgactcctccccagggggctggcctttaccccttgggggcgcggagacctcttggtgggggctgtgtacttccgccggggggggacccgtttgcgccgcgcccctggtcgatgttccttaccgccacgcgaggcccccccacccaatggggtgccctctggggggggggccttacacgcaagcttttgtcttggaggacagggcgcttagtgtggccccctcctgggagggccatagcggctttgtgccatcattgggcgggccccttattgtgcgggtgccccctcgtggtgggcggggcccccttgtggtttgttggcgctctttattaagaccttgtgccttgtggagccatgagaggcgaggaagtgggacgaccccccgggatggtcgtgacttgagaccaccttgttgtgtgtgtcacggtgatggttaatgcccccaataggtgcttgacgacacaaacgtgtgctgtgtcaacagtttcccccacaaggcgggagagtacattgttgctgcacttccccaattttatcccccaggctttcgttgtcaggcgacaccgcgggacgagcaccatgttgttgtgcgacaaacaggcggcgccacaacaggtcggagcgggctaacacaaaaacagggggagttccgatcatcaagcgcggcgagacagctataacatatcacttgcttgagttggaccacacagcagcacgtggataagtattaaccagtctggtatcattcgtcgatcatatactgcacatgacgaccatgtgca

SEQ ID NO: 572337 - DNA, 182 bp, Homo sapiens
gatctagccgatccttatgcggtgcctttcaagagtcgaaacatgaagtctgtaaagtgacagactgctgtgttttgagttatgaaaatgatttcccatatttaaattgccacaagtctagtgggttgcttacatagatgatcaaactaagaaacctgttacaggccgggccctgtggctca

SEQ ID NO: 572338 - DNA, 325 bp, Homo sapiens
atttaatttttgttacatatgaacattcaatgatgatatgctcagtctcaaaagtcaaagaaatatgtgtgatcagcatacttatacctcctatccacacatatgtctccatgtaaaaagtacataaaattactatcatttaataagtgttacatatgaacattcattttggaagtgctgcagcctacaagatgccgtgcatgtgtgcgagtggcctgattacatattcctcccagcagcaagtcgcgtcactcctggaagatgtcgatattataagtcaaagagtctagagagaacgttcttataaacaaacgtcaaagaacag

SEQ ID NO: 572339 - DNA, 142 bp, Homo sapiens
aggtgcagttgacggaattgttgctggatggatttggtatttcagaggaaactggtacatactacagaaacggctttcccaaaggaaaaatgaaatgctgccaggtgcggtggatcacgcctgtaatcccagcagtttgggt

SEQ ID NO: 572340 - DNA, 438 bp, Homo sapiens
acttaaaatagtgtgaatttgtatatgttgggagttgatcctgtgctggacgggtatgctggctagtagctggaatcccaggactaagggaggccgaggcgagtggatcgcctgagatcgggagtccgagaccagcctgggcaacatggtagaatccagtctctactaaaaatatgagaaatagacgccaggtgtagtggcgcgcgtctgaaatcccagctactcgggaggctgaggcaggagaatagcttgaatccgggaggtggaggtagcagtgagccatagagtcgtgccacgtgccactccagcctgggtgacagagcgactgcgtctccagaaaaacaaaaaaggtaaaacataaaagtgaaagaaaaagtgaagaagataaccagcaataggcgttaacgtgaaaataaaagtgaccttggtcaaagaaag

SEQ ID NO: 572341 - DNA, 114 bp, Homo sapiens
gtgactctcacctctcagacaactaagacagatgacccccaattgaaaagagaattaaggttattgaaacacagagaggctctctcgagatttgcgcagagagaggagagtata

SEQ ID NO: 572342 - DNA, 222 bp, Homo sapiens
gaaggcggagattgcagtgagccgagatggcaccactgcactccagtctgggcaacagagcaagattctgtctcaaaaataaaataaaataaaaaacaaaaagcatctccagtgatgctcatgcctgtcatgtaaaggttccagccttgaggccaggcgcggtggctcacacctgtaatcccagcactttgggagggcgaggcgggcgagaagctgtggcgg

SEQ ID NO: 572343 - DNA, 103 bp, Homo sapiens
tgacctccaggattcatgcgttgtcagtgaaccactattacgaaaaaactctacctctctatactaatctccctacaaatctccttaattattacatttcaca

SEQ ID NO: 572344 - DNA, 568 bp, Homo sapiens
tcctcggcttgccccttggtgcaacgctggtggcgtttcgtggcctggccatctggcaggcgatcatcgtcgcgattcttggcgccgcgggctcctttgccgtagtgggcatcatctccatcgccggtcgccgtggtcgtgcgcccagcctgaccttgtcccgcgccattttcggtgtgcgcggcaatatcggcccgacattggtgtcgctgatgtcccgcctgggttgggaaaccgtcaacaccaccaccgcagccttcgtattgttgtcgttgagctccatcctgttcggctcggcagtggaggccaagagcgtgccggtgctcaccctgatcttcattgccatcttcgtgctgttgaccctggccgtatcgggcctgggccacgccacgttgctggtgatccagaagtgggccacctacgtattcggcggcctgaacattctggtgggcggctttctgtgtgccaccatcgactggagcgcggtgttcaacgccaccccggcgcccgtgagcgcgatgatcattggcgtaggcccatggctggggtaccggatcgggtggccaag

SEQ ID NO: 572345 - DNA, 202 bp, Homo sapiens
  misc_feature (202)..(202): n is a, c, g, or t
tcaaagacttaaatcgtgaccttataaggagcccccatatcagaactttgacgggtaaagccctcaaacttgctagggaatgaataaagccaaaggacggccctaaggccctgaaatttacgggccacctggcctaacaccaaacctctggcttaatccctttaagcccgccgggcactttcgggttcgccgaccctttctn

SEQ ID NO: 572346 - DNA, 1245 bp, Homo sapiens
  misc_feature (645)..(645): n is a, c, g, or t
ggggactccgcccagatttaactggcgacccgtgaccagtattcttgactactctattgctgatctgtgaatgcttcgagtctgggcaccgtcatgacgtctggggcgagaaaagtccacaccctgtgtctgtgtgcgtgtctttcagcctctggtctctgtagcattcaacagcatgagcacgagcaatagtagccatcccattcgggcctatttgaggttttcgtgcatgcgcgcaagccttcgcaccgtgtgctgcggtgcaatgactgcattcccaggacgtcgagcaattgtcgggtaaccatcctgtctggacgctacgcgaaaggcagacgtccaaaccgacgggcccactccaaccctactcgggcgctagcataacgctgatgtggtctccccacgctgcgagtctggctcgcgttgacgttgcgatttgctataccgaatcacttcacggcctaaatgccatatcctttgtagcacctcagtgcacgaacatggctgcgtaagtgggtctgcgccgtgcaaccgtgatgactttgccgtggaccgcatcgtcacaatccatgtccaactggtaacgtactgttagctggctagcgtgcgcggcaaatacaagaagcttgatcgcctgctgaccanccctggtaggggactgctttccctagctttgcactttattgcctcggcatccatatcggacgagcaagtaggaacccaacttctagtttcctttccatccagcaatacctcatccaattgccttcttcgtggatttccatttgtacatcctgtcaccaaagtcatagcccaattccaatcccccaccaataccgtctagcagcaacatcataaccggttcagtccgttgggctgcaagcgaagaccacacggggatctcggccaggtaacccgctgacttggcgcgcatcggtaacccttagggtctcgccggagggtgatagcgaaatcggtgtgatgtgggagcagttcctgcccagatgtcccgcgcgctaagccaacgcgaatcgggggaggcgaggaaatgcccggccaatggaacggtcgtgcaacgcttgccttgaccgagggatacccgttgggtggaggcccccttgtgggcccattctctatcctatgcggggtgcgttttcaactttttcctttgcggggcctccgtggcctccctttacattcggtttagtgccatgttgggcggttgttccccctttgatggttacc

SEQ ID NO: 572347 - DNA, 122 bp, Homo sapiens
atacagtgagcgagatgcgcacggtactccagggcacagcgagactccgtcgtcacagcaaaacaaaaacacaagccccattaattgaaaacaggcatcaaatggcaatccaccaacacaaa

SEQ ID NO: 572348 - DNA, 908 bp, Homo sapiens
caattctagaggttgtgcccagtccgtgtagcgctagccgattctcgtgcttctagatgcccgaacaatttaaggtagtggccgaggcattcgaagatgaccttggaggtcactgcattgagagagcaggcccagccaatgtgtcgactatcatgtttctgactaagaaatacaaaaatacttaatgcgctgtacgcatcgccgtgtacgctccccatgtctgactagcgtgtagtgtcctgagccgacgagagcaggcatcgcttggacccaggcaagtggatacgtgcaaaggctggatgccggataatcagcgccctagtagacgtcgttcctagcacttgcggtcagatagatgtgaggagtccatctcgtgagcaaatctcgatatctggttgtactaacaggagagcaaatgtcgcattcccatatagtagactcctagaatcaagcaatgtgaagatcacttcggatggaagctacatctccaagttgctaagggcaagcacaatatccgaagcagcaccgacaaactacaatataactaaaggttagagcaaacagagttatattatcgtaattagcaagaaaaaggggcctctctaggccagcagagattaaaaagactggcccaacgttccatttccataaccttcagggaaccacgcaaagttgaggatttacttatctaggacttgaattccttcttttgggaccaagttaataaaaatgagcaagaaactcctgaattaaactggataactgaaggattctgttagcaccagggctgcacgtatcggcctattgttttgaccttcctcctttttctcaggttaaccaatctcaagaggcttaagaaacattccacataaccccaggaagcggtgtgggggcttgactaaagttaa

SEQ ID NO: 572349 - DNA, 633 bp, Homo sapiens
  misc_feature (213)..(213): n is a, c, g, or t
  misc_feature (310)..(310): n is a, c, g, or t
acaacaatcctaaactctttttcgggagtggggacaggggtggggaacgcataaaattcatcggggacagaccggaggggggggcccgaaggaaaccaaaattcctttttgtttctcacggagggggtaacggggaaaagaaagtctgcacaagtcggggcactccatgcccaaacagaacgtggtacccaccgtgttggctttgggcaaaanagtgaacatgaacgtgctcaccacgttaagcttgggtgcccgcccccccgtgttccacgaaaaggattatgacagcctggggcaacccggttttttngaccgtttaatccgttggatttgatagcccccccgcccgggccccccagttaagggttgtgagcccaccccgtccatggtgttaagggggccggggtcccacagggccagcaccgttgttcaatgggaaaagccctggggcttgcacttttcaagttcttcccagggggtcccggaagcccgggcccccgccaagcccaaggtttccccaggccctccgaagggggccgggcctccctccccctgaagccatcccaaggttcttgacctactgggcccttgagttttggagcaagccctgacccaataaaggttttgacccca

SEQ ID NO: 572350 - DNA, 661 bp, Homo sapiens
tttggtcctttcccctggaactgtctccccctgaaaggtcgaacctgtcccagttttaccggggtaccaagatcttacccccggaccaccgggaagcccttaccgcccggagcccgaccggaaggtttttccccaatttttcctaaataggcgcaaataccgcaatttccgcttttcctctgtcccacaggaggaattctcctccggcccagtattaaatctgtggacttgttcctcctaaaccaggaaggaagccccacaaaaagggcaccacatccggaagaaaattccacaaaggaaatagacaccccccggacgccagtccaaattcccgagaggcgcccattaacatggtgccatcttcttgctgaataattaatggcccacagagggagattcacgaaacccctgaaagttatagaaaaggcctccaccgcaggaaccacaagctattcacagggctgctataaggaacgccacaaaaaggctaagccagcatcttaaaaagactgccatggctgctgctaaggccacctcaccaaggccagccacctaagccaaagattgtgaagcctgtgtaaagtttccagctccccgagttggtggaaaacgctaaactggccagattagatttttaaataaagattggattataactcta

SEQ ID NO: 572351 - DNA, 934 bp, Homo sapiens
  misc_feature (925)..(925): n is a, c, g, or t
aaatgaaaccaggactggacctactgattcaaacttggacatgagcgggtctgtcctcttcacgccggagacaggtgtgatgcttctgaccccgtagagtcatccctgtattgggccttaataaatctgctgtcggaaagaatccgctatacctatgaagagttattcccaagtgtcacttgtggtgatgataatgcaagggagcccgaaaatgcagttgacaagctcttctcttcagagacagcatggcgtccttcttgcatggttgttcgacctcaacaggcaatctactatagaattggaaagttaccgattgcttcgtgtaagaaggtccttcagtattcgtagagcccagaagaagacttctggtgcccattgtcaggaattcagaagacgtgtgatgacttgtgcccttgttcacaacgtattccgacggtcccggtgcaacgttctgtgaactccatactttgtcccacacgactgccgggatgcctacagccatgtcacgcgtcaaacacggtaccgtgagaaaagctgcttaaagcctgtcccttgaagcagaacgacttagggcagataaaagagttaaaatcgatcgcaaggactcgacgaatgctggggtcacttgagcgtaattgcacagtgctgcctgggccacaacgtgcgttggctcaggagagaaaataccccatatcagtatttgaaaggtaggcggtgtcctctgttctaagtgtagaaacagtggtgaactgggcccagagttaaaaagataacagggtctgggacatggtaccattcctatgtaccgccgggtggaaaacctttaacacctctcgacgaacgcagtatatgtagacacatcgagtacgaaccttgttgccgccccccccccctcttctctcctcctcaatcataacattttctngaagaaaga

SEQ ID NO: 572352 - DNA, 372 bp, Homo sapiens
tatctcccagtaaagggagaaataggcaacgaagaaaggggtactggtcccagttaagtccaaaacacaaaagggaaaacaacattaagacttaatgacggagaatgatctcctttgactccatgtctcaaatcctaggcacggtgggacagacatggggcctccagtgcctgaggcagccctgctgtctgcgtgtgaactaacaggaagtgggctgaagtcatcctttttctcaggaccccacttctgaaataactaatccattcctgcgataatggcgttaatccattcatgaaggcaaagctctcaagacctcatcacctcttaaaggtcccaactctgttgcattaaggactaagtttccaacacatg

SEQ ID NO: 572353 - DNA, 167 bp, Homo sapiens
tgcggacccttaaggctgtacccctgcgcaggtcgactacacctccagtggtgccagcgcccctttgaaatagccacgacgcgggttatgatagtgaacctagcacaccactctactttaagtttctcgcgcaagccccacatgggaaagtttgctgacggtgtcaa

SEQ ID NO: 572354 - DNA, 693 bp, Homo sapiens
  misc_feature (217)..(218): n is a, c, g, or t
  misc_feature (221)..(221): n is a, c, g, or t
  misc_feature (278)..(278): n is a, c, g, or t
  misc_feature (288)..(288): n is a, c, g, or t
  misc_feature (500)..(500): n is a, c, g, or t
  misc_feature (522)..(522): n is a, c, g, or t
  misc_feature (693)..(693): n is a, c, g, or t
cattcctttcatcttccagctcttagtggctgccagtattgcttgacttgtggccacatcactctaatctctgctctctctctttacatctctttctcctctgtgtgtctctctagcctccctttgcctttctttcacaggacgaagagggcaagttcagattacgtggattgctgccgggatgtgtgtaccacgttcagctcaaggcagaaggcanngancacattgagcgggcgctcccccaccatagggtgattgaggttgggaataatgacatngatgatgtanacatcatagttttccggcagattaatcaatttgatttaagtggaaatgtgatcacttctctctgaataccttcctacattatgggtcaagcgttacgaaagcgatttcccccccgctcagagacggcgagaactatgttgtgcttttgaagaccacacttcccagatcccagtatgactacatcttgcctcaagtttctttcaccgcagtgngctaccataaacacatcacctngatttttaatcccacgaggaagctgcctgaacaggacatcggacaaagatcctaccattgcctgccattgacgcttgctgttctgcttggccggtaccaccatgacaagctcatcccttgcttctgcagttgacaagccggctacaggcagtccgcttccttgcccagccn

SEQ ID NO: 572355 - DNA, 210 bp, Homo sapiens
gcttccctcctttcagtagaattctttctctaataaaattacacagaaataacacaattctttttttattacattgtttatttccaggaaataatttgggctatatgtaacttgtaaaataaggggattaggcatcaatattatattaggagtgagaggtgtggttataataataattcccaggctttcacaggttgccgcagtattaca

SEQ ID NO: 572356 - DNA, 294 bp, Homo sapiens
tggctgcccccacaggggctttaggctggtttgggtcatggggaagcgtccctcttatcgcggtctgtgttctccggatttgggatctaggtgggggggcctccggcccttttatttaaagggctttggcttttgtaaatcccaagccaataatagacttttttctccccctcggttttttgctgggtcatttctgccttgagactgccttgagacagggcttgccttgagagagtgagccaattaacagcggcctaattttgaatatatatatatatatttcttttcccccta

SEQ ID NO: 572357 - DNA, 748 bp, Homo sapiens
  misc_feature (217)..(218): n is a, c, g, or t
  misc_feature (221)..(221): n is a, c, g, or t
  misc_feature (278)..(278): n is a, c, g, or t
  misc_feature (288)..(288): n is a, c, g, or t
  misc_feature (555)..(555): n is a, c, g, or t
  misc_feature (577)..(577): n is a, c, g, or t
  misc_feature (748)..(748): n is a, c, g, or t
cattcctttcatcttccagctcttagtggctgccagtattgcttgacttgtggccacatcactctaatctctgctctctctctttacatctctttctcctctgtgtgtctctctagcctccctttgcctttctttcacaggacgaagagggcaagttcagattacgtggattgctgccgggatgtgtgtaccacgttcagctcaaggcagaaggcanngancacattgagcgggcgctcccccaccatagggtgattgaggttgggaataatgacatngatgatgtanacatcatagttttccggcagattaatcaatttgatttaagtggaaatgtgatcacttctctctgaataccttcctacattatgggtcaagcgttacgaaagcgaaaacctcgacaatccagtccagacagtttcccgttggccagtcgcggttctgccatttcccccccgctcagagacggcgagaactatgttgtgcttttgaagaccacacttcccagatcccagtatgactacatcttgcctcaagtttctttcaccgcagtgngctaccataaacacatcacctngatttttaatcccacgaggaagctgcctgaacaggacatcggacaaagatcctaccattgcctgccattgacgcttgctgttctgcttggccggtaccaccatgacaagctcatcccttgcttctgcagttgacaagccggctacaggcagtccgcttccttgcccagccn

SEQ ID NO: 572358 - DNA, 105 bp, Homo sapiens
gcgctcagctggaacttccgatctattttttcttggtctcatactcagtttttttatgtagtcacttagtaaaataaacctaaaaaaaaacattgattttttctg

SEQ ID NO: 572359 - DNA, 1483 bp, Homo sapiens
ggagagacctagtctcgtaatcgcgggagcgaagatgccattcctgcacgggaactgggtcagtctgcaaaacttatgtgacccgcgcgccaaatccgttggcaccaaatctggtctcgtaactaatggttagctgaagcctggatcgtgccgaagcctatggggctccggtaacaagagggtacaggctacaggaaggggtctgaatttagccttggcgcatagtacttccgacattggagcgcgtctccgcggagagctgacgtgtacgtcgtcgcactgcagcacagggactccgagtggacgtctgtgagtcgcagggtgccaactggtactgccctgtgctggcgtcagttgggtcccgtctctgggcgaggtgtcttgtcactggacgcgggcaaggacttgacagctttggcagtgatcatcactgggtcgctggagagactaagctgggagtcccaagagagacacctatccgactatgataggagcccgagaagtcatgtgatggactggcgggttggcgtgcaaatgatcgcagtcagacacaggtatggtcgtagagttacctggatgcgcggaggagcgagacacgggtgagtgcgagtggagtcctgacacacacccagtgctgcgtgtgtagacaatcacgggatcggtgtctattgggtccggggcgttggacaattccgctataaaatggcgagcgagtcgagaaccgtgttcgttctcaatgacagcattctttcccgcgtgacgagagagagtagggcgcggcacccagggggcgctggcagttagacacgaacgggaacagaaaattggcgcaacacggacacgggagcccaaggggggtcttgcgcggcagccttaggcaggggctagggaaggaacagactgcacgggacgagaagcagaccttacagagagcgcaagacagtgaggacgcggagcacccatatggaacacgatcggctggagataggggatacgaacgacacaaagacgagcgtaggcaacaaaaaagaaaaaggacacgagacataaagagcagggccgttgacacgaaagcacatagaacgcaaccaggagcacagaacaaaaagctaggcacgcgcacgcatccgataaaccagacgcgaatgggcggatggcacgagaagccaaaaaccgcaacccgagatagaccgggagaacgggtaacctaaccacgagaaggcaaacgaaagccaagacggtaaaacaaaccaaacacaagtaatagccagcacccacaaagagaggatagcacacacgcagcacaacaaagacacccaaacaagcgaagcaagaacgaactacaaagtcgccatagaccgccggaagaaaaatgagcgcccgacgaacatcaagacgaggggaaaacacaaagaatagtagcacgcagagagcaagacaagacgcccgagggaacaacaaaagagagagagagaaacagcct

SEQ ID NO: 572360 - DNA, 236 bp, Homo sapiens
tgtgacttcaagactttgaaatttggggtgcaatgatcccaaaaaataagttaagcagttactatggagtgtgtgtgtgtgtgtgtgtgtgtgtgtgtgtgtgtgtgtgtatgtgtgtgtgtgtgtgtgtacatgtgcacaaaacagagagtgtattctacataaaatctctctctggcgccagagcgcacatgaggagtaactcagacatacaggagacatacatcgtcgtctcg

SEQ ID NO: 572361 - DNA, 130 bp, Homo sapiens
gtgtcgctcgtaccactctctcgtgtaccctggactcctttctaccgatcgcctctggtccccggacctacctcccacgctcccttcgctgtcggcccccctggtgttttttttttttcttttttttttt

SEQ ID NO: 572362 - DNA, 1028 bp, Homo sapiens
ggagcggcgggggcggcgcgcgcgcgcgcgcgtgtggtgtgcgtcggagggcggcggcggcggcggctggcgggggtgtggggtcctttcctcctcgagcaaaacaatcacgcctattaacttcttgctgcacgtcgcaatatcatatctcccatgactgcgagtagaccttggacccagcatgtccgtacatggaacgtgcagagacatgtgtaccgttccgcgcgtccctgtaagacgagtgcacagtccgcaagacaccggactacagagacacgatcggtctcgcctcttctcaacgaacactcgcgactgctcgggccacatatcacttgatcggcggcttcccactcgcaccaccagcacacacggaatcaggactacctcgggccagcgacgtaaggaacccgactacattccgccatctgacaacagtgctaacagctggctcgaaacgcatctcgtacccacagactcaccccagtgggtttgaaccacgtcctctttaacggactttcactctaaccggcccaaacgataatatatccacacccatcaacgcggctcacaatcgattaatggatgtggcgattaagatcttccctacgcgtccccagaccgaaaccccacagacgctggcgccttgatcccatggcccgcttccccacagccgcatccacacgaatccaccatcgttcacccaactccctcccaacctgggcaatggcaaaccttccgcaacactaacgccatgggaaaactaacacgaccacggtccctccattccacacgaaacagccagcacgagctgtttacaagacttcctacacgactctcgacgacactggagaacacaccaaagcgcgaagagagccaactgggcgttgcagcctggaaccacgctctaaagcccatacctggcccccccacgctatacatcggtcgcgcccaaacacccccattgtcactctcactaaacactaccaagagctagctacgacggcattggttcccactccacacgtgaa

SEQ ID NO: 572363 - DNA, 118 bp, Homo sapiens
tgtgcatccccccacctcgagtatccctcctgtctccagtactctccacagacaataacctctttagtgagactggccatatgctgaagaaactggaagtgagttgtctcaatgttta

SEQ ID NO: 572364 - DNA, 136 bp, Homo sapiens
agtgtctcaacgaggtctgcttctacagcctccgccgtgtgtacgtcattaacatggagatctgtgttcgtacagtgtgttccacgaggagcttctccgagctgacctctgtcgggacaagttctccaaatgtggc

SEQ ID NO: 572365 - DNA, 666 bp, Homo sapiens
  misc_feature (431)..(431): n is a, c, g, or t
ggtgatctcgatataagaatcacgaccctcgtctctgtaccaattttagtgattacatttttaaatttatctttaaaatttaaatttaaatttaatgggcatttattttgatggaaattataaatctaattttttgtaaattactatctgattatctaaataccatgtaatcattaatttttctcatgtttgtgaggttgagttattattattattttttttttttggagcatggagctctcgctctgtcgcagaggctgaagtgcaggggcgcgatctgggctcactgcaacctccggtctcccaggttcgaggtgatttccgttgcctcagcctcctgagtgggcgggggactacagggcgtgcaccaccaggctcagctaattttggtattttaagtaggagacggggtttcaccgtgtgggccaggnagggtctcgatctttggacctcgtgatctggcccgcctcggcctcccaggggtgctggggttgcaggcgtgagccatggtgcccggccatgatttttttttattacactttaagtccggggatactgggtgcagaaggtgtcacattggttacataggtatacatgtgtcatgggggttggctgcgccataaagccgcatctaggttaaagccccaatgcataagtattggtcat

SEQ ID NO: 572366 - DNA, 325 bp, Homo sapiens
aatagtcatttttaaagtaattataaaaaatttgttgttggccgggcgcggtggctcacgctggtaatcccagcactttgggaggccgaggcaggcggatccctgaagtcaggagttggagaacagcctggccaacatggtgaaacccgtctttactgaaaatacaaaaaattagctgggcaaggtggtgggcacctgtagtcccagctattcaggaggctgaggcaggagaattgcttcaacccaggaggcagaggttgcagtgagctgagatcgtgccactgcactccagcctgggtgacagagcaagactccatgtcggtaa

SEQ ID NO: 572367 - DNA, 1455 bp, Homo sapiens
ggatgatgttcatggtagaaagtactgctctttgcacaggagcctgtatctacagaaacccatggtgtgcacatagagcacttttctactgatcatcatcacactctgatatctgaggcagatgagtaccgaaccacgatctgaagtcaacagacagaatccaagttctcaaaattgcctgcggacatgtgtagcagtatctagcaaacacatgcaaccagaacagtatcaggttattttttacaaatacaagcacagtccatgttagtattctagcacattatcatcacatacacacagccatcggaacagcaaaatatcatctatcaggtaagagccacattagtcacaccacatatatctgaagcacacagtcagaaacccaattatacgagtcattataggcaaaactcaccttaggccacatacacatgcgtatagtacatatattcaaacaacacaaaaaaacaagcaaacatagtacacatagtaaaacagggtaatagcactataagagacaaaacataggcatgaatcgcatcatccataaatactcaacaattccacaattaaaataaatagttaaagaatagcaaaagatagagataactggaatataataactaaagaggaataggtatagaaaaaaagatagggcaattaacttaaaaaatataagtagaatcagataaaaccttagaaaaccaaaaaattaatagagaattaaagctacaaaaacataggtcatggtaagtgagagaccactcacccacacaatactaacaaaacaccaaaaaccaaacaagcggcgatagcacaacggcagaaaagaaaaataggaagcaaacagacacaactgacccagtcataactaagaaacagacaataggttaaaagaggaaagcaaacaacgcaagcgataaacaccaagacaatcggcaaacacacaaaacacaaaaaaccaccaaccaaagagaaaacacaacaacaggccaaacatcagggcccacaaccagccacacaccactggcgcaacataacgcacaaccaaaaaaagactaggcaaaggcgccaggcagtgcacccacacctaaagcacaccaagcacagagacaaacgaccaaaacacaaaacacacaacagaaagcaaagacagaccgccaaaacgagagaaaccaagcgcacacgcacggacaaaagccacgccgactcgagagcaaggagagagaacgacaacagaaggaacacaaccacgagacgagccgagagcgaaagcagacaaaagcgacacacaaccagcagaaaacagcggccgacgcagaagaggcgagcgaaaccaagtgacggcaagccacacaacaaacaaaaaggagaagaaaagacacacagctaccaagcaagaaaaaagaaacaagaacaacacgccaccaagcaacagaaagaacgatgcgaaag

SEQ ID NO: 572368 - DNA, 398 bp, Homo sapiens
actgactcatgcgtaaatgacaaatttgagaagtctcccagtaaagctggaacttactggttaggttaacaacaaggttactggatgagtttcaagatttaaagccaaagcgtgtgggtccatgacttaggtgtcattgcgtgtgggtcacaatatttatatatggcgaattcagataaacatgggcctagcatggactctgggaaaacaaaatagaggctgcattacggagataagatttttggtctgttccctgggacatgcttaaaaaatacaatagctattatgtatggtttttattttcatgtggtttcggggaaacaacacggttttaaggatggtttctaaagatgcaattaaaaattgttccacaagggttaagtgtctggtggtaaagt

SEQ ID NO: 572369 - DNA, 1775 bp, Homo sapiens
gggtccgccgccgtgaacgtggagcctgtggtgtgcgtgtggacgtcctggactcgctgggagactgatcgcgactgacacacggctgcctgatcgcgcggcgagactcacgtgcttcgccctttctcgcctgcagccgctgactgtgcaggcagcctccagcctttcgagccatgcctctcactcacccagccgccccactcgagaaggaaccaggcagccgctccccgtgctggcgcgcctggccgccgctcctcgtcgcgcactcaatgccttcaacacaacactgggctccaacagtccacttctcaccctgggccaccacactaggaagccaagcaggaccagccggacctcctggcgcacctttctactccaccgacttacctggcactcactagagcctggccctggaactccttaacaaacgcaccgtcactacctccctggcacccagggggcaactggctgcacacgcccacgcgtccggcctctctcccttccgcacttctgcacctccaacgggccacagcaccctccacctttcccaaccccccaccacaccacgccccttacaccttgggccctccctggacacaccccgacacgccttcggctcccccttaccttgcggcccaaccaagcgcaactacgtgctccccttctgggacgcgcaacggggccctgggcaccttcaccacttccccccgtcacaacggccgtatggccccttggccccttcggccacatatcgcccacctcacctcggccacgcaacacaccccccgcacccacttaacctcatcatgtttccccccctgcctctcggcacccctgccctgggggccacaccagatgtgccgccaccctttccaagcacggtggctgtcaacacacggccaccggtgcaaacccactgtgcctacgaacgcactactgcgggcacacccccccaatgtgaccacccctgctggcgcgcacgaacccggcggcttcctgacatacacccccacagaccgcgcctttgtgcccccttgggggccacccaactatctccgtctacacccccaccctccccaccagtgccgcttggggacacacccaaagcaggacacctccaccaaaggccgcacacccccgaccgcgcgctcccactctcccctggtgggagctacccccaccccccacgattgaccacacaccccaacggcacaatcttacgacccaccctccaacctattcacaaccccaacctatacaacaccccgcacgcaccacccacacagcactcttccaccattttccaactcccacccttcccatacttttatacccttgtccaacacccaccttcattcctggccccaacccacccccacaccaccctcccctcaccctctccccctacctccaccacttccacccgcccttctacacactcccctcgcgccacccacctctcacgggccaaacaagtactccctgttgccccaccatttctgtcacacaaccatctcagcccctacgccctctgcacgcgcccccgccttattacaccacaccagctttacacggttatacagcacccgtgtggcgacctgacgtctcatccgcgggaggcatcaatgggcacgtgcatcatcatcggtgggcacgcccgtccctcacacctactcgtgggccggccgtcactcactaccctttcgctagcgacgcgcacacataccatcgccccagctccttcgcagtgcgtcatacccatcacatcaaacgcc

SEQ ID NO: 572370 - DNA, 459 bp, Homo sapiens
gtgcttcttcgccctgtacaggacggagatcgactgcgtcctctaagcccaagggaagggggccagcgcacccttagcccgagttgcgcaacaacgccccttatactattcaacttcgagatcagctgccaagaggccaaggcgctgaaatgtgacttcgtcccagtgacgctgcgggagggcaaaccggtcttggactgctagatcgaagactataacgagacctcgctttcaggactggaaatgctctgacctcgcgaggtcatcacaggtcaaaccgcaatcgcttgagtgcccgatgaaccgggacaaggtcagctgaagtagagcgaccaaacattcttaagtggagccacagtttctaaccgaggcattaatggcatacctgcacaggatcgacgatacaaacgtgggcgaccagttatgcgctccatatctttacatggatgtattcccagg

SEQ ID NO: 572371 - DNA, 1019 bp, Homo sapiens
  misc_feature (161)..(161): n is a, c, g, or t
  misc_feature (163)..(163): n is a, c, g, or t
  misc_feature (165)..(165): n is a, c, g, or t
  misc_feature (168)..(168): n is a, c, g, or t
  misc_feature (170)..(170): n is a, c, g, or t
  misc_feature (173)..(173): n is a, c, g, or t
  misc_feature (175)..(175): n is a, c, g, or t
  misc_feature (183)..(183): n is a, c, g, or t
  misc_feature (260)..(260): n is a, c, g, or t
  misc_feature (1019)..(1019): n is a, c, g, or t
ctgcagctccagcaggtggcgctgcagcagcagcatgcaacagcatgcagttccatgcagcagcagcaggcggcgctacagcagcagcagcagcagcagcaacagcagcagttccaggctcagcagagtgccatgcagcagcagttccaagcagtagtgcngnancancngcngntccagcancagcagcagcagcagcagcatctaattaaattgcatcatcaaaatcagcaacagatacagcagcagcaacagcagcngcagcgaatagcacagctgcagctccaacaacagcaacagcagcagcagcagcagcagcagcagcagcagcaggctttgcaggaccagccacacaattcagcagccaccgatgcagcagccacagcctccgtcctcccaggctctgccccagcagctgcagcaagatgcatcacacacagcaccagcagccgccaacacagccccagcagcctccagttgctcagaaccaatcatcacaactcccgcaacagtcgcagaccagcctttggtgtcacaggcgcaagctctcccttgacaaatgtagtatacccaacaccactgaaatttgtccgagctccgatggtggtgcagcagcacccagtgagccccaggtgcagccagcaagaagacaggcagtacttaatgccagccgctcctggaattgccgtctggaacaatattccgatcacctggtcttcaacaatttccattggtaacgatcatttccgttccagcattgactgccattcaggggccacacacaataaggaccccagttgtgtctccccaggaagacgcatcgttgaacgataataccaccgaaagtcttcacacgatgttgtcccagggaacaaggtggccaggctgaacccaaggtcttgtaacactgggacctcttatatagaacaatcgctgaccacctaattcgcagtggagaaaagggaccacaagtgcaccatgtacacagtgcaccgacaatacgccaacacaccgtaagn

SEQ ID NO: 572372 - DNA, 752 bp, Homo sapiens
  misc_feature (1)..(1): n is a, c, g, or t
natattgatgggcaaccggaacacgtgctgtagccactgtggaggtactaaaatgtgaaggtacaaccgggagtgagtcatcctttctgaaggaatcattgtccgttgcccagcgttgtgttccagaataaaaggaaatattttgaaaccccgttataggacctaaaatcctgagtttccgtgaccacgttaaattggtagcatcactgtgtagctgataatttatcagaagtacagcttgggccagattttcccttgttatcttaaaagatctgccttagccatggctcctttttcaatggtgatctttagattttcccaccccataagagaggagccaaggaaattacccgtttagactaagttaccgtatgtgtttcataagtgattaaagctatatcaacttccccggtattagttaacacccaattcagccacccttctgagtattgtttgttcaacctttcagacttggtgatactggacacctgtccgtgtaaataaccctaaggttaggatcttctaagtgtataactgtctcctaagcccatcacctgtggcaaccctgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttcccatgccctgttgtatgaatgccttaaaaattctaaagtaccatgctta

SEQ ID NO: 572373 - DNA, 393 bp, Homo sapiens
gcgagaaccttgtggggctgtcttagcctaacccgggagcaagtccacacggcgtgtcacacacacacacacacacacacacacacacacacacacacacacagtgaggtgctcacatctccacagccgcgggcgcgtatatatctctgtgcacacgatacacacactctctatggcacacacacacacactccgagccatatggagcacacgactctcaggcacgtgcacccacacatatcacacataggcagtctcttgtacagagacacagtcatatcttgtgtacacacagatataggatttcgctgtcgcacacatatagagacttgcactctcgagacacagcgaaaacgcaaaatctcacatactctctctctaacatctcacagt

SEQ ID NO: 572374 - DNA, 777 bp, Homo sapiens
gctctttccctgccgccgcgagtcgcgcggaggcggaggtggggtgcgtcaagattcagcttcaccgcgtaacccaccgccatgccgaggaaggcatggtgctggaggtgtaatggacgtaatactgctttacaagaggttctgaagatgccctcatccacgatggcctagcacggtggaattcgcgaagtggccaaagccttagacaagcgcaggcccaatcttggttgtgctgtgcttccaaatgtgatgagcctatgtatgtcaagtggggtggaggcccttggtgctgaacaccaaatcaacctacttacggttgatgacacacaagaaactaggagactgcgtaggccctggtacaattggacagagaggggaaccccgttaaagggttggctcgcagttgtgtagtagtacaggcctatggcaaaggacgtccagggccacggcctgtcattgccgacgtattcaaatgcgagaacgtgacgaactcaaatctgggctcaccagaagacggaacacacacacaacaacaatgtgtcggccgctaagaaagctttaaaaaccattgttggggccggccaacgagaagaacgcggccacgggccaagaaccgggcaagaatggcggtggctcacaaaaaaacggccgggaacggcggtggacacacccgcagcgctcgcgccacggactccacggccaggctgaaaaccccgccgcgcgacccaccccgcaccgcgctcccaccgctccgcccgcgcgagacgcaccgccgcg

SEQ ID NO: 572375 - DNA, 968 bp, Homo sapiens
  misc_feature (495)..(495): n is a, c, g, or t
cgcggcgccgagcgagccgaggcgaggtcccggggagggcgcggcggcgcggggcgcaggggcggcgcggtggggccgcgggccgggcgggtgggaggagagcgcgaaggggctgacggcccgtttgcatggtgccgcttcggcccggggaccgcccgtcgccccgactcagtccttgacatagccccggcgcccggagcattctcccgtggaggaacggatgacaaatggagcgattcagtgtccagaagggctcccaagagagccaggacgtgacgcatgccatgtcagagcttggtgccttgatgcccagtgccttaagcacagcggttgccctatgaaggcccattgaggcatcaagttccaagcctgcttgggcttacatcgggcatcgagaccattcatcagagcagattgcgcgaatgaagacgcattgaagaccgggttatcgaacttcaagcatcagtggtcggtatggccacgagttggacctgnggcaatatcaaccgcgtgagtcaaacgacggcttcttcagaatcccaaagttgagcccggcaggggctctccatgctggaaaccggggaaggacaggaagattcccgaaggaccatgttggagatttcaaagcttatcgtgggcaatgttgatcagaggaacggcggtgttcaaaacatgaaagctgaccggtcatcgacaccccaggcttttggagacccaaatcaacaattgaaaactgcttgggagcccattgaggaagtacaatcaattgaagcaggtaccgagaaagttccctgaaaggagggaggtcaaccatcggccaggaacgaacgggattcccttgaaccactcgtgtcccactggctggccttttacttcaatctgtacccacagggacacttccttgaggacctccttggattcttggcggttcattgaagcaccttcggcaaggttgtgaaccattatcc

SEQ ID NO: 572376 - DNA, 112 bp, Homo sapiens
agtactcgggccgggatcgagacctggttctagacctacggtgccttttgctgccttcaattaattttatttttctcccatttatttcctttccagaaagttaaacaataag

SEQ ID NO: 572377 - DNA, 1328 bp, Homo sapiens
actagttctagatcgcgagcggccgccctttttttattttttttgggcttgaaccaggatttaaaaatctgggaacggtgaaggtagacagacagtcggtgggagcagagcatccccacaaagttcaaccaggtggccgaggacttgcgatgtgcccattgcggtggtcatactactactagatcataccaacatatgaaaagtgcattgtgatctacaggaagttccctgacacatccataaaagcacaccccacattctctcataaggagaaagtggcccagtccgtctcccaagttcacacaccagggggaaggggtggaacttacacccaattggcgtataccgggtgatcaactgtcatagtgctaacagtgccacaaactcttactaacacactcatgtaccgccataaacaatacctttttacaacaccttctggcataaacagctagcgggaacgtgagtagacccacattacgggaccccccacatatctaccaccacatatattgatgagccccgcacccacagagctcgcaaacagcggtcgtcaacagcggctctatgggaacatccacgggcaaaacggaggctgagaaggacaagccaacgggagcaataacaccagtgcaacacaacccaagaacatcgaacaacaacacggagcggaaaacaacccagagggagcaaccgacctgataacacaaacagtgcaaacacaaaaaaaaacaaaaagaaaaacaaacaagagggacaacaccgacgcacaacacaagagactacaccacccaccacaagaggagcgacaccaaaaagaaaatccagccagactgacacccaccgcaagaaggcgggacaaccacacgggacgggaccacacatacaagagacgacaaacacgagcccccatcaaccagcagcgagaccaaatacacccggacacaaagacacccaccacaacactaaaaacccgacctcggaccaacacaaaaggccaagacccacatccgcaacaacacaagagggacagcaacacacaccacaacaacacaacacagccgcggcaggagagcagaaacccaaaaagatgagccaggacacacaacagccaccgaaaagacacaaaaacaacacccgcacaacagcaagaaaacacagaaacaacacaacacgaaacgaggcaacaaacacggcggagcaaaaccacaacagaagcaaacacggaggcagcggcacgacagaacacaagcaagagccacaaagggaagaacacagcagagagaaacaaacaccatcaaacccagagcgcgcaacacaaagaacca

SEQ ID NO: 572378 - DNA, 256 bp, Homo sapiens
acagccatatactcagcatgagccacgaatatcagggacgagacagatgtcaatgtacagcatccccatcaggtcgtgaaaagctgctgctattggagtcaaatatgaaggtctccataatgttcttttggccactctggtccagaagcatcagggtcaccctctgcctgaatggccactgcaacagtgagtcgacctctcctcgcatgaccacaaagtataaggacaggtgtgactcgtggaaatgtccacggat

SEQ ID NO: 572379 - DNA, 1075 bp, Homo sapiens
gcggcctccgtgtcctcgtggggactcgcaccgcctgcgctactagactccgacttgttacagatccccctgtagacatcggccatgcaggacggtgtcagctgacgagggacttgaagcgtgtggcgtacaggtgggtcaagtgagggactcgtggagaacagccgggatcactaatattagcgacagaatcgtatatcctgaatgaccgaattctacgaaagcatcgcgtgcggccagctcgcgtgtccataatggtgtgagttctttacactgcacatgggtgcgtagaattgcggtcgactgatggtcgtcatttcatagctatctgacgctggaccgtgtgggtgctgctgtatcgaacattaccccgtacctctacagtcgatggcttccatgatgctcaaggtctcggctgcaggtacatattgagactccattgaaggccctcccgagactgacgaaggggtgatctcaggcccaccggatccaagaacagtgaaagcatgagggacagaagtaagggcctcctcgtggcatcctgcctggcacaaagtgcagcaggccggaggaggtgactcgtacaaacgtagtcatgcagtccttaacgacgaggaatgcgtagggcccttgggctgagatgcaccctcctggatgaataaagcctgtggtttgatggaaacattcacaaagtgaggcattatcacgtggaaatgagacaaggatccgagcggtgatggcctcttggcttcacagttggcgggccagtgcttccatatgtgagagaatccagtaagaagacatccaggctcaggcagccactccgagcaccgccgggggtctgtccctgtccacagagggtaagtcgggtgtctgcaatgggtcaagctctgcggcgccaactggctgagagaggtgccgctgagcacaaacgacaagagcccaagacgacgggtttataaacgcatgtactaaatgcgcattgattccggtcacccaggggtcaggggtgagttttaaccctcgacatcacttagaggggtcagcagtgagagaaaatctaccgaacagttca

SEQ ID NO: 572380 - DNA, 262 bp, Homo sapiens
tgaaatcagcttctgttggtttgcggttgtgtttggctttgtgtgaggccaaggcaggcggttcacgaggtcaggagattgagaccatcctatctaacacgctgaaaccccgtgtctactaaaaatacaaaaaaattagtcaggcgtgatggcaggcacctgtagttccaggtactcgggaggctgttgcattagaatggcgtgaacccggcaggtggagtgtgcatttagccgaaattcctgcactgaacttcagtctggg

SEQ ID NO: 572381 - DNA, 532 bp, Homo sapiens
gggaggattgcttgagcctgggaggtaaaggctgcagttagccatgattgtgccactgcactccagcctgagtgacagagggagaccccgtctcaaaaaacaaaacaaaacaaaagaaaaaaaccttaaatggaatactaacatatgaagcagattaagcctttttgcatatttataaattacaattataattatgataggcttataaatataaaactaggtacatagtcttaaaattgtctatcaaacatttattgattatgagctttgtgtcaaacattatgctaagtactagagttgcagtggtgaacaaattagcccctgcctatggtgaacaaattagcccctgcctatggtgaacaaattagcccctgcctatatagaactatcctcctttcttgttttgtcataaaagaggtatctctcctatcttaggccaatacctgtgcttttatcttaatgcttcccatttcagaagcctgaaaactattaattacccctttcctttcttgtgtaagaatcaacattttcc

SEQ ID NO: 572382 - DNA, 1175 bp, Homo sapiens
  misc_feature (873)..(873): n is a, c, g, or t
  misc_feature (1008)..(1008): n is a, c, g, or t
ggccaacatggtgaaaccccatctctactaaaaatacgaaagagagaatacaaagaattacctggggtgtagtggcgggcgccctgataatccgtagcatactcgcgagaggctgaggccagagaactgtcttgaacccgggtaggcggagggtgcagtgcagctgagctgacattagccagcatctgcattccagcctgggcgatcagatgcgagactccgtctctataaaaaattagaacaataaatatttccacagatcgcagcccaccagaatataggggggagtctggcattgatcgcaggatgtcaaaactgtcctgcgacgaaaggattattgcatgcctgcacaaagtggtcctggtcacgttggctaccaaatggctcgggagctccatatccacatgtattgacctattgtttattttactgcacgccctccattagaaagaggacccttccaggggaccgagacgaactcacttttggtcgccacgaggcaaggaaacctgatgggggcagagagcatacgcatggggagcatgtatgaacgccgcatgtacgagggggctcatgccgacacccgagaaaggcggatagcgccgcgcttgaagccacaaaaggactgtttcgcgtagtccttgcagaaatgcctccactgcatctaggagcggtctctaccccagcgaccgctgaccacctataggggggcgacacaaaggcaattccccgtgaggaggtgggggccaacgggaaaataccgctaggcgatatgccagcgcgaatatgaatagacggcgctcccacaggtgtgaggaagcgcggacccagaattggcccatgagagcctaaggggccgtggcatgcacatangggcggggcgatattgtcgtatatcacctcggtggtcagcttggtaaagaccatttctgtcttgtctgccggcaacagacacgcccttgtgtaccctttctccattggcggtacccggagtaaaaaacccgcgcnagccgatgatactagtttcccactccagggaaggtgtacgtccaaggtggtgcccatatggacacagccgctatataacccaatgggtgtgcagaaccggatatcgtgcccacagttttatctcccttacatatactaggagtcccttccccccgcggtacggatct

SEQ ID NO: 572383 - DNA, 202 bp, Homo sapiens
ttgggaaagagcacatgacttgggggctcaggtatgatgtgtgggccacagacacggaccaggtggaggcaacacagtcctcaggcttctgtctctgcctctgcctcctctcgcctgtgtgacctcatgtcacgcgagtgcttccagaccatgttgcaacaactggagtcctacgaacgcatccgggggctgtatcactcct

SEQ ID NO: 572384 - DNA, 220 bp, Homo sapiens
cgggagcccacgagtgaaggttggcaaagctgccctgacccgcgacccaaagccccgatctgcctccccaaaagcctcgtgaccccgaggcgcgtcccacctctgggcctggcgcctagaatatttaggccaggtaagaggaagggctaaattggggaaggggccggggtcgctgccctcaccagtcctggtggtccaggcaccaacccatggcgcccaa

SEQ ID NO: 572385 - DNA, 1048 bp, Homo sapiens
  misc_feature (7)..(7): n is a, c, g, or t
  misc_feature (72)..(72): n is a, c, g, or t
tctgggntcagggatgtccccgctcctgtgtcgcccctggcacctgctcgggggcgcccctaactggactgngctaacaggaggagcctgaacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaaggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtctttttttaaaaaaaaaaagtttaaataaaatgtctcagagcatctctaa

SEQ ID NO: 572386 - DNA, 476 bp, Homo sapiens
  misc_feature (8)..(8): n is a, c, g, or t
  misc_feature (16)..(16): n is a, c, g, or t
  misc_feature (91)..(91): n is a, c, g, or t
  misc_feature (100)..(100): n is a, c, g, or t
  misc_feature (330)..(330): n is a, c, g, or t
  misc_feature (376)..(376): n is a, c, g, or t
  misc_feature (460)..(460): n is a, c, g, or t
ttccccgngagaccancttacataaattaagaatgaatacatttacaggcgttaatgcataccgcttccaactcaaagcaagggacagccnggggtgttntggccaaagacatcagctaagaaaggaaactgggtcctacggcttggactttccaaccctgacagacccgcaagacaaaacaactggttcttgccagcctctagagaaatcccagaacactcagccctgacacgttaataccctgcacagatcagaggctgctggccacacagactcaccaagccacagacttgtcttccgcaagcacgttcttaccttagccacgaagngaccaagccacacgtactaaaggttgaactcaaagatatgtacagngtattaaacaaataccaaggggaacagttaacttcaatacaaggtcaaaatcagcaacaagttctacaatccagtgctgatatnagatacaagcttcaag

SEQ ID NO: 572387 - DNA, 224 bp, Homo sapiens
cacgaggactgatccaacccggtgaagattttttttccggggaggttaggcttacttccgaattcgacaagatatccaccccctccagtacgggagttccaaggcacttgttttccagcatatcagcctaacctcagtgccttgaaagatggctttaagcctttgacaactgagatttcccgaaaccacaggcccttgccccagggggttctccagatccgggt

SEQ ID NO: 572388 - DNA, 318 bp, Homo sapiens
  misc_feature (6)..(6): n is a, c, g, or t
  misc_feature (63)..(63): n is a, c, g, or t
cctttngtcctgcctgaaggtccaggagcaaatggccaactgccccaagtttgtccccgtggngcccacatcacagcctatccccagcaacatccccaacagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtctttttttaaaaaaaaaaagtttaaataaaatgtctcagagcatctctaa

SEQ ID NO: 572389 - DNA, 785 bp, Homo sapiens
  misc_feature (7)..(7): n is a, c, g, or t
  misc_feature (72)..(72): n is a, c, g, or t
tctgggntcagggatgtccccgctcctgtgtcgcccctggcacctgctcgggggcgcccctaactggactgngctaacaggaggagcctgaacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaaggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaagggcaccccagtggtggcagagcttgggggcctgggcaggggcccgcttggcgggccgggcaacacgtcaacattcttttctgttcttggcattaattattgctgtctttttttaaaaaaaaaaagtttaaataaaatgtctcagagcatctctaa

SEQ ID NO: 572390 - DNA, 878 bp, Homo sapiens
tgggtaaaaatgggggtctcgctatgtgggccaggctggtctcaaattccgggcctcaacgatcgtcctgtctcggcctcccaaagtgccgggatgacagggcttgagccaccgcgctcgggccccttcttttggaatggggcctccttgcgttcccgtttcaatgccccgtgctacttttttggggagccccaaggctgtactggtttggattggactcctttttttctcccctttcttttaaacctaaatttaaagcgtgccacgtgcaaagccccgccatgtggaaaacacgccgctggggtgatatcgaagcaaaaaacggagggtggtgtgcggggtccccacccagggtgggtgtgttacgggccttctcgagcgagttcacattccgtgggtgggtgggtgacccagtttggggaaagaatgggcacccgtggttctcccgtggaagcccagcagcgtgtggccagttgacgtcagcaagccgtggtgctcaccacaaaagtccttcgtggggcaggatgagcctctcatccagtgtcttggcaaagaaaccgggtagcgttgggtgtctcaaaaagcggtggaaacagagcagtcctcctcgccggtggccgggaaaggacaaaagcttggaggggctaaaggcgctagagggaggtaacccgggtgtgccaggtgtggtgacctggaggcagccgccccgagctgctcagcaggacacgtgaacacccaaaaacccactcagggactcaagtctacacctccctccccggtggaggggaggaccttggggcacaagccctgggagccggaaacaaagactcgggtctcaggcaaactctaacgccggtaaccaagatcatctgggcaga

SEQ ID NO: 572391 - DNA, 1208 bp, Homo sapiens
gctgggcactgttgccctggcgactgctccggcgctgggtcccgatggcccggcccctccccgggagtgacggtgggcttcgagtcacgtgaccctgtgccctacgggagggtggtgcggtcgtgggacccggcatggagtgctgtgctgagaagagaggacctgtgggtggctgttctgcgtggctcccagcccgggaccccacccccgcttgtgacagtgggggaaactgagtgcctgagctgggcctgtgcctggccacctctgtcccctgtccctctgcaggcccacacatggaccatgaaggttgcttctcctcacacgggcctgggctggccctgttcttcggcctattacttcggggatgacaaccttcgacccaggcctccagcggagctgcgagtgctgctgacacgggggccaaacgctggtgtacgcgtgacggacgcttggcctatccactacgcgcggtcttgggctcacaaccatggcttgctcactgacccacgactgagagctctccttgcaaaaaggcggggctgggacatacctcgttgctgaaaccacattcgggcggacagcaccgggaccggaaacgagaagccccgaaggcgcccaggacaactcggcatggactcaattgcaagggtacacgtttgtcggacactacgctcgcaactggaccgtccgcacggggagcgcttgcaccagcccttgacggagcacgcaacggcgctccctgggtggcatggaggtccccatccccttacttcacgaacaccactaccaacaaataccagctacatccaaaatccccatacctaccgagacgtggacaacacttctgccacccttgccacccgccttcacatacagacacccctcacacacacgcacccctagcacgctttccacagcacacgctcgaaacaccgcgatgcgaccgacatcccagccaccatcgatcaccgctatacaagcgacacacataccccgaccgaacttgcaacagcgaccttcaccgcacgcggccgcgcaagccagaggaaaaaagctgtcgaaagctacacgcaagcgcggacttatagggcgagggccaccatgggagcgccagaacggctaggacacgatgtcaccattgcaatacctcacagacgactgcacggagatacgagggcggacgaaggctacataacaagcacgctgcg

SEQ ID NO: 572392 - DNA, 156 bp, Homo sapiens
tttttttcccgttcccctaccagcccccccggttccttagaattagggggtttcggggtgggaatgggcctttaggcctggcccccctccctcccccctggtggtggggttgttttatggtttgggtggggggataaaaataatttccctttggga

SEQ ID NO: 572393 - DNA, 224 bp, Homo sapiens
gcgtggtgtgccccatctgctcggcaatgccctggggggaccccagctacaagagcgccaacttcctgcagcaccccagtggtggcagagcttgggggcctgggcaggggcccgcttggcgggccgggcaacacgtcaacattcttttctgttcttggcattaattattgctgtctttttttaaaaaaaaaaagtttaaataaaatgtctcagagcatctctaa

SEQ ID NO: 572394 - DNA, 304 bp, Homo sapiens
  misc_feature (1)..(1): n is a, c, g, or t
  misc_feature (108)..(108): n is a, c, g, or t
  misc_feature (163)..(163): n is a, c, g, or t
nacgccacgagcaaggagctcttataccactgtctcttcctctgtgattgggggggctccatgcctctagctgggatgatgatgtccagacctgggaggagcccaggnctacccacctctaaacatcagagggcaggaagcaagaaacagtcataggactgcnctggagggtgctggggtcacctgccctcaggctgcagctgcctctgtcctggcacctccccttcccagaggctggtgactgcctcccagccattattggatgggtcacaggttaccgtctctttcagctcaccaagcttca

SEQ ID NO: 572395 - DNA, 102 bp, Homo sapiens
gcacgctacatgaggaggctccctgcagaatcacgacagctgaaggctgcgtatgaggcccgaatggcgcggctagaccccagccagacctgagcaagccag

SEQ ID NO: 572396 - DNA, 242 bp, Homo sapiens
atttttggagaaaaaaaacccgtttatttcatcttgccttttgggtttgagttatttttaaaattttcccgtaaaaattttgtaatattttacttgtaatgaaatgggtccccatgtcctttcctaataccaggccggatatgtgggaagaatatgtcccattatttgattaaaattttttccccctgccctaaactttcagtgatttgtgggaaaaataaataaatgttttcccccccgga

SEQ ID NO: 572397 - DNA, 800 bp, Homo sapiens
  misc_feature (175)..(175): n is a, c, g, or t
ggattctgaggctctttgcaatggctgtagaaaacggacagatgctgtaccctatggataaaggtaacctcaaggaagatcagtcgcgactattagaaggtagttgccaagtccacttggttcgcccatagtatttccagtacgactggtggtgttggcgcagtaaacttgcggntgaaccgaatcactggtacttgaacttcgtgaagggcacagtagagattgagaatctgtatctattacggaatgcctaaaacacatgaacagactaatacgatactgtgagtcgatgcgcacccaagtcatatgcaaggagacagccaaacgctactgggcatggtaccaaaactgcttttcgtgtgcaaaaccccttttctattaaccaattagtaccctagagattaatctcgcccaagagtaaaataagagatcaatctcgaaaattcatgcgaggctggaacccaacccgttgaagtcagcggagtaaaattctaacctaggattggccctccaaaggccatctgtggtcccgtcaattgaaagggaagttccgctgaatgaccgtattgctacgagcgcacacacgaggcatgacacgaggatcctaattcccaataaaaggggagatgacaacaaaactcggtcgacaccgacccttgggctttcattccacctccatattgcctaaataacgaagaacggtctgtgaacccaagtctttgccctcccgtagggccaaattgggaagccgtgaacccttgtgaaatcactccaccaaggggaagtgacactcgaagcct

SEQ ID NO: 572398 - DNA, 163 bp, Homo sapiens
ttgcgaacaatatagagtgctgaacgggtacattctacggggataatgatgttattattatcaatggttttatacgcatcatcgtattttcaaaaaatcgatcctcttttttatcagatagataggcattaaatatatgtggtgccatatcccaaaactctct

SEQ ID NO: 572399 - DNA, 165 bp, Homo sapiens
actagtgtcatatttacgaagctcaaagaaaagatgtagagtaacatccttcagggcacacctgttacatgaatcaccacctttctagcacaggggtatcaggatcttgtgcaaaaatcaccaccggagacattaggatccctgaaaacaactgcctcactcact

SEQ ID NO: 572400 - DNA, 155 bp, Homo sapiens
cctcgcattgcttccttttttttttttaaaaaattaatattattttttttaaattggcaacataatataatattactagtagaaacccgacagcttcgccagccgcaaataattatttcattgggccaatattattcttcctaaatatttatctt

SEQ ID NO: 572401 - DNA, 979 bp, Homo sapiens
gaggaaggcgttcgcgctggttcagagatgatgctgagcactcttcttcctcatatcaatgtcctggcagcaaaactcattggagtggtcgatgaccgcaaatttcgcatgttctatgagaagcgtatggacatggaagttgttgttgacgctctggttgacgaatggaagggttatgtgcggtgcgaaatcaaggtgggtgttgacactgaccagagcaaaggttatcacccatgaacgcagagggtgtcctgtgaacgcaatggcactgtagtcaccgcctgttgaaggtgatgttaaggcgggcgactttctctggtaatggagactcaaggaggacatgtggataaattgacatcgagatacttcagttctgtggctcgcatgtgcgtggtgcaggagtctgagcgttctcaacattgcgccattagtgtatgaacggatcgacggataattcctagtgtactagagttgcattctaaggatctcgtctcgcgccggcgttgagtccctcaagaaagttgctcaagcatgtaaatctcgaaaaatatctttgttcgatcctctgctagaatgagaacatagatagtcccggccattcatcgtttgtcatagagtggagcttttttactgaagacatcgtttccgaacgcgtaggacctaaatcgctactgaacgtatgctaggtcgtgcattgttactactgctgtagtacttgggatgcaacgaaccgggaagtcccgctaattggatctgaaccaggcagcgtacgcagagcacgatcgcgacggcaggctgactgggagtatgctacaggttgtgggcgacgcacgatgactgacgcttagggccaacgcgccgggaacatgtggacgaaatcgcggatgttcgtcgtctgcgaggttttcatcctaagctgcacggtctcagagagtggattttgctccccaacgattgagggccgggacagaggaacttg

SEQ ID NO: 572402 - DNA, 115 bp, Homo sapiens
gtaggaggacgcggtggaatgggcgctcggagagcgacggtcgcttcaataagcctagtggacccattggatgaagggcccagatctttgatctaggcccaacctttagatcccc

SEQ ID NO: 572403 - DNA, 191 bp, Homo sapiens
ccctggtcttcagtagatgttgctaaggagggagttggtggggctcagggaggttaggtgaggacaggtggatctggtgtctccaagctcccaggcacccctacagctcctcttcctgctcccgccaactcctcctctcacttcgtccccagtcctctgccacaccccaaagcccacaaacctgcccagtg

SEQ ID NO: 572404 - DNA, 258 bp, Homo sapiens
  misc_feature (207)..(207): n is a, c, g, or t
acatcaaacccctccacacgctcgcccgcccgcgcgccggacgcagcaatggccgccctcgccgcctccatggccacctccacggccttcgccgccaagccgcgcctggcccgcccgccggcgcgcctctccgtctcctgctccgcgtccagcggcgacaacaacaccccctccctctccgcctccatcaagaccttctcggcggcnctggcgctctcgtccgtgctcctctcctccgccgccacctccccgccgccg

SEQ ID NO: 572405 - DNA, 1731 bp, Homo sapiens
  misc_feature (672)..(672): n is a, c, g, or t
  misc_feature (761)..(761): n is a, c, g, or t
  misc_feature (1188)..(1188): n is a, c, g, or t
  misc_feature (1344)..(1344): n is a, c, g, or t
ggtgtgctttgttgttgttcgggtgtgtgttgttgccgtttgtttattgttttgttgtctgcttgcttgtctgtttttgtttttctctctttctcttgctcttttcttctgtgtcttctttttctttgttcgtctctttctcttctgcgtttcttcgtcgctgttgttctcttggtcttctctgtgtctttgttttctgtctgttttctgccttctttgttccctatctcttctttcttcctgtcgttgtgttttctctgtgtgtctggcctttgttgtttgcgtcttgctcgctcgttctggctctgctgctcttgccgcttcctcgttcgctcgccgtttcatcgccggcgtctcgctctctcttgctcccgctctctcgtccgcgtcggtcgtctcgtgcttggttctgtctctgtcgcgtctcgtcctcttcctctcttactcgttcggtcttgtgttgtgtccgtctgtcgcgtggcggtctcgcgtctccgtcatgtctcttcgtcgcgtccgtgctctcggtgtcgctcttgttgccctcgcgtcgtcgctctgctcctctctgtgtctttggttctggttgtcgtgtgtggggggttgtttctgtttgtgcgttttgtgtgtgtgtggtttttcttgtgtgtggtggtggcgttgtttgtagtnagaggggggagcggaggggcgtcgggggggcggacgaggccgccgacggcgcgggacagcgcagagcgatcctttcgttttgtgcagtnctcgctgtggtggtagacttacttggtgtgccgctcatcgacagaggtgggggttcgtccctcgtgtggtccgcgctcgtgttctacttcccccgattggtggcggtgggaggctctgccacgaaggtgtgtccgcgccctcttcttcttgggtcgcgggcactcttctggagtctctgtgtggggcgctgggggccccccttgcggtggcggcccgactatttctttctccatccaggtggttgtcccgagagcgcgcggccgctgtggtttgtcttggggagagccccctccccgtttattctcccttgtgggggggcgcgactacaccactgttggggaaagaaagatgtggtggtccgccgcccctctgcttggggcgtggccatccaaaaggtgggccccctgtcgcgccgaagtgttggcnccgccccgctttggtgggggagcacttctcgcttcgaggacgccacactgttcgcctggtgagtggtacgcgcacgcggtgtgaacaccgcctctctaaagagaatttgggtgggagcagccacacgtggggcaccagacagtgtgcgcggccganagaaatgtggggggcgccccccgcttgaatctctgggtgctttgtgcgacgcgaaatatatctctctctgttggacgaagacgcaccaccccccctgtggggacacccccggtgtagatatgaagtgtataagaccttatatactcctctggcgcgtaatattgtctccgccgatatgacgcctgtgggggttacatcttctccctggggctcgcccgaaggcgcaccggagacgaccacttttggggggtttcctgctaagcctcttgttatacaagagtgtgtggtgggccccacaagactcccccgtcttaatgtgttctgttagagttgtgggagcctctctctctctcccacaataaaaaaaattgttggggggcctctcta

SEQ ID NO: 572406 - DNA, 211 bp, Homo sapiens
ttgttgcatgaacatgcaatacaggtatttttccagatcctgatgtcagttcttttggatatacaccaggagtgggattgctgggcatatcgtaattctatttttaatttttttggggaacctgtatactttttccataaatggttacattcatcatacattcccaacctgcagggccccagggttctaatttttccactttctcatcgaa

SEQ ID NO: 572407 - DNA, 175 bp, Homo sapiens
gcgagcgaacggaccaggccagtgctgaatttcactagcagaacctttggaaagaggtgccatagcgggtgacagcccgtatgcgaaagtgagaattcaggacttgagtagggcgggcacgtgtaatcctgtctgaacatagggggacaccctctaagcctaaatactcgtatgc

SEQ ID NO: 572408 - DNA, 1205 bp, Homo sapiens
agaaaaatatatatcaatgttttccaataaaatacagtgactacctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaagaaaaagagagagagaggcgggggggggaagtatattagtttccgggggagggatagcaggaaggcgccagtgtgagaaggaagaggggagcggagagggatcgagagaggaggcggtcagcataacatatgatagacagagcaaaaagagagaggagagagcgaaataaaatatcagacacagagcagagaagagaggcaggagagagcaagacaagaggcggaagaaaacggcaaaacaggagaagaaaaaacacaaccaaatactggggtagtcgggtagtggagaggcgggcgacagcggtgtgaggagcgaacgataatcaccacgagaatagaatataataacaaaataagagtaggcgctatccttccctttatttcgacgacgagcagcagagcggtggaggtgccgggccaccacacagagaagtcacgataagtagggccggaaggatgagaacgcacgatcaaagaggggccgaaaaaaaaacagatagaaaaaacaattaagaagaagaaggagaagataataaattcgacaagaagacgggacacagagagaagaagacgagacaagggacaaagaagaagaccgagaaaacaaagggggcgagagaggcagagggaggcaaaagggaggcaacaagaagggccggaaaagacggaagaagaagggggaggaaggggaaaagacaaaggaagccaagaaagaggcgcggacggagagcacgagggaaagacacacagacaagggcagagaagagagaagcgaagaagaggagggagagagaggacaagaggggaaggaagcagggaaaaagaggacagaaaaggaaaagcaggagcgagaacagagaaaaacacaggacaaaaaaatagaagagaagaaagcacgacaaaaagagaagaaatagaacgcaaaaagcaaagaaggcaggaaaagcaaataggaacaaaaggcgaaaggcggaagacagggacaaacagagggggaggaacagagcaaaacagaaggtacagaaagaaagcag

SEQ ID NO: 572409 - DNA, 592 bp, Homo sapiens
cccttggggcctaagtttaggaaggcgggcctgaaatccacgagacagaaatgtctccaagccttccaaccggatattaagtcctccactttggaaggagggcaaccgttgggcccaaaacctggtggaggttatggccctctaagcgaggagttcagcaaaggtgatcttgtttccaccaaccatggcgtcttcccaagtactgtaaaaagtccttcttctgtgtaggaagttcctccaagtattctggcggcagtttatcaaagcgagggctgtagcagactctggccagttgattggagacgtacatagtctggttctctaaaatgtccgctcgaatcttcacgtattgtgtctcgccacacgtgatgtgcttgcgggcaatgtagcccaggatggcgatgctgtgggtgatgttgtcatcattcagccactggtttctgtcatagtcaggagcgtcccccgtcgaatacttcttttcctcgtagcatgagtctgtgtattccaggagcaggtgcatggcgtaggccaggctgtgtatgtcccagtaccccagtgtcatgtacatgatgctggttggtgtcgattgagc

SEQ ID NO: 572410 - DNA, 1073 bp, Homo sapiens
  misc_feature (339)..(339): n is a, c, g, or t
  misc_feature (413)..(413): n is a, c, g, or t
  misc_feature (434)..(434): n is a, c, g, or t
  misc_feature (610)..(610): n is a, c, g, or t
  misc_feature (617)..(617): n is a, c, g, or t
  misc_feature (651)..(651): n is a, c, g, or t
  misc_feature (690)..(690): n is a, c, g, or t
  misc_feature (699)..(699): n is a, c, g, or t
  misc_feature (709)..(709): n is a, c, g, or t
  misc_feature (713)..(714): n is a, c, g, or t
  misc_feature (731)..(732): n is a, c, g, or t
  misc_feature (735)..(735): n is a, c, g, or t
  misc_feature (745)..(745): n is a, c, g, or t
  misc_feature (773)..(773): n is a, c, g, or t
  misc_feature (779)..(779): n is a, c, g, or t
  misc_feature (830)..(830): n is a, c, g, or t
cgcgcaggaccgctgaggcgggagccccgaatgcggttctcgcttgctgcgtggcggtaaaggaccgcagtgtcgtaaaagggccgcagtggcagcgccctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggcngcgagaacctggcctccctggagcgcgagcgcgcccgggcgcactggcgggcccgcaggaagctgctggagatncagagcctgcttgacgccatnaagagtgaggtggaggcagaggagcggggcgcccgggccccagcaccccgcccgcgtgacggaggctgaggagcgggtggctcggctgtgcgccgaagcagagaggaaggctgcggaggcggcgcggatgggcaggcggatcgtggatgctgcaccagcggatcgccggctgcgangtgctgnctgagccggcgaggccgcgcgggtctggagcggnacgcgggcggggagtgtcccgcgtggaaggcgctgggtnagcagggangggagcgcanagcnngtgccacgttctccgcnnganttggtttcanttcttttggccaactgacgaactgtgtncacctnataaggagtcgtggtgcttggacaggctcaaaccaagagagcctttcgttngtctcccctgtttttctgcctgcgttttctccacatttaggcactcaattttccaggtaacaatcctggcgagaattacacttcagcacttagatgggccacgggtatttcgacatacatagggcgccttcggttggacaacaaaaggcttcactaatgtccccggaaacgaacaatgggcgacaaagacagtaccgcggacgagacaagggcgggaccaagatattcaaagagcgaatacac

SEQ ID NO: 572411 - DNA, 1884 bp, Homo sapiens
  misc_feature (339)..(339): n is a, c, g, or t
cgcgcaggaccgctgaggcgggagccccgaatgcggttctcgcttgctgcgtggcggtaaaggaccgcagtgtcgtaaaagggccgcagtggcagcgccctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggcngcgagaacctggcctccctggagcgcgagcgcgccctgtgtgctgcagctgcgctgtgcgccctgccatgtgaacgcttcgccttgtgacgactccacgatgccttgctctgactgcccatcacagatgtgacgtgtgcgacggccagcaggatgctggcgcgcgccctgtgtgctcctcatgccagccctctgctccgctgttgctgggcacgtgctagacgcgacgcggcggcttggcctcgcgcctttgctgccgccctgacaggcctcgcatgcacggcaccaggccttgccgtgcacgggctgggctcgccgcgcatttgtgtgccagggctgcgcacttcggctgggcaccgccctggccacccctagtcccggggcacttcgcccatgtgccctggcggcaaggttgccctgcccttgtcacgcccctcgggcgggagcggccccggcgtgcccggcggcgtccgtggggcacgcccgcgcagtgcccgcgcgcccgtcgcgccacccttgcttccgcggcccgggcttgggcccacgcggcccgcccctgtgcggctctcgcgcgcccggttcggtccgtgtgccggcaagtccgtggcacgtgcaggccccctggttgtctccaacgggcaccattctttccccgccccgtctggcagtgctactgccggcttctctccagactctgtgccgtttcctctctcctccgcttcgtgcggcctccactctctacgcgcactgcacccgtcgtagttcacacctactcggggaccctaccattggccctcggcaccacggggacacacaaacggcagggcttaccacgtttcgacgcccacaacctattggtgagcaacaccgagtatcctttaccacccacggcgtgcaacccgggcctactggccaccccccatgccgcttggggtcgcattccccacaccttaaccgggctctgtcgcgccccgcggccaagaacagcacacgcgacttgtcgacaccacgccgcgccagcgggggtacacagtttgcgctctgcgcaccacacaccgcggttcggctacgacaacactggctacttggtcaacaagcgcacggcacattttgtgcaagtgcaggctcagtctggtcgctgaagctggaacacccgtcctctccagccttgccaccagctcgcttccgcgaccacacgccccaacttattgtgtatgacacacacacaacaccgactggctgctaatgagtaggggcctaattgtggctctcattggtcaccataccccacgaaggacattattgtacagcacaaccaactctctcgaccagcctccaacacagacaataactctgatacgctcggaatatgagcatctaaacttttccactcccccacccctatctcgcctcatcaccccatgcgaccccactgtgacgcacacagtgtggatttagcaccacgtcaacacagagcactaatatcctagctcgttcataagtcaaacagagccatctcacgccacccacgcagagacactcatgt

SEQ ID NO: 572412 - DNA, 108 bp, Homo sapiens
tactaggggttcatcgaatggtggtgaatgaggtcagatggtggacggtctgtctatcacgatcatctccatggttcttggaggtcggcaaatgctatggcctcctgg

SEQ ID NO: 572413 - DNA, 1010 bp, Homo sapiens
  misc_feature (339)..(339): n is a, c, g, or t
  misc_feature (413)..(413): n is a, c, g, or t
  misc_feature (434)..(434): n is a, c, g, or t
  misc_feature (610)..(610): n is a, c, g, or t
  misc_feature (617)..(617): n is a, c, g, or t
  misc_feature (651)..(651): n is a, c, g, or t
  misc_feature (710)..(710): n is a, c, g, or t
  misc_feature (716)..(716): n is a, c, g, or t
  misc_feature (767)..(767): n is a, c, g, or t
cgcgcaggaccgctgaggcgggagccccgaatgcggttctcgcttgctgcgtggcggtaaaggaccgcagtgtcgtaaaagggccgcagtggcagcgccctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggcngcgagaacctggcctccctggagcgcgagcgcgcccgggcgcactggcgggcccgcaggaagctgctggagatncagagcctgcttgacgccatnaagagtgaggtggaggcagaggagcggggcgcccgggccccagcaccccgcccgcgtgacggaggctgaggagcgggtggctcggctgtgcgccgaagcagagaggaaggctgcggaggcggcgcggatgggcaggcggatcgtggatgctgcaccagcggatcgccggctgcgangtgctgnctgagccggcgaggccgcgcgggtctggagcggnacgcgggcggggagtgtcccgcgtggaaggcgctgggtggccaactgacgaactgtgtncacctnataaggagtcgtggtgcttggacaggctcaaaccaagagagcctttcgttngtctcccctgtttttctgcctgcgttttctccacatttaggcactcaattttccaggtaacaatcctggcgagaattacacttcagcacttagatgggccacgggtatttcgacatacatagggcgccttcggttggacaacaaaaggcttcactaatgtccccggaaacgaacaatgggcgacaaagacagtaccgcggacgagacaagggcgggaccaagatattcaaagagcgaatacac

SEQ ID NO: 572414 - DNA, 169 bp, Homo sapiens
gaagatggcggacattcagactgagcgtccctaccaaaagcagccgaccatctttcaaaccaagaagagggtcctcctggagaaacttgcacgagagctccgcggtacttcaagacatcggtcttggcttaagcaaccaagagcatttaggacctcattgcagaatccc

SEQ ID NO: 572415 - DNA, 229 bp, Homo sapiens
  misc_feature (210)..(210): n is a, c, g, or t
  misc_feature (213)..(213): n is a, c, g, or t
ttgaacacaggcttcagaccctacatgtgaggcttctcctgtggaaaataaaccaagcagcatatgccttcacagagtttttattcacatcagtattcttgctttgagttttcactggagagaccatcgcagctttgactgactgatatgctgactaacttggttgtgtcttcagcacaatacgttagtatactattaaggggacctagntcntaggcaccacagcaag

SEQ ID NO: 572416 - DNA, 182 bp, Homo sapiens
  misc_feature (5)..(5): n is a, c, g, or t
cgtangaagctcagtgggaagctgtatctggtggactggcaggagtgagaaggtcagcaagactggagcagagggagccgtgctggacgaggcaaagaatatcaacaagtcactgtcagcttttgggcgtacagggggaagggtacccggagctccggaattccggtaaatcattgggtcca

SEQ ID NO: 572417 - DNA, 543 bp, Homo sapiens
  misc_feature (339)..(339): n is a, c, g, or t
  misc_feature (413)..(413): n is a, c, g, or t
  misc_feature (434)..(434): n is a, c, g, or t
cgcgcaggaccgctgaggcgggagccccgaatgcggttctcgcttgctgcgtggcggtaaaggaccgcagtgtcgtaaaagggccgcagtggcagcgccctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggcngcgagaacctggcctccctggagcgcgagcgcgcccgggcgcactggcgggcccgcaggaagctgctggagatncagagcctgcttgacgccatnaagagtgaggtggaggcagaggagcggggcgcccgtgctctaatacctacggccgcgtgcctgaggctgaggatgatctaggctcgactgtgccccgaaagaggggctc

SEQ ID NO: 572418 - DNA, 173 bp, Homo sapiens
acacagggtttgcgttttaggcccgcggggactccttttggtttgcggaaagagggtagtagaagctggcgttttgacaaggatggtggcgcaggggggggcgggagaggggcgggcccgggcggttggccaaagctgcggggggaacggtgcggggagggagggggaggggg

SEQ ID NO: 572419 - DNA, 132 bp, Homo sapiens
gtcactggctcattcagagacaaacagcttctccgttcctcctctcagagtggctcaggcccttcctcaccagactctgtcctgagacctcggcggtacccccaggttccagatgagaaggacttaatgact

SEQ ID NO: 572420 - DNA, 230 bp, Homo sapiens
tttggggcctgaactgcctttgcttccccccctgaggggcccctcccttttacccaagattttggattgttgcagggcacccccctcccccatggcattgttcagcaaatatttttcccttcccggcccccctgtgccccctttttggtcccaacgccagccctttatccttcctccctcagcagccaggcagacataacaacaaaactattaaaaggagcttccctgca

SEQ ID NO: 572421 - DNA, 837 bp, Homo sapiens
  misc_feature (340)..(340): n is a, c, g, or t
  misc_feature (695)..(695): n is a, c, g, or t
tctgagcagctgggaaacagtacagaatatcaggcattagattctcataaggagtacacaacctagatccctcgcatgcacacttcacaacagttgtgcttctatgagaataatgctgctgctgatctgacaggacatggagctcaggtggtcatgcaagcgatgggaggggctagaaatacagatgaagtttcccttcactcgcctgctgctcacctccagctctgtggccctgtggttggagaccgctgctcaagtgcatttgaaaggaaccatcccacgccattcttcagagtcatctttactgctgcagtggtcaacttgtagcacccctaagctngcaggacatatgcttcaactggcatttcacaatcaacagtatgtggcagcttgagtcattgtgagctcacttcctggaaatcaccagcatcccatatcccattgcaaggagctcagcactgctccttggataaccaaacctattcccaaatcccatctgtgtgcgtctatctcctggtacccttcctagcatcaattctgtatttgtaggagtccaatcaggagacacaaaccactcaaaagtttaaactagaatgagcaagatggctcacacctgtaatcccagaactctgggaggccaaggtgggtggactgctttgagctcaggagtttgagaacagtctgggaaacatggngacctcgtctctacaaaaaacacaaaaatcagctgggtgtggtggcacttacctgtaatcccagctactcgggaggctgaggcaggagaattgcttgagcctggcaaatggaggctgcagtgagcagaggttgtgccactgt

SEQ ID NO: 572422 - DNA, 877 bp, Homo sapiens
tagggaggaggctggcgccaatcggacaggggcctgctgttatctacaagcagagcgggctgctccgctcccaggctccgcctctgctgctgaagtactgctgcgcactggcactgccaacggcttccagatggtcaccagcggtgtacatgagcaaggcccgtgagtgactggctgattgccagcgtgaggtggcggtgacgtgtgctgtgcggtattgaccttcccaccatcgtcatcgtggcccactacgacgcctttgagtggcccctgtctgtcgctgggcgcggactccaacgggacggctgtctctgtgctgctggagctggcacgcctcttctccctggctctacacctacaagcggcacgcacgccgctacaacctcctgttctttgcgtctggaggaggcaagtttaactaccaggaaccaagcgctggctggaaggacaacctggaccacacagactccagcctgcttcaggacaatgtggcctcgtgctgtgcctgacaccgtgggcccgtggcagcagcctgcacctgcacgtgtccaaggccgctcgggagtggcaccctgcagcacgctttctgcgggaactgagacggtggccggcgcaccagtttcccctaaggtaccggttctccattggtgcacacacgccggatctacctgcgggggagtcctggcctgtgagcacagcgttcgagccaatccgccgaatgccggccttaggctgtccagccttgagagccacgtggacggcagccgcaggagcatccatgacgtcgcgcccgggtgatctaagaccctgacccgtaacaggaggattattggaaggcctcactcgagtattacaacctgacagagagggaacccga

SEQ ID NO: 572423 - DNA, 854 bp, Homo sapiens
gcgaggggaggcccaggaagggggcggcgagtcgtgcgaggctgcccttctcactcagcattatggatccaagcctgttgagagacagggagctgttcaaaaaagagctctttctactcctgtagttagacaaaacgtcagcatctcctgagtcatcatcatcatcgtcaacagacagaggaaaacaacaggtagaccatggaggatcgtcgagggctctaaacaaaaattctgatcatagcaatggatcatttacccttgaacagctttgtcaggaagctcgtggattaataacaggtctgggtgtcctggctaaccgattggtggacattcaccatgactgaccagcgccatcagcgaggagataacgcatcctctaaccttcagattgccacatttcgtggattgaaacacaaacatttaggattatgggactcaccgcagacacccaatggttaatgactggagggcttttagtccaacaaatcccaaaatttgaacgtacactaggatgggaagttatgctttcaaggccagttacaaccggtgggacgataaggaagggcctaactttaagcgctcttagattcaagaattgaccaagcgacggcatcagggaagcgaattcttcttaagaagaaccttagaagaaagcattggcccaatttcccaagaaagctggcgcacggcttttgggggacccgatactaatttgtacactcgtcccgataaggaagaaaatactttccttccatgctcagcagcggccgttctgtcgcttgaacacctcacaactgcgggcgggtccgggattccctggccggcactcgacaattgacggccaggattccagg

SEQ ID NO: 572424 - DNA, 516 bp, Homo sapiens
ccctctctctgtcgcccacacacactctttcccacacgcggggtccccccgccggcttatatggttatagtggcgcccccccccgcgccccgctcggcgagagtgtgtctgtcgaccccacgctctcctccctctctgagaggacactcctcgtctctctgcgcaccagaacactcccccacttgttgtcccccctcctggggggaggccccccttcgctaggccagcgcttgcttcccagggctggttgtggcccggctcctcgtcttgtcggggtataccatgtggggcgccccacgcactgcccctgtttgtgtttttttttcgcccctcccgtctgtcccccgccacagtctgttctatgggagggtctctcacttggagagacctctcgcgtgtgttacatctctctccgcgggggtgtggcccacccagcgtgatgccccccgcgggtgtttttggctgctccccaaatagaaagccgccctcttggccccaccaccaatagaacaaaac

SEQ ID NO: 572425 - DNA, 265 bp, Homo sapiens
gtgaatttaaaggtaaagttcttgaagggaaattaaaactactactccagtaaacatgtgaattataagaagtaaaacaaccttattgctgataattgagaaagtttcagtggtctggatagaatatcaaaccagccacaacgttccttatgccaagcctacccagagcaggccttgctctcttcagttgtattaagctgagagagttaggagctgcagagaaagttggcagtacaaggtggttgcttattaggttaggaaatgc

SEQ ID NO: 572426 - DNA, 458 bp, Homo sapiens
  misc_feature (298)..(298): n is a, c, g, or t
  misc_feature (433)..(433): n is a, c, g, or t
  misc_feature (439)..(439): n is a, c, g, or t
acagttcggatcttagtccacttagtctatcttagtcagcttgggctgctataacaaataccatacactgggtggcttacacaacagaaacttacttctattaaaggttggaagttcgagatcaggatgccagcattgttgggctctggtgaagtctctctccctggcttgccaatggccacattctcaccctctcactcatgtgtcatcacttgatgccgagagagagcaagcaagctctctggtgtctcttcttataagggtactctaatcacagcatgagggccctaccctcatngacctcatccaaatctaaattgccttcccaaatcctcatatctgaaatgacatgcacattgggaagttaagggctttcaacatatggaatgtgtgggggaagggacataatttcagtccctgaaaagaagtgtcntatttnccaagggacagtatatttc

SEQ ID NO: 572427 - DNA, 117 bp, Homo sapiens
tcagctcggtcctagaggtttgaactactgacagtcttaaaggtgaataaaaactgttcatactttttatggtgtaaatttcccttgctcgatgtcagtgattcagataactcttga

SEQ ID NO: 572428 - DNA, 667 bp, Homo sapiens
  misc_feature (534)..(534): n is a, c, g, or t
actgaagaatatgtattgaataaaaataatattataatctatcctgaactgaataaaaagtacagcacagtatttttagttatttacaaaactgcgtacagtgtaacttgcgcattgagatcaccattctataaatatggccacataccaagatgtgaacatattcctgacttatataacaaaaggctcacgttggctgccacaaactttgaatgaaaattcacgggaacattgctttgggaacatgaacaaaatgcaccacattccatgaaaaaacgatttaataaaatacctcaaacagcacttttctacttgtttaggagtacactcttgccaaagtagcacaaacaattcatagcatgctttgaaatgcggacacaatgtgaaatgaaggccgctactttgatgatatcacttacctttaccttacttagctagagagcatttctttccatgatagaaaggatgggtgatagaaaatgacctatcctaatacatccaattgttttaagattctgctaaaacacaaaagcntgtgaatttgtaacctgacacactttattaacactgggcagaagaggcattgtacaaaggtattccctgggtaaagggactatctagaatgtcttaagattaagcacaaaatcagcttcaaatagatttaagg

SEQ ID NO: 572429 - DNA, 541 bp, Homo sapiens
  misc_feature (32)..(32): n is a, c, g, or t
  misc_feature (115)..(115): n is a, c, g, or t
cttaaatccgaatggctaacctaaaagcaaangccgcttgctcccgaaggcctgcgctcggaaccggcttccaccccacaagccgcctccgcggcacctccgccccaccaacttnatttcctctgggccgggttctcacctcccaggagtccccgcgctgagagcccggatgtgagcccaagtggccatgcgcacaagccagcgccgctgccattggtcgctggtgaggaacagattgatgacacatccgaaaaataggaagtggccactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcatttctta

SEQ ID NO: 572430 - DNA, 221 bp, Homo sapiens
gacgagtgtgctgtatccaggagttcatctcacatgcaaagacacgtgctctaaataaaggaatggaggaagatttaccaagcaaatggaaagcaaaaaaaaaaaaggcggggagtggcaacccaggttctctgataaaaacagaatttataacccaggcgaaagtatcaaaaagagacaagaaaggggcttaccatataaggggaataaaggggatctca

SEQ ID NO: 572431 - DNA, 122 bp, Homo sapiens
ttgctacgcgcaccatggctggagcgcccacggtctcgcttcctgaacgggctgacttggtgaattgggcaactccttatagtgttgtgcacacaaaagcatcaaataaagaacatttaatc

SEQ ID NO: 572432 - DNA, 141 bp, Homo sapiens
ctgtatagctagggtcagtgctcaagccatgttgctacagggtgaagctctaatagtggatctgactggcaagctgaagacagatgtcctgtgcgtgttcttcactgacaggctgtaggagtgctgaggactgagcagtct

SEQ ID NO: 572433 - DNA, 1440 bp, Homo sapiens
gagatacctcagcgctacctggcgtgaactggatatctctcccgcctgccgggccatgtcctgccaacagtccgtgactccgccacatcctggtagcctcaatggcttgcaaacctgtgtagattagctaacgatattttagcgaacttacttcagtgcagatgtactagcatcggaggactcacacctctggcctctgttcccacctgcgtgccgacctttggggccgatggacttggtgactgatccctcgatggcaaccccccagatagtcattagcgaggggtacagatgatagggccatgcttggattcgtgtgtggaaacaagcactcatgcttcatcggctccgaaaggacgcacgtggatatctcggacctggcgatcatggatatccataagttgagatagaattgacacagaaggtatcctagcggcgacaagcggccccattctgcacattgcgttctagcgattgatgacctacttgggagtggggtaagcaccatccacttactagtcggatcttgttgcccactaatagaccgagaggcctagctgctcttgtgatctttattgtgtgcactcgattgggggagaacccgagatcttcccatttgcaccatggcttgaccattaaacgcatccagactttccacaaggaccgtcatttcgtgagaagtcgagtgcttccaatgcctagcggcattcgcagttgccgaaagcgatggcctcggcctatgactatgggagtttgggcattctcggccctttcgctaggctgaaatgtggccccattagggaacttcgcaaaggagggctcacttttgtggacccccactgtggggtcgagaggttccccaccctgttatggtgcgccgccttgtggacagacctgtgcacatgaggacctcagactggggggtctcaatcggtgcaaagttggaccttaatggcggttcacatttataacttcaaacacgccacgaagggggtccgtccatgggtatggacatccaaaggaaagaatagtcccgcccgtccttccacctccatattggtgtgcaggacgcatccaatatgaccggttgtgctgacaaagagcccagggaggactgggtccacatcatgtgggtgggccattacaatccaagatattagcccaaccccctaacgtgcgcgttacacgtacacgtgaccacgtggcagggtcaaaagttgatacccggttgtgaaaccagtgtttgagctccccaagtaggacgctcggcacagctcctactctcgcccaccaacttcgcaatgcgctatggcataactgtgaccatgtcccagcgaacatgggtgtaaatactctagaggacacagggttgaaagtcgtgaattaacgacgacgtgaccggggcgcacagcacaacactacgaaccatgctacgagagc

SEQ ID NO: 572434 - DNA, 1283 bp, Homo sapiens
  misc_feature (374)..(374): n is a, c, g, or t
  misc_feature (420)..(420): n is a, c, g, or t
  misc_feature (454)..(454): n is a, c, g, or t
  misc_feature (1042)..(1042): n is a, c, g, or t
gggcccataccactaccaaagggggcgtacgccaaaggcccccgctatatgttgggacccctggcaccccccccccccttggcgaatatttggggcacgccgttgccccgccgctgtgatcgatgatcgccgcccctagttggaatttttggggttggggtgcttattattagatgtgccgtcgccccctcacgcgcgtctcgccaagccactgtcgccgacagggtgtctccgcgttgtgcaaagccaacagtggtgccagatagccacttgcgcgacgggggggggccccccccgcgccacgaggtgccacaggatgggagccccccttgggggggcgttcttttgttggccccgcccccacaggagaggcnttgtgagccacaggccgcccatagcccgcgtcccaccagaaagcgngtgtcacgccacaccacaatagggcgacacaatngggggcgcgcacaagttcctccccacaggccgaagtttttctctttgtttgggagatagtttatatagttgagacccccacactctgtgtgggggcgcccacggagctctggggcccccggggcgcgctctctctctggtttggttgttggcacatctgggggttttgtccctctgcgcgcccgtttccatcatgtgtgcgtctttgcgttgtctttacacacagtgcgcccctctgggggcgtccacgcgccttatgaccacagtctcggtcttgtgcccactacccacagcgagagagtattgtgtgcgcccccctctgtgtgagctctctgtcacaccacagacacagtgtgccctctggtgtgcgctctccccctgctgcccctctcacagggggtaagacacacacagggagcctctctggattatattttttaagctcttgtgttgttttatagaaagcctctcttttggggggttataaaaaaagaggtgtttcttacactatattttgggaacttttttaaatataggcactcttccttcttttaataatgaaagaaattcccacatcccacttgggccnccttttataaccccacgagaatgtgaacctccctccctcccacagttatacccccacggccctgccctttgcacgggttgggggtggttacagcggtaaccccggggttaggcactcctatgacacgcacgcctgaggaaggctgggagaatttgggccacatgtaagctgcctttgttaactctaatttattttagtcacttgtattaaacccccaataaagccatagaggccaactcca

SEQ ID NO: 572435 - DNA, 167 bp, Homo sapiens
ccccctcagagatgtctcattcaattcatgcatgagtctggctcccagataatgacaggaatttctcttctgaacattgctggaacccaccttgagtgcctgccagaaagcagggccctcaaaaaatctgtcaatacatttctacgacttctgctggaagggagcag

SEQ ID NO: 572436 - DNA, 369 bp, Homo sapiens
  misc_feature (56)..(56): n is a, c, g, or t
  misc_feature (75)..(75): n is a, c, g, or t
  misc_feature (99)..(99): n is a, c, g, or t
  misc_feature (152)..(152): n is a, c, g, or t
catcgcagtacagccagaaagagagaacactaaaggacagagcaggctgccctcantcggtaaatccatccatcntgctcacacaagccatcccgaggnaacgcgtgggccatgagattgcagcgatcctgagggaagaaggaatgacgcanaacagtatatggtgctgatttagtgcatggagggggacacagagagacagggggggaggggaaggaggaggaagacagagagacagagacaaagatagacagagaaacagagaagacagtcacagagagccagtgacaaaggagagacagagacaaagagaggagagacagagacacacacacagagtgacacacaaagagaccaaaaggtcgacgc

SEQ ID NO: 572437 - DNA, 130 bp, Homo sapiens
cggcctctggttcctcctcttccagtgatcaagctcagcaaattcctgctgccatgtaccatctacatccaaggagcatccatctgaaggcggaccggcaggagccacaggcagccgactgtggatcaca

SEQ ID NO: 572438 - DNA, 548 bp, Homo sapiens
tatggaatgtttggcgggggccggttcgctccaccacctattatctagtcctccgccggaccatttatccaaccccataattaaggaccccccctctgtttgtggcttcttggttactgcctggtgattgtttgttgtggatgaagaggtggaggggtgtcatcttcttcagcccagtgaggcgtctctctgtgtatgagaccacagttgatttatcactttactgtacatttaggcgagagagagagttggttgttgaggagttctcttctcccttcatctgcattaggcccagttgttggttgttggtcttggttgttcactgccacctcctccttcggcttcatccccttctgcggtaccgaagatgagccgtcttctctaatatagaaacaaccccatcacattattactctccacgagggtctcctcccgcggggaggcaaaaaaccgcccatgcctgagtgttggtcccagacacaacaatacatagatataaatagaaagacaatagagaacaaaacagacaaaacaatgaacaagacaaa

SEQ ID NO: 572439 - DNA, 220 bp, Homo sapiens
atgaagcctatgatgtgcagaggcagggtaaggcgcgggtgctacccactacgagaaggtgcaggcctggtcatattacagatgctgtgcacagagcgtggcgactcgcgactggctcagcactctggagccccggaatgtgcgggccgacatgaagcgggtggtggaggataccaacggcactcgacgtgcagggtggggctccatgtacgaagcaggg

SEQ ID NO: 572440 - DNA, 231 bp, Homo sapiens
  misc_feature (27)..(27): n is a, c, g, or t
  misc_feature (69)..(69): n is a, c, g, or t
  misc_feature (142)..(142): n is a, c, g, or t
  misc_feature (182)..(182): n is a, c, g, or t
  misc_feature (223)..(223): n is a, c, g, or t
tcaagctgtgtcggcaaaagccctcanaccgactgagtctgccctgtataaagaagatgaagtgcccanacccctcacccctcactttttaagtttctaaatgtattccacataaacttttatttccccagaactcaaacanccacaaagctcagaatttattttacagttttattcaaggnaaaaggtgatgtttttgtactgtggggaggagggggctggntcatattt

SEQ ID NO: 572441 - DNA, 175 bp, Homo sapiens
ctgtagttccggctacttgggggactgaggtgggaggattgcttgagccggaggtggaagttgcagtgagctgatatcacgccaccgcactccatcctaggtaacagagcaagacccagtctcaaaataaataaataaaataaacgcaggtactgaatgagccgggtaccgagct

SEQ ID NO: 572442 - DNA, 331 bp, Homo sapiens
gctgccgctactactacggggggcgcggcccgtcgacaaaacaatcaatcctgtgttggtatgttggctcacgcctataatcccagcactttgggaggctgaggtgggaagatcacgaggtcaagagatggagaccatcctggccaacatggtgaaaccttatctctactaaaaatacaaaaattagccaggtgtgatggcacgcacctatagtcccagctactcaggaggctgaggcaggagaatcgctagaaccctggaggtggaggttgcagtgagccaagatcgtgccactgcactccagcctggcgacagagtaagactccatgtc

SEQ ID NO: 572443 - DNA, 391 bp, Homo sapiens
  misc_feature (60)..(60): n is a, c, g, or t
  misc_feature (305)..(305): n is a, c, g, or t
  misc_feature (308)..(308): n is a, c, g, or t
  misc_feature (344)..(344): n is a, c, g, or t
gttttattttaattttaaccaccaatggtctttcccaaagtcccaatttccatggttgcntccaaaaggaacgtgatttcaattcttttatggctgagtagtattccaacgtgtaaatatatcactttttaaaatccaattcatctgttgatgaacacttaggttgattctctatatttgtgaatattgtgaatagtgcttcacttcaaaatagcttagaagtgaggacttgaaaagttcccaacacatagaaatgataaatgctcatggtaacggatatcctaaatacctcaacttgataattntanattctctgcatgtaacaaagtaccacatgtaccccnataaatttgtttaaatattatgtatctgtacaaacagttacaaaatt

SEQ ID NO: 572444 - DNA, 327 bp, Homo sapiens
tgacaggtctgtacagctgcgtactgtgtcgatcctctacaggttgatctggaggtgatgtgaatttgtccctgaccgacgatgtagaacgtcatgatcgtggacgatccctggggactcgtcggtctctggagtgtttcggatgcggcccacgaacagctcacgcacttccttccagcagatatggctgcctgtctcatgcagtagtagtcaccgtaatccgtcactggatgccctggtggaggaggaagtccccatgcatggcatgcccccaattggcttctaccacgtccagaaaatcgcagtggcggtgaccaagtccttcat

SEQ ID NO: 572445 - DNA, 1174 bp, Homo sapiens
  misc_feature (726)..(726): n is a, c, g, or t
ccccgatgcaggtgcagcttgctgggaggatcgaccgacagacggacgcacgcctgaggcactgcgccccgcagcccggcgcgggtgccaccgcagcccggaccccgtgtctgccagtccgagccgcccctcgcccggtgcctaggtgcccggccccacaccgccagctgctcggcgcccgggtccgcatgcgctccgtcgtctgtcctggctcttctgctctgcgcccgggcaagtcaactggcggcttcccttgtgcaccaggcccttattgacttaaagggggattaccggagggtgatgaaattgcattcggttgagggctcatcttccgatcagcagcgttttccaaggtcccatgcccacatgttgccttgttcgagccaagggaattgtttatctgaagaagcgacttcgcgagagtgcagtcacttgacctcggggagttcccgtttgtcgcaggtctcgatggaggtagcgagttccaggacacaatgtgctacccgtggcacacgcgtagtcttcaccaaaaggaagcgcattcgtgccttacttacgccagactgggggcccggtcccgaaagcgtgggaacagtaccgacggggtccaatctaagttcgagggccgactgcagcagctggacgacaatgcaagccgcacggactggtggcttctgttcgggaacacggcaacgttgaaaaagccgttcgttccacgcacagcgnggtttccgttctgccacgtaaagagtccccaaggggtaatgtgcctaacgtgtcgccaatgtgggggcacccccagggtgcagtgggcccgcttggtcgcccagagtcagtacgtgcaacgggggtgggccctaagttggtgtataatgtgatgtgtgacagtatatgtggaaaagtgtgccctctcacatgcttatagtctcagatagttttttgccgtccctccgatatagactatggtgggtggtacacactgtttttggtgagtcttttgttactacgttttgggggtgggcaaatcggggtgcaaactcaatgcagtagtggtggctaaagtgtgtcaaaatgtgtgggggaaacatttatttccacgacctaatataaataatgggggtggtaacaactagtcgttggggtcaccccatgctctggtgtcgcaattgtgtta

SEQ ID NO: 572446 - DNA, 166 bp, Homo sapiens
agcgggttgctgtgaccggcgggggactccggtggtgtgcggcagctgtgggtgggggggcatcgggccgcggtgccaccatggcggtgcgactgtgcagctgagaccgacggccttgcaactgggatcagaggcgcttgctagctgtggctttcacccgggcaga

SEQ ID NO: 572447 - DNA, 1534 bp, Homo sapiens
tatctgcgttccctcctttatagtatagaccgcgtgtctttaaaggttcactcgagctctctggggtgtcgcaaatatcgtgcccatacgaagggtctacattaccaggatcactttttgtgagaggtaatatttgtgagattccacttgggcgtctttgcgggaatttgtctgtagaaagacacgcaccacccatggggtggcggttaaactagttgtttgccgcgtcccatgcgatattttcgtggcactctttttctccgccgcggtatgttgtttagccggttggccgagacacacccaagctaggttttctcaatttgggaagagggttcctaacattgggatgtggtggcccacacagagttttccaaataaatgtcccccgaaaagagggttgggcgaaaaaaatttgggccgcgcgacacacaagacatcggttgggggggagacgtggcgcagagtagattgtgttgctgtcccgcacgtgcgcagacggttgtgcgaaaaacacccacataatactgtggggggggtacacactccccaaaaaaagtttggtacctttgggcccacaaacgcagtgatgggggagaaaagaggcccacatgttggtaggtgtataactcccctatagaggagctcacagtctgttatagaatcctctctttttaggagcgcgctattctcacgggatttaccctctccttctggagagttccacggggcgcccccaaaaaccctggagagagagagttgcgtgttcttcatattttggtgcgacagaaaaagagaataggtgtggtttgaggagtaaacatggtgggggcggatatatttttctcgggcaagagcctcttttttttgtcgctatgtgcccaatagggcgcatactctcttaaaaggagtgagaagagagaggacaccttctcagagtttgtccagaagggtgtctcgtgtggtgtttttttctccagacgcacagccagcgctgttgtgacacacagctctcatttaatagagaggacacatctggagagtctcccttctctctccctgttctttgtgtgtctcccaaggcgcgcttttgtgtgccccccgcgctcatggcgcaaattattgggagatggcgttcttcttaagacgcatacttgtcgtggggcacacaagatctcaataggtggcgcacaccagtaggagcgtttcatggggcgccagaaagaagaagccacataagatctcctgttagcgatcttctctctctcccagttcacacaccccttcattggcccagatttgttaggcccacaccaagaaagagttctcttttacacccccatagccaagaaccacatttataggagagacacaccatttacaagaataggctggaccctgggagaggataggagatgggataccctgaaaaggtgtccccaactgttgaattgggaaagaaataagccacctagataaaccctattgtgtgctgcatggaaagggacctgaaaaccattgccctttaagccatgga

SEQ ID NO: 572448 - DNA, 366 bp, Homo sapiens
  misc_feature (85)..(85): n is a, c, g, or t
  misc_feature (124)..(124): n is a, c, g, or t
  misc_feature (154)..(154): n is a, c, g, or t
  misc_feature (321)..(321): n is a, c, g, or t
  misc_feature (340)..(340): n is a, c, g, or t
  misc_feature (360)..(360): n is a, c, g, or t
ttaaaaacgtttgcacacccccctctcttttttaaatataagcttgaaaataaaactaaagtcctttcaggtaataaaaccaaanaaaaactttgtgttgttggtcctcccccccccccctttnggaggtcaagtctagctcacctgccctagnattcttccaccaaaaagagttttagagtgggaagaagaggcttttccttctgcattagtataaagagtctgtatttttaataaatgttaaataagctaacaatgtttgtacttatgcattccccatgggtaaaaataaataatagcattgttaaagatagttattcncaaaaaaagagagttattncaaataaatatgtctctttnttttta

SEQ ID NO: 572449 - DNA, 758 bp, Homo sapiens
  misc_feature (1)..(1): n is a, c, g, or t
  misc_feature (273)..(273): n is a, c, g, or t
  misc_feature (282)..(282): n is a, c, g, or t
  misc_feature (304)..(304): n is a, c, g, or t
  misc_feature (432)..(432): n is a, c, g, or t
  misc_feature (460)..(460): n is a, c, g, or t
  misc_feature (476)..(476): n is a, c, g, or t
  misc_feature (530)..(530): n is a, c, g, or t
  misc_feature (533)..(533): n is a, c, g, or t
  misc_feature (537)..(537): n is a, c, g, or t
  misc_feature (559)..(560): n is a, c, g, or t
  misc_feature (566)..(566): n is a, c, g, or t
  misc_feature (677)..(677): n is a, c, g, or t
  misc_feature (689)..(689): n is a, c, g, or t
  misc_feature (753)..(753): n is a, c, g, or t
nagcacagtcctatactactccattgaaaaaatgataaaaaataactaaaaaatcaattcaatatttatcagtatcaaataaaactactatcacctttcctgaaatacaaagaaacaacagatgtatctatacctatttaaagtttaattcagaatcttgcgtcttaaagcagatgattattagttagcttgacaacagtttaaaactgatggtcccagttaaatctgtacaactgtatgagaaaatgaaaagcttgagttatcagtgtacgngagattttnaactactttatctctgtcaganattccaaactaaaccccctccaaagtctgttttcctcttacctttcagaaccatttcatgcgaaatctaaccagttttgctcgttattttccttttttaggggatggggggccggcgtgcgtttggcnaaagatttagttgttggttatttaacgntgcccaacatgggtcncattgcgaaagtaaaacccccaagtgtgacaatggaaacccaaacatttgtgcnggnggtntacggggtattcgtttccctgnngtatgnagacattttgtttctttttcaaatacttaaatattttatgaaatctggcaatgatcttaagactgttgacatacttccactgggaaatcatccatttcacttatttttaanagtttcattttntaccagagttaaatgtaaactaatgaaatatttattgatattttcataatgaagactctaaacnttttc

SEQ ID NO: 572450 - DNA, 250 bp, Homo sapiens
tctctcatgccacggtggtggcacatcagctggctgtggccagctaagtccttaaggttgaagatgaaagttaatgcagactcattatcctggtgtcacagtgcatatttttttttcgcttggcacaatatagaacgtgcagttcattcaatgaaatcctgaggcttggataaagtcaacaaactgaaatggatgcttcgtaccatctactgatgcggaagatctgaggtcctagttgtgaatcatgaaa

SEQ ID NO: 572451 - DNA, 541 bp, Homo sapiens
cttcatatttcagtgtgtctgcatagagggccgagctccgtatgtcagcgtgtctgcatagaggcctgtgggtgtcttcatatttcagtgtgtctgcatagagggctgagctccgtatgtcagcgtgtctgcatagaggctgtgtgtgtccccttaatctttgttactctagttttcagatattgtctggaactggagaagccccacattttatgatggataaataaataaaggttaaacgcagggctgcggagctccattgccttcctcgtaattctgcgagactctgcgatatacttttcagggagcatcacattagctgtcacacactgagtgtcaaccaaagccacgcaaggtggcctaaaattaacgagctcgttgtggaggagcctccactaacgaagtcaacaaatgcaaactggtttggtaaccttctgtaaagaaaagatccatcattggttaatacttattgtatagattatggcaaaatttaaaaaataaacagtccttcccggaattttaaaaaaaaaaaagaataaaa

SEQ ID NO: 572452 - DNA, 340 bp, Homo sapiens
cactatataagatctatgacgtcgcatgcactcgtacttaagcttggatcctctatagcggacggcctaagttcattgggcttattactcttgtgccctcaaaatggtccgctctctattcaacgtctacacagggctgtaccattcgcccaattgcatcggctgactctaggggcagataactgagggattatggtgactaaattgtacactaaacgcaaactctgtacacaatcttactctctagcttcagctttctacaaacctttataaagatagtgaatgttatatctaaaactctagcaactagcaatagtcgaatacctaaggacatgctatc

SEQ ID NO: 572453 - DNA, 312 bp, Homo sapiens
tcaaatacccggaccgctctccagctgaccagaggtcccgcgggtcaggaagcaggcacggatgcgggccaggtgtgggatccagccctcctgcctcagttgggtcatgatggcatcaatccaagggaagcctgtcttgccctcagcccacttggccagggcctcaggattgcggtcccaggggatctggatgcagatggggttcccctccatgcggtcaaacctggggttgttggtagctgccgtgtagaagaactctcgccataggagttgcccaaatagggagaggggaggtgtgctgttccgcttccc

SEQ ID NO: 572454 - DNA, 1056 bp, Homo sapiens
ctggctctacggctggagccagatggactggaggaggtgatcacagaatgctgtggctgggctgcctatgcttgtacgagctcagttgcccgggacattgctagatgctggtgcctggagtcactctggagcccggaggcctgggtgaacgtccgagcactgggcaccaatacgcacaggagataccagctatggggcgtgcagcctacgacgtggcgagtccacgatggctggacgcctcgagggttgcgtgcatgcctcctgtttcggttccacacgagccctaccgcgttgcaggacgcacgagcccgtcggcgtacgtgtgatttcacgagggaatctcgtggtggtacggcgagcggtagccgtgtgcctgggctgtcgtttgggcaatcgcgtttctttgtccgtggggatctggtggtcttgggggcccctgggtccctggagggttctggggtagagatggacttggtcgattatggggtctccgatcagggcgcttcttgaattccctacacatcatatgcgtcgttgaaattgcacgtagataagactccatcagtttcacttctactaatccgtttcgatgatctgccccttgcctgaaaaccctggttactgagttcttgcgaaactatgcatcgcgccagtagcgctcctatcccgcccatgccaccgaactttgagatgaacgaatagaatatccctcttctttgacccttgttggctaagataaagccgcttttgggcgggcagacccctgagataaccgcacatgtgtgttgggggcgcagaacgaggcttgcctttattctaatgcaccccagggcgtgaggcattgacgacgggaggtggcgaaaggatggattcctccacaagcactggggttcttgcgcctccaggggaatttcgagtgggacacggcggtccaatggagctcccaaactgtagaaggaccccaaggaagggctttcggagattccaactataattcttgacatgctgggttgatagaaccagggaggaccaggagatcccaatggtggacccaga

SEQ ID NO: 572455 - DNA, 1156 bp, Homo sapiens
tccgcccgcgagcacagagcctcgcctttgcctgatccgccgacccgtccacacccgccgccagctcaccatggatgatgatatctgccgcgctcgtcgtcagacaacgtgctccgtgcatgtgcaaggcctggcttctgctggtgcgactgatgcccccctgggccgtcttcccctccatctgtggtggcgccccagtgcaccagtggctgtgatgtgtcgggcatgggtcacgaaggattcctatgtgggcgaccgaggcccatgagcaagacgaggcatcctcaccctgaagtaccaccatacgagcacggcatcgtcaccaacatggagacgacatggagaaaatctggcaccacaccttctacaatgagactgcgtgtggctccctgaggagcaccccgtgctgctgaccgaggcccccctgaaccccaaggccaaccgcgagaagatgacccagaatcatgtatgagaccttcaacaccaccagccaagtacgtagctatccaggctggtgctatccctgatacgcctactggacagtaccattggcatcgtgactggcctccggttgacggaggtcacccacacctgtgccacatctacgaaagaggtactgccactacccccatgcacatccatgcgtatggacctgtgctgggccgggacacggacctggagtaccatcctgaagaatcgtcacccggagcgcggcatacaggcccaccaagcacggggcgcgcagaggcaagccgagcgtggccactaaaggagaacggcgctcaccgtcagccctgcaactccacgcaccaaaaggggcaacggtggagacccagacccccccggcaagacagcccaacccacgccggaacggacacggcaccccatggtaaaggcggacacgggccaccagcacaccaaccgcccccccacagggaaggcagcccagcgagtaccaagcaccacaacacaccatggcaggggaagggcccccgcacaccgccacccccaggagagcgcgcgcacaccgcaccggcgacgagaggacacaccacagccccgccgcacgacgcgcaccacagcgacgcacgagcgcccaacgacaacatacaaaggccgcgaccacgacagccacgcggcgacaagccacgacccg

SEQ ID NO: 572456 - DNA, 1554 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 572457 - DNA, 418 bp, Homo sapiens
  misc_feature (21)..(21): n is a, c, g, or t
  misc_feature (110)..(110): n is a, c, g, or t
  misc_feature (149)..(149): n is a, c, g, or t
  misc_feature (152)..(152): n is a, c, g, or t
  misc_feature (160)..(160): n is a, c, g, or t
accaagaacgctccaacgatnacaacagagcagaagacagttaatgagaccattcattatcaaggcgctggtaatcaaactcctgctgataacaccgctcaagtgacctntacgcgtcaagtctcaactgatacggttacaggtgaaanganctatggtnttggtcagctgatcaaagctttgggcagtgactagcccagttattaagggttatacgccagatcagctgaaattggggcacaaactgtgagtggtgacgctagtgatcttgactttacggtgatttataccaaggatgcgccaacaaacccgttaatccaagtcaaccaacgacgccagcaaacccggttcaggctggtcaagcggcggctacttattttgtggacccacagttgcctgaacctggtgaactgaggca

SEQ ID NO: 572458 - DNA, 1418 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactc

SEQ ID NO: 572459 - DNA, 869 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactc

SEQ ID NO: 572460 - DNA, 408 bp, Homo sapiens
agagaactagtctcgagtctgacagggtgaccgccatttgttcctaataggaaatcaaggataggcaagggacacccatgtttggtcttattcctgatgcaatgaaacttctagttccacagactgtgcatgctgggttctctaaccctgtgtgctgcatgagcctgatactcatctttaatcctatgtaaactgcatgcttgactactgtgggataataactgtatgcagatctagttaaatcatactcatgactatgtccttatattccactctatgcttttggtattgatgatctttacatattaaatggcctttgataatggatctctagtgtatggtcttattaagacctacttgtagtcatcccattctttatgcgctactttcatggttgatatcgatgtt

SEQ ID NO: 572461 - DNA, 808 bp, Homo sapiens
  misc_feature (9)..(9): n is a, c, g, or t
  misc_feature (11)..(11): n is a, c, g, or t
  misc_feature (223)..(223): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacccgcgacctgcngcccgagctggctgccaggcctatcgccgccgccgagaccctccggccaacagggacccgcggtggccccggccccccggtagtgtctccctgacccgagtcccgtccccgggcctcttgccttcaaccctggtctttcctcctccccgggaccttgagtccccgaggagagcgagggagaggagcgccttctgcagggttattgggcgaacctcttcaccttgtgtggttcggcgtctcctttagtgtattaacccggacttttccgactggaaaataggggtatgggaagcagcgggagtcccgtgagcgtgaacgccgggctttgcaggtcttcactcatccttccctgccaaggccctgacaccttacaggctgaccttaaacctgccttgtgtaaaaggaggtaaagagtagaaagtggcaagtacatttgggaaaagaaggcgcttgatggaagcccaggttgtggcatcgcgggtggctgcgtggccacacatgtccggctgtgagcatccctgttcgcagatgtggctgcaggcagttgctcacagggttcttccaggaactgggagccgagggaag

SEQ ID NO: 572462 - DNA, 359 bp, Homo sapiens
cacaaagcatgatgtggcgcgccatttactttgagttctactttactattcatttgtatttctatcttttatctgcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttc

SEQ ID NO: 572463 - DNA, 377 bp, Homo sapiens
gcatggggtcatcgactttgtgcccaggcagctagagcctgtgcagctcctgctgggagagaacccaatactgaccacacctgcgatgtttgacacgcttctttgtgctatgagagtggcgtgtgcgcgccaagctgtccacccatccgcgtgccctggcggatgatgctcatccaccctctgtccctgacggaactgaggctgggcagcttttgggcttgaagtcaccctgttgagaagcagctgtctgccccagtgccacctcctgtccatcttgtgcagcagctccctcttcccgtggcgcatggtgggaccaggtcattgcttgctggctgtcacctgtgccaggttccaggtggtgaagggcagggtggccc

SEQ ID NO: 572464 - DNA, 863 bp, Homo sapiens
  misc_feature (31)..(31): n is a, c, g, or t
ttttttttaattgttatattattctttaaanaaatttcacaactcactacatgttggtggcaggatttaaaggacagaaggttcaagatgtaaagaagactattcagaaaagttgattggcgctggaaatgcacttatttacatggaaccagagaaacaagtgatgtccaggtcgtcagatgtatgtgttgtagctctgtgtgaccagtggtacttggattatggagaagagaattggaaaaaacagacatctcagtgcttgaagaacctggtaacattctgtgaggagaccatgaggaatttgcgaagttcttttttgttggctacaagaacatgcttgctcaagaacttatggggggggcgctcacttgccttgagatgagctgtggataaataaaatcactttctgacttactatttacacggcatttgtcacaggtgttcacctattgtaggtgggtaactttgtttgtcacgccttcgtttcccctgggttccctacccgtccagtacgacccacaaaacaatgtattttaggagtatcagaggtggtccgtttttctaaaatttttacggagcttgttactctcctacccgcccgctcttggtcgcttccctccacaccaccatcatgttcgtgcatcctatggttctactccgctctaccctcgctccgccagtttcgtcttgacgacttgtaacccatctctctgtcctcctgtcttttttctcctggttttcttcacgatgatccgacccagtgataacacaggaatgacaacctcaccatcctctcgttgtgtatatctcccccttcttgtacatctctatatccttcaaattttaacaccgctgttgcgacg

SEQ ID NO: 572465 - DNA, 1742 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 572466 - DNA, 348 bp, Homo sapiens
tagcatcatgcaaattactggtgagcgttataaacacacatcccttgagggttgtcattcagtcctacaatacaggcatgataaccggcaggcctagagaattccttgctctaagcgccagtccggcttttggggctatgtgtatattctgagcgtttagcgcagttgagctcaggcaatctctcctctcctcggtcgctgtgtttaaacaagtaagacttagagcgcttagctttcgtactcatagataaagatctggtctgagttctgacacaaaggtcggtcttcagatctctcgttagccagactccctcacgtgactctatgaggccttctgaaaaaggtcat

SEQ ID NO: 572467 - DNA, 160 bp, Homo sapiens
ggatccggcgctaggacgccgaagggcgtaccggatgtcggtagtctgtatgacatgcagacacgccagacctgactgcgccaatacgagcagcagcagaaaaaatcgatgtgtccaagtttcccctcgccgacgcgttcacgcgttgtgcaaaggtgag

SEQ ID NO: 572468 - DNA, 268 bp, Homo sapiens
ggcacagagttgaaacctttattttagatgagagtttttttcccctccatcccaaaccttgggcggaaagcaagcgtccttgtaacttctttgggcaggctggggggattgttcagcctccttttgtggcctgcgcaaaccttaaagaattccagcttggtgcaaaaattttacttctaacaggggcccaaggcaattgtctatcatctttgcccagggattaaaatgaccgccccttcccttgaggactttgctcaagtgaaagtac

SEQ ID NO: 572469 - DNA, 2216 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 572470 - DNA, 877 bp, Homo sapiens
agtggtccgcgtgcgcgtgccccgccgcggcctagtggaaagcggcccttccaagagggcgggcaaccccccaacccggggggacccggcacgctagccccaaagtgcggtgccgcgaggagacccccagatgttgcgacgaagaactgttgcgtccgctccggaatggagacaaatggactggtgccccacgtgggcccacccccccagccccaagaaggggacaaccccgtcttccacccgccgctgtgccggtataatgccttccggggtggtgattggcccccaagggcgaaatgtgccccgccgactgtttctcacaccaaaggggccacgcccccggtggtaaaagtcagggggttccccccccctggggcaaagagtcctaccctggtaactaccagcacgctgtcagttccgcccccaagttccccccaaaaagacgggggcacccacagcgggggggccccacgacaccaggagcaacaccagaattcattgggaaaaccagtcttatggacaataggaacaatctgcaggcgccgacacagccgcagtgggtgcaccaccccgtgagaccccgccacacctcggtgaagggcaacagaggggccgaaaccaacaaatgacccagaggtaaggcacacacgctgggaaaaccaccggggtaaacgcccgccctgtctctacaaacgccgccaacattgtccccgcccgagtgtgggggtatcctaaagacccatcggactccagagacgtggtaagccatacgagcacatggtgctgaaaccacgagagggcgcaggggagccgcaagcccggtggtatggtccccaccccccccaccggggggacaagggggcctgcccacaaaaca

SEQ ID NO: 572471 - DNA, 140 bp, Homo sapiens
cacgaggaggagagaaaaaagctgttatggaacagttccgccacttgccaatgcctttccactggaagcaggaataactcaagtttaagacaggcttgcggaggatgcagcaccgagtaggggagatccaccttctccga

SEQ ID NO: 572472 - DNA, 1802 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 572473 - DNA, 96 bp, Homo sapiens
  misc_feature (53)..(53): n is a, c, g, or t
gttagggatattataagtagagtccagaatcctaatagtccagtgtctacatnatcttcatttttcaaattctcagcatgcaactctttaacgatc

SEQ ID NO: 572474 - DNA, 1982 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 572475 - DNA, 392 bp, Homo sapiens
ttttagtcatggatattgactttaagcaccactaatctgtattttgggggagtttacatctacctccttaggtacctattagtaccaagcataataggaaaaaataggctggcatggtggctcatgcctatagtcccaacactttgagaggctgaggcgggcagatcccttgagcccaagaagttcgagaccagcctcagcaacatggtcaaaccctgtctttagcaaaaaaatacaaaaattatctgggcttggtggtgcatgcctgtggtcccagctgctcgggaggctgaggtgggagaatcgcttgggcctaggaggttgaggctgcagtgagctgtaatcagtgccactgcacttcagcctgggcagcagagtgagacgctgtctca

SEQ ID NO: 572476 - DNA, 2141 bp, Homo sapiens
  misc_feature (9)..(9): n is a, c, g, or t
  misc_feature (11)..(11): n is a, c, g, or t
gaccacgancnctcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttgaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaaaaaaaaggaa

SEQ ID NO: 572477 - DNA, 445 bp, Homo sapiens
  misc_feature (223)..(223): n is a, c, g, or t
cgtagccgttaacacatacaacgcttaagaccgcctgccgtccacatgaacctccgacacattactattgaacgcgaccgacctgggttttgaaaaaggcaagagaaataaacgaaaaacaaggaaagcgccacagccaaaacaaaaaacaaaaaacaaaaaaaaaaggcgcgggtgaaagaggtaccgagctgaactgcacgggctgctaacccgacaaccnctaggacttgctacaaagagtactataaatggcgtgcttatttaaagaacggaacctgaagcccggagggtggcttaaagggtcacgaggggcgatgggggttaccaagcgtgacttgcttaaactggcctgccaagcatgttgggcgtaggttattggcacctaaagaccgtctactgagagcgcggccttaggcacagctggttgatactatgtgcgact

SEQ ID NO: 572478 - DNA, 418 bp, Homo sapiens
acggaatgggcttttctttgtggcactgtggtagtaacaccaccaccaggctccgaatgtgagtcttcttcctgtattgctgggactcagtacagaacatattattgcatttcaaaaatactttcacaatggacatgatttaatttgaaagttcagcttaagctttcattttcatgagttaaaaaaaggaggcaaaaatgttgcaattaaagccaagccaagcatatgcactctcttgccatctagtgagcatacagggtattgcaacagtgtgtgatcttaataatatggggtatcctgttaattaaattatgtatatgggctaacaatgagttatttaatcagccatttaattatcttgaataacatttttattacagtgaaataaataccaatttaacttaataaaaaaaaaaaa

SEQ ID NO: 572479 - DNA, 491 bp, Homo sapiens
  misc_feature (463)..(463): n is a, c, g, or t
gggtagtagtgcttgcttactacaccttctgaaattcaaagcacacagggcaaaataagtgttacctttctttatatattccccccatttggaatacgtctacctttaaagtttttttaaatgggcagagcgcagtggctcaagcctgtaatcccagcactttgggaggccgaggcgggcggatcacctgaggtcagaagttcgagaccagcctgggcaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaanaaaatacatagtttttccaaaatcttga

SEQ ID NO: 572480 - DNA, 1025 bp, Homo sapiens
cggacgcgtgggtcgacccacgcgtccggggagacgaaagaaagaggctgtgcctcagaaataataacgccgcatatctacaactatctgatctttgacaaacctgagaaaaacaagcaatggggaaaggattccctatttaataaatggtgctgggaaaactggccaaccatatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagcaagacatcttatgcagccaaaaaacacatgaccacaatgctcatcatcactggccatcagagaaatgcaaatcaaaaccacaatgagataccatctcacaccagttagaatgggcgatcattcaaaagtcaggaaacaacaggtgctggaagaagatgctggcgaaattagaacccttttacactgtatggtaggactggtacactaagttagccattgttgcacacacgggtgccgatcctcacggattagaacttccaattccacttttaccacagcaattcacttaacgggggatatacccaaagggcataaaacagcggcattacaatcaccgcgcggttgttcatagggaaaattacgcagccaaactgtgaccccacagtgttcaataagagcgtagtcaaacatgccaactacacgagatatcccaaacaagattctctagaaag

SEQ ID NO: 572481 - DNA, 861 bp, Homo sapiens
ctcccgggtttttggggtggcgtgtcctggtcgcccatctttccccgccaacggcatgtctgttgtccatagtttctgtgtcagggtgacccgcccctgcagttggtatggggctctctggggtcccccccgtcgtggccggccctccttgttagtggtgtctcggcgcgcagccgcattttccttgcgggcgcgcgcccccatggcagttgcatcttctggtgtgacttgctctttcctttctgtattctcttgctccggtactttctgttgcaggctcgtggcgcagcccgtgtgggtgtgcccctcccgcctgttttagcgtgcgggccgacggcccatgccttttttgcgcattgctgctcatccccgtggtggtgtcaccccaccctgcttgtgttcgcaggatccccgcgcggtatcctttttggcggtcccccgcgctggtctttatccgctgttggctcgccttgctggcgtcccgcctcggtctgcgcgctctctctactcccgcaggtgttgcgctcccccctcccgcgcccctgcgtaactaacggctggttcctccccggcccgatgttgacacaccctcctttgttgtggtatctctaccacctcattcattcgcgcttatctgccatcagccgctcagaatagtttcatcgatgtccctcgcagcacgacgtgcctctcttactcacctgattcttcgtctgcggtgcggcgcctccttttactgccgccgtagaccctacgaaggggttgttccaggcggcaacagaaataatgactgatgccagttctgtccaccaggtctgcaccaaaaaagaaacatagacaaacacacacaaacaaaacaca

SEQ ID NO: 572482 - DNA, 699 bp, Homo sapiens
  misc_feature (2)..(2): n is a, c, g, or t
  misc_feature (620)..(621): n is a, c, g, or t
  misc_feature (643)..(643): n is a, c, g, or t
  misc_feature (654)..(654): n is a, c, g, or t
cntgatggagtctccttctgtctctcaggctgtagtgcagtggcacgatctcagctcactgcaacctctgcctcccgggttcaagtgattcttctgactcagcttcctgagtagcttggactacagacacttgccaccacacccagttaattttttgtatttttagtagggatggggtttcaccatgttagccaggatggtctcgatctcctgacctcgtgataaaaccaccctagcctcccaaagtgctgggtttaggcgtgagccaccccactgggtcctcattcttgtatcttaaaagtcagtgatgttgagtaatttctcatgccaccacctccaaggttgcctttcttctgccttcttctttcacttaaaaggaaggttgtgatttcattgatcccacccatttaagacaatctctctatcattgttctgcaaccttaatttcacttgaaatctaatttcacactgccgtgcaacctaacatatttgtatgttagactctgggaattaggacatgaaaatttttgggaggccattctttggcctacagcagacatagtctatttacctgcagattaaagctttctatatgtttctgactccctctcttaattttnnaaaataatattaattgcagtanagagaccgaangaaaagaaaaccaacaaaaaaaaaaaatgggcctctttggcctca

SEQ ID NO: 572483 - DNA, 427 bp, Homo sapiens
ttagtgtcactgtgtgtcaactgttggagttcaactgtagcatttgagtcatgacctactctctccctatcttcttggacacatctttttggaatggagtttctttgaactgtggggcaggggagggaggatagggagagagtaggtcatgactcaaatgctacagatgctcattgttcttaataagatttagtcgatttaaaaaaatatttcatcatctgctatatgccattataacaatttcagagactttagcttcttaaaaaaatattttttatcaattatggttgttccactgggcagagagccacagagctcctcacattgtcatttcggaagcagattctaagttcgatttcaaatacctttagtcacagcagttactatccagttgaccacctggcctactacaccctattatcttatg

SEQ ID NO: 572484 - DNA, 286 bp, Homo sapiens
tctaggatcccggtatactgagcttagagcatacagcccctgtatgggactgtgtgcttaccatcctgtgctgggggagcggggacactagggtcagtgaccccctagctctcaaggccactccgtgctcatgcagctgcatccacagttgcagagccttgaaaacaaggaccaggagcaagaagctggtggcgggcatgtagaggccgatggagacgaagcgggacagagtggggagcaggtagaggaagaacagctggtgcgggtgtccaaggtcgtcataccg

SEQ ID NO: 572485 - DNA, 449 bp, Homo sapiens
gttacactttaaaattaggattttaaatttctatctaatgttctttaccaggtatcataatttatttaaacatgttgagtcttttccattttttgctattatgaactatgaccaatgcatcccataggcaggtgtaatggagaaattttagaaggatcgactccaatcctttgtttcacaataataacctctaaaaggtgttgttcagtcaccttcagtcatagaaaccagtgtgtgaaaatggacattggatcctcctggctataaatgggctctgcagctccacccattgctctccaccataagcagaatggccaccactatggggtgggagggagattacaagcaggctctcagctgtgctctggtctgcagtccgcagggcacctcgtcacctttgttttttctcccctgatcataggatagagtcacatttcctcatttgggag

SEQ ID NO: 572486 - DNA, 136 bp, Homo sapiens
taagtgtggtacaaacgttggggagcatgtatcctctgtcaaaatggtactagtaacagattcaaggtagtaccatatcgtatcagactgatgtgggggttattatgtttgacatcagttggtcagcctgttaagg

SEQ ID NO: 572487 - DNA, 694 bp, Homo sapiens
ttggcgctgtcgatggcgcggcgttagtttggtgcacaagcgggtgtctactaccccccttggggttgctcccgcccttgctcggtgtgtagtcgtccttccccccctgcttgtggccgccgtgctgtggaggccccctcgtggttaatttttctattcgcgttttttctctttatgtacacgctgactcactcttttgttgtccgcgagcgcttctttgtgggtgccgcaccatcatgtttttatcccttttcgcacgcccccttttaaaccccctccctccctcttctagcgcgcgagtgtgtgtttcctgaattgtggcgtacaccacatgttgacggctgcctggctgctgaccaactcgtgggggggcgtgtcccttctgcctcgttgtgttttgtcgctgctcgtcattttccttgcgcgtagttgttccccacgtcctcgctcaccgattttcgctaccacccacggtggttgtttgtttcgtccactagggcgctccacgtcttttttttgggctgcttgcgcgccggcggccctctctttcctcttctttttccacacgggggggccccccctacccccttttccacccttggcaaattgaccccggttttttttccccccatttttttttttttaccccctttttcctctttgtgtacaaccaaaaattccaaggggggcttta

SEQ ID NO: 572488 - DNA, 536 bp, Homo sapiens
  misc_feature (298)..(298): n is a, c, g, or t
tagttttattcttcattctgactttctagctgtttgacttcagttagtttgaatgagagtaataggttttttttttctacatggactcagagggtaagagcattagctctcatcattgtgatgtgtgtgctctcctctcccccttggatgtcacagccattgatttctttgtgggcctcatggacttggtcttgttagtctaatgaaagccagacttcaaagagacaaggcaaccatgcagccagttcaccagtaaatgtggtaacacccacttaaaaatttgttttctcctcaaggncggtgtatgaagttgatcataaaagttctattactttatcctaaattaaattgagaaaaagatgtgttcttctaatcagacactgcattaatagggaaagattggtatagaaaagattttctttcctttttacttaatgtatatagtttaactcttttctttgttacatttaaactatgctcatgggtatcagtctgttttggactagtattaaagatggaaataaaacaatttgaac

SEQ ID NO: 572489 - DNA, 102 bp, Homo sapiens
gccgcggacacggccgtgtattactgtgcgaggagggggtacggtattttgactacttatcgcgcatctggtgacgacgatatggacgtctggggccaaggg

SEQ ID NO: 572490 - DNA, 2487 bp, Homo sapiens
ggcacgaggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggaaccctgcagagctcacagggcccaggacaccaacgccgcataggaccgcccacatgggaacgcccacatgggaccgcccacataggaccgcccacataggaccgcccacatgggaccgcccacatagaaccgcccacataggaccgcccacatgggaacgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcgggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccg

SEQ ID NO: 572491 - DNA, 168 bp, Homo sapiens
tacttatacacacgagtatccaccgaccacacctcacaaagcggataaaaggtaaaaacttataacaaagcctgaaagccaaaatgaacgaaaatctgtacgcttcattcattgcccccacaatctctaggcctacccgccgcaaaaactgagtcattctatgtgtag

SEQ ID NO: 572492 - DNA, 215 bp, Homo sapiens
tcttttgccaaagaatgcaatatcaaaaatgggacagtggttttaattaactgtttaggaggatatgtgtaaaaagttgctttttttgcaggccaagaaattatattccttattcagtcagttatgtttaatctttttcctgaatataaaatcttgttaaatgccttaggccctcttaaaaagggtccaaaaatttaaagtttcgttaaatatgt

SEQ ID NO: 572493 - DNA, 234 bp, Homo sapiens
gctagcagcgattagttatttttctatttctgaacttttacattaatggaacaaggaaggacatataaagtgtacattattttggtccacgctctcttgcatactacatatgttagtgagatttggccatactcatatctagcggtatgttcatttacattgctgtactgtgttacattttaagaatacaccagtttcgccaggcgcggtgcctcatgtcagctctcccagcag

SEQ ID NO: 572494 - DNA, 2583 bp, Homo sapiens
  misc_feature (1718)..(1718): n is a, c, g, or t
  misc_feature (1728)..(1728): n is a, c, g, or t
ggcacgaggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcagacagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggaaccctgcagagctcacagggcccaggacaccaacgccgcataggaccgcccacatgggaacgcccacatgggaccgcccacataggaccgcccacataggaccgcccacatgggaccgcccacatagaaccgcccacataggaccgcccacatgggaacgcccacatagaaccgtccacatgggaccgnccacatgggnacgcccacatagaaccgccacataggaccgcccacatgggaacgcccacatgggaccgccacatgggaacgcccacatagaaccgtccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcgggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattaactcagggtttcagctccaacctcgctgagttggtgcagctccgggtcattcctggggtgggaatcggatcatccctgactcagcttataccttaattttatttgcagaggattcttttctcaaaatgctctggcatttggacacacatcacatgtcgatatttgcataggagtcattttcagtggaataacatttttaatgtgtggttttacggttcaaggaactacatgatgattttgaggaaacacttgccagaaactaaattaacgaataaaagatttcagtgcccg

SEQ ID NO: 572495 - DNA, 826 bp, Homo sapiens
  misc_feature (513)..(513): n is a, c, g, or t
atgacccaccaattcacatgcctatcatatatctaaaacccagcccatgtaccccataacagggggcccatctcagactcctcctaatgaccgtcacgagccttatgccagtgtgatttcatcttccactcgccataatcggctcctcgattactatggcctacgtaaccaaacatgacttaaccatataccaatgatgtgcggcgatgtaatcacgagagagtgcgtcatatccaaggacgcaccatacaacagctgtctaaacaaggccttcgatacgggaataagtcctattttagttaccttcagaaatatttgtctcctctcgcaaggagttgtgtcccctggatgccttcttatcgcagcatccccatggtccggtagccctccatagactccacgcaaagttaccgaggcgtgccactggggggacaccccctagcgtggcagtacttgcccagccttcaatcgcgcaatgatgtcccaagacactaaaaagagctggcgcgcatntaaactcctgcagtgcctgggatggttttctatgcacgatagacgtcttctccaattgttgtcctagatcaatgagagtccaggtcggatagggccaacaaattaattgttcaacgtcgaacattgtctccaagtggatcaaatgtatttgcctcgcgtgccttgcaactttgaacacctcctaagtgcgaccatacacgtagatctcttgcgaagcgtttgcccgtatctaccatttgttgccgaatggcaatcctaatgtgcccacgaactttgcttgggataagcgcatctgggcttccaccggtactca

SEQ ID NO: 572496 - DNA, 1030 bp, Homo sapiens
atcaccagataccagagatgtgtatctttatgtgaataatcttgatgatggtattggatgatgaacgtctccggaaagagttcgctcccatttaggtacaatcactagctgcaaaggttatgatggagggtggtcgctataaagggttcgattctgtatgttcctcctccccagaataagtcctaactaaatcatatccagaaatgaacggtacaaacttcgtggtccgatccaaacatgtccattatgtcactgttagcttatagactcagtcgtcgagaatggacagtagcgttcctaggtctcaactcattaaatagatatgtgcagagaatggcaagtgtgctgagctgtgcccacaaatactctgataatcaagcacactataccataccagacacctacctttatgttacttcatggaagactattccacagaatcagaaccgtggctgcatattatcctcttagtccaaattgctcaactaagaccaagtcctcggtggagtggtcagggtgtcagacctcatcacattcctaaatatgcccggtgcgtatccgtcgcagtgtgctccgtagtaccaccatttagtactatgagacgagacttcttcgacaggttccacgaggtcatgtcaacaacagcgtgtggctaacacatcaacgcagactatgggtccactggttctgcagctgagccgatgagctatattcctgctgtccgcaccggtgacacagtattaaatatgctgcaggagttcgcaatcctcagtagggtcttattgcaaagtcacagttcaaagtacaggctgctgtcgtgttccggccggaacttgaatgctcatgttggcttggcctctccagagcaatgcatgttgggtgacgggggccctattaaccatgccctattgggtaaacaggcgtgtgggaggaaaaaacctctgggaggcaagccccgcgagaggaaagtttaccaccaagaggggaggaccgcggcgtaggcaagcggatccttaaaagcgcgggttat

SEQ ID NO: 572497 - DNA, 217 bp, Homo sapiens
ctcagagggcataagccaagtcgcacagtgtatttattgtgtgtctggcttcttcagtttaggagaccatgtctagaaaatgcattcatgttgttctgtgtgtcagaaattcactctttttttactgccaggccgttgccttgtatgagtcactacaattagtttatctattcatctgcagcataggcaacagcagctgtttcttgtagggggccaa

SEQ ID NO: 572498 - DNA, 438 bp, Homo sapiens
  misc_feature (98)..(98): n is a, c, g, or t
  misc_feature (346)..(346): n is a, c, g, or t
gatggaacctagctctgtcgccaggctggagtgcagtggtgcgacctcagctcactgcaacttccgcctcccaggttcaagcaattctcctgcgtcanctcctgagtagctgggactacaggcacctgccaccacacccagctaatttttgtatttttagtagagatggggtttcaccatgttggccaggatggtcttgatctcttgaccttgtgatcggcccgcctcggcctcctaaagtgctgggattacagacatgagccaccgtgcccagcctgttttgtttttgtttttgttttagttttgttttgtttgggagacagagtttcactcacttgcccagggntgggagcataaatggatggcaattttcggtttcactggcaaccttccaccttcccgggtttcaaggcaatttttcctggcctcagttttttt

SEQ ID NO: 572499 - DNA, 228 bp, Homo sapiens
  misc_feature (74)..(74): n is a, c, g, or t
ccacatagctgggactacagtcactccactatgcccagctattttttttctaaagacaggtctccctatgttgnctagggtggtctcaaacttctggggttcaagcaattctacctgcctatggccttcccaaagtgctattagattttaggcatagagccatcatgctctggcctacagataggtgtttaagtggggataacatttttaagaaagggggaaactaac

SEQ ID NO: 572500 - DNA, 1717 bp, Homo sapiens
cttgtgtgtctttggtggatgagtggtcaggtggatgctgtttgcgacgctttgactcgtcggccggtggtagcgctgctgcgtgtacgtgtgggtcgtgctcttcgtgctgtggtgagtcgtccttcgattgtgtgtcgtgcgggctcggcgcgctgtgggttgctggcatgtgtgtgctgatgtttcgatcgtatacatctatgtggtactacacgcgggtgttgggtgacccatgttgatgccgcggtggtgcccacctcggttggctccgctaacgccgcgggtcgttgtgaccgctgctcgcgtcctccgtttggtcgtcgccctgtgcttcaaggggttgcggaggtcaccttgggagtgtggtcgtacgtcttcgtagtcgcgaggggggcgcactcgaccacctcgcacgtggccgggggtggtgcaacagtcgccaccaagtgctcctgctggtttccgagttgggcgttggtccctataatagggggaggcccctcaaggtagaaaaagagttgggtgttgacccaccactgtttgttcgtaaagagaaatgaattgtgtggttatgtagaaagtgtggaaacagcaccctcgctgccctatatgtggttcccaacatatgtaaagcgagcaaagtatatttggtgggaaaaagacaccgtcgtttcgtgttcaccaccccaggggattccccccatagggagtagcgcccacaaagtttggccaactgcttgaatagcgtctcttctaccaggggtttccctggtggttgtgaaaagtggaggatgtctcttgcgtgagatttgccacggaagtagagtggagagctgttgccacatcttagagggaagagttgccacagggctggaattgagcctgagaagaatggtgctctcacgcgcgtgtaatataaccgtgccccgtgaatctataacgcgttcaccatgggccacatcgggagtttgtttgaccccgcgtgacgacacacaaagtggtgggtgtacccacagtgggctcccacaaaatgttgggcacaagacacccacatgtaggtttgagatgcactcccacacgcgtttgagaatggttcacacgagacctagttctcgacttggggtttatactgtgcgtgtctgcgtatgtgttgtctgttggttgtggtgtttgtatactatataaataaacgccgcaccacactcacgaatgatcgggagaagagcctttcttaatgggctgcacggcacacccacacacgcgtctcgcccacacatttccgcgcgaagagaagatggagatggagaaattcactgagcccgcaggagaggtggcacgaccacaatggagacttgagaaagaaggtgggtccaatataaattgagttcccacgagcagcacattggagaaaagaacactatggaataagggcgttgccacactctattgttatttccttctccactgatagttcttcgcttcagataaagattaataatgctgtaagaaagacccacagatttgaatatgggataagagcttcactggagactttcactggtgtaaggcccgctagatttctggaaaagacccctcggggaaccaaaccacggtgctataaattgtaacgagctgatggatatgagacccccccccccagaatctgttttaagttcagacttccaatagtggccaattaaaagtgctatttgtg

SEQ ID NO: 572501 - DNA, 562 bp, Homo sapiens
ggagtaaactagagcactcatgttacatagtctcccactataagggtggctcctgagcaaacgaagtctaggtgacacttgaggttgccatagaagcaataacgacagggaaagctgagtttcactttatagtttgcattccatgaaaaacaaagtcctgactcttactagcctgggctcaatgttaactgcttcacagaaccaaaggcccactgcctccataacacacagtaactgaggcctggcacattgcagatgcttgcggaccaccctcccgtttgcctgcctgctactgttgccaccatgctgaccggtggtcaactgtaccagtgtatgtgttcccaactgcatatcagcataatcatgtaagttgattacatattatataaagggataaaatgcaattgcaaaagtaaatatttaaatttatatggtgaaaactaagctgaaacctttgcaaaaacttaaagtgaattgctacaaaacagaattgtcaggctggccatggtagctcacacctgtaatcccagaacttggggaggcaaggcgggcggatcacttg

SEQ ID NO: 572502 - DNA, 966 bp, Homo sapiens
tgcaggctgtacggcccggaggttagggatgctggtttgatgtcccatatagagaggtggcacagccaggctgtttatcccagtcccgtgtcgtgtccagcattttagtgcagactcacatgcacatcaaatgcacaaccatgcaatgacagacaagcagctccacaggaggagtgcacaaccagaggggagaggagagagcctggacagcctctgtcctcacctcctcagtggccatgtggtgacggctgggttttttatttttttctccctagatgagcttcacatctcaggtcttctgctcaactcaggtaccagctgacacccacccagtccctggtgttgccttcaggagcagtggcaagatgggagctggttggggaaggggatcctagcgcaggggggaggaggagagaatggaatggctggactttgagatgagaagacagttggatggggaggaggcaccatttgctggaactgaagggttctcagtaggggctcgaggcaggatgtatctgtgatatctggacctctggagtcccttaagcacaaggaggcaagtgtgtggcagtgaagacattctgccttgggcccaagcccaagacaggtctcccttcctgagccctgggcagaccatccgactatggtcattggaaggaccactcctccctatccaggctgtgtaaagccaggaagcacgtccctttctccatgcagggcctgaaactggggcagtcagcaccattaaagttcttcctcctctgaggctttcctgggtcaacaactttcgagggctgtgtagttggagggcagggaagcctgagcccacgaggacgtctttcctgttcagggtttgaattcgccccaacttgacggctagtgggggggccacggttgggttatactggtgactggcgaggaaaatcaccttgagggtgagtgcctcagagaaaaaaggcgccg

SEQ ID NO: 572503 - DNA, 152 bp, Homo sapiens
acagctagggggaggattgctggagcccaggaggttgaggctgcactgagccatgactgcgacactgcactcctgcctgggcaacagagtgagaccctgtcttaaaaaaaaaacagaaaacatgaccaggcatggtggctcacgtctgtcat

SEQ ID NO: 572504 - DNA, 126 bp, Homo sapiens
gtgaagtgagaactccatcagaaaaccaaagggtgctaggaggtgtgggtgccttccatactgtttgcccatttcatctggaataatattaattttcaaccccagagaaaaagttggttaaacaac

SEQ ID NO: 572505 - DNA, 564 bp, Homo sapiens
tatagtaaaagcccagaccatgacccctaacaggagccctctcagccctcctaatgacctccggctagccatgtgatttcacttccactccataacgctcctcatactaggcctactaaccaacacactaagcatataccaatgatggcgcgatgtaacacgagaaagcacataccaagggccaccactacaccacctgctccaagacaaggccttcgcatacgggataatcctatttattacctcagaagtttttttcttcgcaggattttttctgagcctttttaccaacatcccagcccttagcacccgtacgccccacaattaggaagggcacgtgtggccccaaccaggcatcaccccgcgtaacatcccctagaaagtcccacctccttaaagcacattccgctatttactcgcccattccaggcagttactcaaactccacctttgagcttcacccatcagtcttaatcagcacacaacaaccggcaaaccccacaatcaattccaagccactggctttcattcaccaatttccaactgcggtctccctcatctctc

SEQ ID NO: 572506 - DNA, 335 bp, Homo sapiens
cccgtcctacatcgtgttgttggacccagagacatgttgaaacacatgatgccagtttggtgcggtggctcacaccggtaatcccagcactttaggaggctgaggtcggtggatcacctgaggttgggagttcgagaccagcctgaccaacatggaaaaaccctgtctctgctaaaaatacaaaaaattagccaggtatagtggcacgtgcctgtaatcccagctgctcgggaggctgaggcgggagaatcgcttgaacccaggaggtggaggttgtggtgagctgagatcacaccgttgcactccagtctgggcaacaagagtgaaactctgtc

SEQ ID NO: 572507 - DNA, 131 bp, Homo sapiens
tactggtttcaggatcttggtgaggaggtacaggggttaatccttgctgagtggtcttggatgaggccgtctgcaaaccagatacgttagtccttgcatgagggtcttggtgaggcctgctgcaaaccagt

SEQ ID NO: 572508 - DNA, 1174 bp, Homo sapiens
  misc_feature (319)..(319): n is a, c, g, or t
  misc_feature (330)..(330): n is a, c, g, or t
  misc_feature (336)..(336): n is a, c, g, or t
ggtctctcgccaggcgtcctcgttggtagatgacatcgactgtattacataccctgccgatggccatattccctggatcgacataactgacctgatgcatggcccttacgagttacatgtactagggtcgaaccatggtaaggtgccatacgtacatttccctatatagtattctagtcgcaactacttgtgattgaatctatcctgaaaatgtcttcattggtcgggagctggtacggattgtgtggcttccatacgacagcattgctgcaggcatccgacaatgcttgcgcttcgctggagtgaaggacctggtggnctgtcctgacntgcggncgacgtaaacaacgcattgaacctggcgacgagggtccatctaccggagtgtgtcagccctgcgtaaaatagatcccacaggctgcctgagtagattacagctggtatgtgccttgcacatacctaccgaggtcgaagacctgttgtgggcttcttgtatggtgtgaccccaaagagaatgggaatcgccgttcatcatgtacgtacttccacggggtatcaatttgtttttgccctcagggctacaatatttagaggaggttcggctcaacgtattgacgttgtcacactgattgactttgtgttgtcgctatggtcggtcacacaccagttggctggacatgttctctattgtttggttcgatgtcacccacagaaaagcgaattagggtatcccatcggtgtggccccactgtaggagaaacggtaacacatctctatttattgttgcaccaaggcgcccttcttaaagcgtagctctaaccccaacgataaaagaaactcttttcgcaaatgtgggtgggctaacctccaaatttggaaattatattctccgcgggcaaaggtggtaaattcgctggcgtgtgtttagaatcctcatgggcatacatgggtaagcatcttataaagtgttgggaaagtcgctagttaggaaaattgtcccatcaggcctgtgctggaaaaaccaatggactttcaaagccaattcattcaccgccccccatgtaccttcccctttttggggagacatgggggttccaattcccaaggcacaagcggttgctttccggaaacaaaattttggggcaagagccattctttatcagaaaccccttgg

SEQ ID NO: 572509 - DNA, 1559 bp, Homo sapiens
  misc_feature (240)..(240): n is a, c, g, or t
  misc_feature (411)..(411): n is a, c, g, or t
ggcctcgttgcgatggatatccggaggttcattctccggcttgagaagccagacgtagatgattacaccaacgtgtcctcactatcagaggacgcatgtcttggactcctctgaagcgagacgtcgcatgctcaatagagaggattaatcgacacctggatatgttagttaccaccagggagacgtgttcctccctgaatcgtcctgcactgaaaacgaacacaaagcctggatggcttnccactcgcgcagtacggtatcgctctaatagccatgccctcatgacccgaaggtgacaaggtcgccatgatatactgaagacaggactcgtggtgcgagtgccgaagaggatcttagccttctgacagtccatccttactcaggtgcacttgagaaacagcgagagactgntcacgcagacagtgtgacacgggcagatgcaggagaggcatttttggttccagcggaaagctatgcgtcggttggtcaacaacgcaggatgttgtcccctatgagaaggctcttttccctggtaactctaagcctacttagtgggacgaattgacgtgtgccgcgcccgtgatgagcaagttgagactgtatggtgcgccagtgggagttaccgcaaacgaggtgagttgtgctcaagaaggcaagtggcataacgattcacctgtgctgaatgagaaaccaacgagaaactcattgagcggaagaacgcggaccttcgttggtcgcccgggttgagcacaggtggtgtttgccccctttgtggggcatgtttctcgttgagaggcgacaggttcatgtgtggagcacatacatgggggggaaaacgtaccagggggtctactcgcgtttggagaagcacaccagtttataattgtaactctcataaagcctaacccttccttcgaagagcgggaggaaccatcccactttgagcccctggtggatagccacactatttcacggttcggaccatacatcacagttttctacaacagagggggcgcataagaagtccgagagcaaatcgtgaaaaggaaacgaccataacttggggaaggtggcaggcgagggaaacattttttccgaaggcggcccactattaaacactctggccatgtaaccttggccgagagatgaataagttctttgctaggggttcggcgctagggcatagaaaaggtcgcaacgcaaccgttccaacattaggatggccccaccattgtggcgcacttggttagaggggttgttgtcggagccgtttgaatacggtcggtttacagccattattatgtggccatactgtgtggacacctatgcaccaagtttaagtaacacatttgcccgaggtccaattgtggctacccaagacccacgagggggtgtactaccctacgtgacagcgctccacaatagagagtccgttaatgagatactcacctcagggaaaatgtgtaatattgggtaggagtgccagaatagacccacaacacttctgcctcaccgaagtgtggccaggacgattacaacaaacgaatgaacacgtgcga

SEQ ID NO: 572510 - DNA, 388 bp, Homo sapiens
catgctgatcgtcacgatagcgatccatgtgggcatggatcgcgtacatgtgcggatgacggctccatcgcaacagcatccccaccatcgatggatagtagttcggctggaagaactccgatggaatgttctctttccatttcccgcagtcgacagcgtcatcttcgctatggtcgacatggccctggacgcggaatacacagtactccacatccgggatccaccagcgcgtgtagttcacccgatacaccaggcgctcagacacaatgacagctctctactctctctacatactaactattacacaacgaggaaaatacacccaccacattaacaacatcaaaccctcattcacacgagaaaacgccctccgttgagatcagcatgt

SEQ ID NO: 572511 - DNA, 1016 bp, Homo sapiens
agaatcaagtatggagtaaatcggtggagtcgagagatggggctcgtgacggggcgccctgcaccgtctcccaggcgcacctcccccgtgcccggcgatcgctctccggaaccgtgcaattgggcgccagggcggtaatgttagatcatatcgtacttcaggccctaaatcgagcgaagagtaccgtggggactatactgtaccggatgcccatagtctggctgaatcccgactttgaatcacgcagccttcagccaggctctagatcgggtgtgagtggtgagactctcgaagcctcaaacatgtcaacgaagagactcagcaaagcacccgccatgactcggagactgaggacatgttatgggaacgaccatgctacatggccagagtgcctggtcatctgtcaccagtgtaacagctgagggggccccatgtgaatacccattcagtcagggaaccaaaacagtggaaaccaaaagaaggaatgtcttaccaggccagaattcatttaattctggcttagcaattctaggtaccttgcctctgatcgacgttactgcacataactcctggacagcgggaattgaagtgcatacgaggatggaatatgtctgctgtggaaataaagtggcaatcattcactgagcagcggtcaaatgcctctcctagcaacgaccgtagggcaatcgagacttgctgcggacacgagaccactgatggaattaccactccaccaattctgcacccttggagctgcacgatgagaacgaccacgcgacagagcagaggccagtccccctccgagcccgcaccgccctaggggtgacacccggacaaacccagatcgagcgcaaagcgatcacgcacaggtggtacagccaaatgatgcccacagcccgaggcgacaacgatcacagcgacctaggagcaatcaagccacaaaaatgtgcagacagaacatgaagcaccgactctcaaggcacaaaacacgagaaccacaacactcacagctagta

SEQ ID NO: 572512 - DNA, 178 bp, Homo sapiens
ctggagctgtgcctcagtgaaggggcccagcctgaggaaatactggtctcaggagccacacggcgcgacaagatggcggatagggagaagaagaaaaaggagagcatcttggacttgtccaagtacatcgacaagacgatccatgaacggatccgttcatggatagtcgacgtcggta

SEQ ID NO: 572513 - DNA, 940 bp, Homo sapiens
ttatttatatatgggctggtcttgttggtactggttgtgctccgaagacagaagcaatgggaaggtttcatgcttttgtttaacaggccctttgaacgctatcgaatagttcgcgattgaaatagatggaggtaatattttgagtgcttaagatctggttgtctaggcttgtcttcaaagagtgagttaacagtcgtggtattcacacaaatttggtataattgcctggttatgaaccgattcaattttaacttaatcgactatagaattagaagatactataggatcgtatttggcacatattcaagtggtatattttaatagctgttcaccgagattctttggatatatatgaaggacgtggctttgtgacccaacgcaggggtgcactagtctatttagggaatcaacagcagggttaaactattgcaacctttatcataatactcgctatgtgcctcgtacaaaacttcggtacgtggttctcacggtgtactctaatccctaggaaattttttgttcccaccttcaacacctggggcggcctatggcgtgcgcgtcaaacttcatctggaactcttgccgagacggaaaatatattgtaacgcggcctgaaatatataccttcctaaagtttattaggcacctgggcataattaatggttcgccacctcagtggagtgatacttactggtcattattcactccaatgtacaagcgttaaggggtactgggacacgagcggcggattgtggccatttcggcagccgtccccggcaaatctggatatgtgtcgaactggataccgcacaagactgtgggctgcacggggagaacctatgggcaagaagtacagaacgagcctaactaccgaacttttgcaccgttttgtataacggttgtgcctggcgttaacaaccaaatcggacacaagggaaac

SEQ ID NO: 572514 - DNA, 851 bp, Homo sapiens
ggcacaggtccccctagaccctgtgccgggactgtgtcgcgacgagttcgctaaggggcaacaaggtagccttctgcgggacccgattgtccgcggcgggacaaagcgttgttcccaatccttccgagacgagattgggtaagcattccgggcccaggaatccgaagtgtcctccttatacccgggtgttcgtcgccgcggccattttcccccctggtggaacacaatgggcagcctgtgctccgcacctctcaacatggctggaaactcccttggcctcggattctcgagtcgttgtgcccgcgtctgggtccaatatggggccccggtttgtgaatgacacgcccagacttttcccgctcgtggcgtaggattatttcccccggaatctttcctgcgcccgccggtgggtgcagtttgagtaatccacccaggtacgccgcacaggatttttccctctttataggagccccaattcgttgtggccccggccctttcttagagcttgttgccccattggcccttcgcccccggtgcggtccacccccggtgggtcctctgggcgcgtgcacggcatcccccgcgggcctctcctacacaagcccgggccgcaatggggaaaccccctgtccccaagggaatgacacaaacaatgtaatccaccgcgtgcggggacaccccccccggtgggccccccgacattggcgccggcggagaggcacacagaggagattcaccactggaaccaccaccggagagggaagaaggtttcccctcgtgcccggatcgaagtccgagctctgtcctccctgacgcctgagcagcactggcaatatcctcgcccacatgac

SEQ ID NO: 572515 - DNA, 635 bp, Homo sapiens
caggcaaaatctgatatatcaccattaaagaaagaacttattcatgtgttggttcgcctgttcgcccaaaagctattgaaataaaccacaacaaaacaaaacaaaacaaaaaaccttttccactctcctcaaaccatggtatctatctactacgtctccccttcctctcaacagatttcacttttgcaaaatcaaaagccacaaaccttctggctaccaaaccatcacacttactaatacctacatctaccctttttccatcttgtcacagtggaacgagtgactgcctctgatatgggttggctctgtgtccctacccaaatctcatgtgacattgtaatcctcagtgttggaggtggggcctggtgggaggtgattaaatcatggggacatatttcccctttggggctggtctcgtgatagggagttatcgagagatctgggtggttaaaagttcacctcccctctctttcttcttctgctcgaccatgaagatgggcctgctatgtgcttggttctcttaacttacatatgaatggagtttccgagggctcccagcactctttctgttcaagcgttgaaccggaaggcaattctctttctttctaattacccgccatggattttttttctgg

SEQ ID NO: 572516 - DNA, 395 bp, Homo sapiens
cccctttttggcgggggggggggggcaaataaaacccccccttttttttttccaagagcccccgttttttttttggggaaacctggaccccgggggggtgggtcttttttttggcccccgggggggtggggtgcccccccttttgttttttttttagggtggttttggatgggggaattttttcccattttggccctttttttgggttttcccccccccccccaaacggggttttgggtttccccccccccccccccgggttttgggccaagggggggggtttcttcttggggccttttttttttttgggttttgtttttttggggggggggcctttttttttgggaaaccctttcttttgggttgttttaaaacaaaatccctttttcccccca

SEQ ID NO: 572517 - DNA, 249 bp, Homo sapiens
ggtccgggatcggcatagggattgggggtggatggggtgtgagagaaaggagggagagtgcctgggcagctgggatgatagggcatccccgagcttcatttcctgcccagacgctcccctctgtggcctcctttcctccaaggcctcgccagctctcaccctcccttccctctacctcccctcctctggaagatgtcggagtctagggcagcctgcagttgcgggagcccacactcccatcccctctcg

SEQ ID NO: 572518 - DNA, 424 bp, Homo sapiens
tgcggcatcattgccatttcacatgtgagcatactgtacaccagactatgctgaactgactttctgttaacatggtaaggagggatgtagggaaatacatgtatctgcccaccctagctagctacaattctgcctatagtcttccaaattgtacaggacgaggaaaagtctgtccatagatagatactgcaaacagcgcactgtgttactagcttatcgcctgtttaaacaagagaaagctttcccacactggtgagctggagataatctcgcagcccctgggcatgtgaggtctggtgataggagtgttgcttgatgtcttggtcctgttcttacggatattgggtttcatgtttggcctaaattccagccagtttttaaacagaaaattatggatgtaggcagcctttctgtttgtctaacc

SEQ ID NO: 572519 - DNA, 316 bp, Homo sapiens
agctttgattgaattcgagcagccacatgtgttattgcactgagcaagtactcgtgacaccatgcaacagacagtgcttataatcacagattaggaaatggattcccaggaggggacctgcccaggatcacagcatgacaaagctgggactcaggggtcttgagtctgaccaagaatatacccaattaccaatttatctaatactctcctggggtgataaggccccaaacccactcctcccataggtgataccatgggaaaggggtgcaggaagggcaaagaagtacggtgggcataaggtactagggatacttag

SEQ ID NO: 572520 - DNA, 734 bp, Homo sapiens
  misc_feature (292)..(292): n is a, c, g, or t
acacaaggtcagattgacactatgaagctcaagctaccaaggggaaagtggcatatattggactcaggatctcaacagctgggtgtttcagcattacgttgtgtaaagacttgagagggacagtaccagtgaagacaaataagctgcaatgtcgtgacagataccaacttctgaggaagctggtgtttgtacaagctagcattgaatgctagtcgcaattgtgcgaggtaggtcaatcgttcgaagtagacaagcgagctttgttggctggcctttatggacatgggtaccnaattgcctttggtaatgatggtaaataatgtgagctagcactgtctgctgttccttttgattgtctctttatgaacatgtcattcacatggagaaatatgattcgagatgcttgaattctcactgtaagttcggttcttgaatgttcaacgcaagagatcttagctgtacttgaatgtgccgctggtgtaggttagacacacctagacttgctgtagactgtactcaggtcccaggttgtacgttctttctatggagaagagaaaaacacgtaatcttaaattgatatccagcaagtgtttctggtatcctttaagaaaagttagagactattatttccttcccttccctgtgcagcattcgaaaagtcacccctagaaaaagtgagtgtttaaatgagacttcctaggaagggatgcactgtaacaacaaaagtattctgg

SEQ ID NO: 572521 - DNA, 567 bp, Homo sapiens
  misc_feature (435)..(435): n is a, c, g, or t
cacgaggggctgcgtcgtcgctcaccggcacgtcaaagaactgaagaggcgtaaggctgtcgtagcaatactgagggctcacctgtatccgccagccggcaatattcctcatggcccaccaaaccttcgatgactgggaatgatttgggggcaagtccgtacagaaatcaaacgtcgcagaaaaagaatgtaaacggagcttgtctttaacgccctaacgcaaacgactttccgtcgtttaatttgacctgtggcaagttgggctgctgctccgcgtgtacatccgaaaaaggtttttgttctggatgatatgcaatgcagctaacccgctctcagagttttgtggcgtgccagaagcccattttcgggatcgacaagcaactcgccctctaccgcaagatgctgctcatccggaaggtcgaggaaatgctcggnaacgcctcgctcgccgcggagctgccggggccggtgcatctctatgtggggcaagaggccatcgcggtgggcgtctgccatcacctcgcggagacagactggattgcgagcacgcatcccgggcacgggcat

SEQ ID NO: 572522 - DNA, 646 bp, Homo sapiens
cataatcactgaccagccttgacactccccttgcaaaccatcccagcactgcaccccaggcagcactcctagccttgggctttggcatgagatgcgggctccttagttccgccataatggatacaagcgtcagttaaacagtatgagatggttgcacgtggaagtgagataatgacagagtgaaacgaagtattggagcgaaattagggtagaaaaagtagattgagagtaagagggtaaagcatagaggaaacgtaataaggaatagactataagaaggggacagcattgatagtacaagacagaatcgaagcaaggaacagaagtgaaagacacgcgtagccgcaacgacaattcgatccaagggaactatacgacaacaagcagtacttgcccctgaatggtacggcccatggaccgtgtacggagtacccaaggcccgggaacgaaattaacgggcagatagtacaagaattgctgacaccccctggcaaagcactgaccaaccaagcgggactcacccgagataacacaccccgtgacaggcatgggacggaaaagaacaaagaaaaggggcggccccaatgataacaacaagatgaaggcggcagcacaaagaaacaaacgacaccagcccctgcaccaa

SEQ ID NO: 572523 - DNA, 743 bp, Homo sapiens
ctgcggcagacggcgacagtggcggcggtgctgccattgcagggcttgcaggatccctgctgccttggtgatccctgggctgacagccagagagcacagcggctcagcttcctggagagtgagggttgaaggaaatgctgtgagtggcatgcctgcctgctgccctgctgtgctccctattagtgtcgtgttcctgcagctgtgtgccctggtcagctctttgtgttgaatgtgccgctgccctgtgcagaggatcattgtactttgcacctcgcgaggttgtgcgttgcgattgcacccgtggtcccatcccttcattacgcgccgaaggcccgcccttcgaaccgccactggtccccctttgattgagggtttccatgggccccgacagttcccaggtttggtttcaaggttgggtaggcgttatccgttacgcggcgttagggccatccaactgggcgagtttcgccgtttctccgtttggggagatacactctgtgtgactaatgggccgccgattttttggcggaagccagagaggtactattagtttggcatttggacgcaccgcttttttgggaggagtatacttagtttaatccaccgcgttttaggtggcgccaaggtggcagacccaccgcgatttgagtattctcccccggttattagggttccgcattcggccgtttagcttacgggccgatttggccagttagatgacgcagcaacacaaatctgtttgg

SEQ ID NO: 572524 - DNA, 244 bp, Homo sapiens
cgcatggggtctgtacaaagacagttagatttggcctagtgaggttttactggccctcaaatccgaaagcaagagtgaggggtttagtttaagagacaaatgagcacttctcaccaactctggatggaatctagaatgcaaatgctgagctgggttggtagtgctttttcgatgttcagagagcggattttttcagaggctaaagggtccagtagcaaaaggaggtgtcagcggatgtcatcaa

SEQ ID NO: 572525 - DNA, 263 bp, Homo sapiens
tggatcgagaggctgctactacgagggctatgtggctgattgaagagtatgctatgagcgattgcaggtctgtctgtcgctagccgcatgagcatgttataacttatgcctcactagggatagtacaaggtaaggggtaggctatgtgtgttgtcatgggggttgagaatgagtgtgaggcgtattataccatatccgcctagttttaagagttctgcggcgagtactattgacccagcgatgggggcatcagcattgtctga

SEQ ID NO: 572526 - DNA, 243 bp, Homo sapiens
accgttgctaggtggcggatcactgcggtcacggacgttcggaccacgctggcaacatagtgaaaccccatgtctactaaaaatacaaaaaattagctgggcgtggtgtcaggcgcccgtaattccagtgactcaggaggctgacggacggagaatctgcttgaacgtggggaggcggacggttgcagtgacgctgagatcgcgccgttgcacctccacgcctacggaaccgggggactcctc

SEQ ID NO: 572527 - DNA, 100 bp, Homo sapiens
tgctgggattatagacgtgagccactgcgcccagcccccctgatctttagaactgccctgctcgcctatgttacaccaaccccacggtgcgttggcccaa

SEQ ID NO: 572528 - DNA, 251 bp, Homo sapiens
cctcctggcctcaccctccctacccagagccccttcacatcccaatgcacagtccctctgcctgttgtacattcttcttgcaccggggatttaagagccttggctctttggagtcttgccttgggggttccgcttagccattcaccccttggggtgtttatagcgttttgagaaggtgtctgtccttagggcccaccattggagaggaacccccagacttctttctagaagccagggcttcagcttggggg

SEQ ID NO: 572529 - DNA, 472 bp, Homo sapiens
gtgagtcgcgcaggaagtctactttctatctcatatagatttgcctgtgttgggtggttcacatcaatgatatgtttgaatatgtaagttgtcgtgagtggcttctttgctgtgagcagagagctctctatgttggagcagatatcattacttcattcatttgtattgttgaataatatcccattgtacggctatcccacatcttatttatctattcactgatcgatggacattgatgtgtgtggattgctctataggatatacatgaataatgctgctgtgaacatgtgtgtacaggcttaagtgtagacatgtattttcatttcattgagtgtatacctaggagtagaattgctaggttatatggcagtcctatgtttaaccattcgaggaattgccagacaatttttcaaagggatttgctccatttcatagtcccaaccagctgtgtacaagggttctcatttctcca

SEQ ID NO: 572530 - DNA, 667 bp, Homo sapiens
  misc_feature (47)..(47): n is a, c, g, or t
  misc_feature (482)..(482): n is a, c, g, or t
  misc_feature (538)..(538): n is a, c, g, or t
  misc_feature (590)..(590): n is a, c, g, or t
  misc_feature (667)..(667): n is a, c, g, or t
atgtcctgccacatagttagctgccctgtgccaattactttgcacanaagaccttgttggaaataatgatgtgacccttcacaatgtagttcagcaccctccttcttgtcctttcctcatctttaggcagaaggcatctgcctaaaacgtacatgtgattttatcactcccttgcttccatgtcttacaaaggctagacagcatggcatgtgcctggacaacagccacagtaactcaccacagtagtgtgacaactcctgagcttgtctatactctgtccagcgaaatgagaccactgattaaatggcagtgtcatttatgctatgtttctagatgcttactcttcatttttgtacttatcttgtagcagaccagtaacaaacagtccatggtctggttctgttccatggaccacacttggagtagcactgggttagaaagtcacctagtatgtagtgtatgcccagtaaatatctgttcantgagtgagtagtggtgacggtggcttcattgaggtagtgtgaagcatctcctgctntgggggtccacggtacctgtgcctgagtggacacatttgtctgaaagctagntttaaaattatagtactatgatattatatatcaaaaatatcttctttctacccaaaacctttggtggaagcataaan

SEQ ID NO: 572531 - DNA, 286 bp, Homo sapiens
cccccccccggttttttttcttctcttgtaattccccgggggcgggaccccccccggcgttttatctttgggccgggggggggtaacccttttcccccaggaccccctttttcccccttgggcccttttgggggcccctttttccccctttgttccaaaaaacccggtggggcccggccggggttccccgggttttttttcccccccgggccccccccccgccccccggccggggggggtttttggggtttttttttttggccttttttggggaagaaaagaagga

SEQ ID NO: 572532 - DNA, 328 bp, Homo sapiens
  misc_feature (168)..(168): n is a, c, g, or t
gggggggggggccccttggggtccccccccccccccccggggggtttttttcacccccctcccccccggtttttttccccggggggcccggggcccccccccccccccttgggtttttttggggggggggcccccccacccggggaaagggtttttcccccccccaanttttttttctcccggggggggggggttcccccccccaattatagaccggggggggggggggtcccccccccctttccccccgggggggggggggggggcccccccggggttttttttttttttggggggtttttttttaattacccgggggggggcccca

SEQ ID NO: 572533 - DNA, 113 bp, Homo sapiens
gacatgtcaggttctggaaaaaaatagaagcagggaattgaattgtataaacattttcgtcgtcgacctgggagtaatggagagtattgcagttaggggtacctgagctcgaa

SEQ ID NO: 572534 - DNA, 1307 bp, Homo sapiens
tgtgcgtcggcctgtctgttttggtgcatgctgtgtgtgttgtgcttccactcttcgttgtttctctcgtacggcactctcctggttggtgtcgtaccgtgtggtttgttcttcctgtttttttgtgtgggggtgttttcatatgagtagttcgtgcttgttatgtttcgtcttgtattcctcatcgtatttctgtcttgtcttgtttgtatcctcctgccgctgcgtggttgtttaggtatattcgcgcccctcctataattgtttcttcccgggggtttttgttgggttcctctctacgtttgtgtgtcacatggagatcgcccacagggtgtctccacagcggggtcgcctagagtgtccccctctttttgtgttcagagatgttccctcttggggccgcaaagatccgacacttgtgaaccatgtccaggtgtgaacaccccaagtgtatcacgcggggggacataccctgggatgttagttcgggagacccatgacccaaactggattaacttgggtcttttttctgagaacttttccttgttagccccaaatatgcgttagaccccaccccagtatgcgccgtgacatgactttgtaaagattttccacgattcttcctatccgtacccgtattggttacttcctttccacggaatgccaaaggtcttatttatcccctcccgtgagaggaaaataatttgtaaaaatttaaaggagttattgctcgccctgtgactacccaaaattgtaagtactcttgttttgtgtgtttctcttgtttaaaagagaagtgggaaaatgtttactattaccacgggagcctcacacacctgccctcccaatacacggctggaattaaacctcgtttttaagtccacgggagttttagagctgagcctcccactttaaattaatggtttaaaaaatgagaactttaactcctgagacctcgtgatcacatgtttcacggaaggaatgaaagaggagttctttcttaataaaaggaaaacacctcaaggagctttgttcactttcccaagctaacttgtttaacacattgtacacctgcgagccacccttgccgcttttcactcacacagcttgaataatttaaattctgtgacttataatctgtaaaatagcccggaatttcctcgtttgtggatctattatagcccttttaccaaaaaaatggctgtgaaattattgtgaaataattaaagggactttccttacttccttcccttttttcaggctttttttgactgttcctttccctacccactcaggccttcttatta

SEQ ID NO: 572535 - DNA, 320 bp, Homo sapiens
tgcgcattggcagcaacactcgaatcagacacagccacaccggaaacaaccttggcaacgcccacagcctccgtactggacattgataccggcttggaagcactgagagtagacgcagcggcccccgccgcaagattgctattcacattcacgcgatgatcaatatcagtgaccttaccatccagcgccttgagcgctgcacccacactgccgtaactactgccctgtatttgatacaccggcgcaaccaacaccccttgcgcacctactgccgcaccaccgcctaaaatactggccatgctacttagggtctggaagag

SEQ ID NO: 572536 - DNA, 185 bp, Homo sapiens
cccggacaacattgctgtttgatgactgcctgatcgatatgagccggttattacttctgtttaggagactgtgccctctgtggtgcctctcttggctctactccacatattccagacctcttctaagaggatgagctgagcagctttgtggttgagctgtttctctttgtctgccttcccaaagc

SEQ ID NO: 572537 - DNA, 797 bp, Homo sapiens
  misc_feature (151)..(151): n is a, c, g, or t
  misc_feature (200)..(200): n is a, c, g, or t
  misc_feature (206)..(206): n is a, c, g, or t
  misc_feature (232)..(232): n is a, c, g, or t
  misc_feature (274)..(274): n is a, c, g, or t
  misc_feature (470)..(471): n is a, c, g, or t
  misc_feature (546)..(546): n is a, c, g, or t
  misc_feature (616)..(616): n is a, c, g, or t
tctgaccctggccccgtgtaagaggccgggcatttaccccccgccgagtctgtagtgtcagtaccccctgttgggagcgtctttaatttattttatccgccggcacccgtgactcgttgacccaacacgccccccaggtcctccttagacnttctcccgactcctcgccatgtttagaagatttctcggttgggggagcngactcnctctggagcgccaggcagacgcctcncacccttctcccgaggccaccgttatcacttggctataagancttctacaccaccgcgtcacaaatgccggatctatcttatatatctcctcacttggttagtccctcagctatagcttgtagccccaaccgcggaaccacacgtctatccccttcatgcggtagatttacgcacgcgccgcacttcctcatttttctatagaggtccaccatatccacaccacacatatagggtttnnatacgacgcctctcgacatgtgtggggagtcacaggagcactacccacacttgcgtgcgcacaccccgcgtaatnttacaaggtgttcgttttgtgttcacacacgagttttaaaagtgcctaaccgtggagttctctgaggttncacgacccccgggttatcccacaggtgctggtgttctctaatttaacttgccaaatttcctccccccgtgtccgcaaggacctaagagaaataaggcctacttccccaagcgcctttccccctaaatgaaatcatttccactttgttttaaaccccccccccccccaggaccagggtttta

SEQ ID NO: 572538 - DNA, 335 bp, Homo sapiens
tccaggtaaagttatgaggacttttgttagtaatacaaggttaagaacaccttattgtggacaaccctgaatgctgaacttagactttcaattttcaaacaggtaggttctttatttcctatcgtgccatcatgaataagtattgagttaggggcataaaattaattttcttaattaaagaggttagcaaattggaaatggggtcacttggagaaaacgaacgttgttggcaaggtggtgtttccttctggctgctctatgaattgatttgttccctctctttacccagttttagagacccttgcattccttgcctcatggctctgtatgtatct

SEQ ID NO: 572539 - DNA, 220 bp, Homo sapiens
tgagctcggtaccgcacgtgcacacacctggcttattttttgtttgttgtctttaagagaggaggtttcactatgttgccggctagtttcaaactcctgggctcaagcagtcctccttcctgggcctcccaaagtgctgggattatagatgtgagccaccatgtccagctgcatcgctgctttggatcagctataactacctgaagaaaagagtgcttgg

SEQ ID NO: 572540 - DNA, 208 bp, Homo sapiens
aaactgaagctcaatgtattgtggcaggtctgtggtcctgaagcatccatgcctcggaatgctgagatcagccacagaccaggtcacacttctgttgcacattgatgggcaccctcggccacctaccaatggttccgagatgggaccccctttctgatggtcagagcaaccacacagtcagcagcaaggagtggaaactgatgctctg

SEQ ID NO: 572541 - DNA, 484 bp, Homo sapiens
acatgacaaaggcatgtggccacatccatctgcatctggacagtgtgatggtctggcgcccatggggcctctgctcagtggttctcatgctggagctgcgccagagtacctgctgtagggcttcttgcaacatggattgctggccctgccccaggcatttctgattcagtaagttttgggtggggcccaagaacctacatttctaacaagtttcctgatggtgctgctactgctgggaccccactgcgagaacctctgccccagtgcaaccctggctcccctgtctgttgatgtgggaagttactggctgcctctaagccagtctacccatgtgggaggtggggcgctgtccacttcatgggtggatataggatcacatgcagccctaaaatttgcaggagccaggaagaggatgaaagcccacacatccaaatatttaaatattgtgacatcccgaaaataaaaacaaacaacaaaaaaaaag

SEQ ID NO: 572542 - DNA, 190 bp, Homo sapiens
agtcacactgcttgggcatatatctggacaaaacttgcctgagaaaagacgcatgcacccacatgttcattgtagctctatacacaatagccaagacatggaaacaacccaaatgttcattgacagatgattggattaggcagaaatggtatatatacaaaacggaatactactccgtaattagggttgc

SEQ ID NO: 572543 - DNA, 651 bp, Homo sapiens
gtgtgtgtgtgtgtgcacgtacatactgtatagtcttaaaaatagcattatactggccagggtggtggctaacgcctgtaatcccagcacttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagggagattccgtctcaaaaaaaaaaaaaggaaaagggaaaaaaaaataagctattatacctccttcctgggtctcaaccggccatggaaatatttctggaaccatctccaaattccaggtgcggaatatatccaataacaaattttctatcaaggtattaagaactaatttttagcttcttactaggtaactagtatcactttaaaaagcgcctcagggggtatattatccttctaaacaggttacaatttcaggggcagctactttagccaactatggtcctctagttggagaacaacttaggggcctatttcactggtggtggtaggcct

SEQ ID NO: 572544 - DNA, 777 bp, Homo sapiens
aaactggtttttttcaaaaaaaaaaaaaaaagcaaaaccaaaaaaaaaacccaaaagcggcttgtttaaaatccggtgggaggtaaggtggtctatacttttttccccttttgggcgagcaactttacacaggcatttttataacacctttttttttcttagttttttgggtccgggttgggtttcccattcagggaatttggaggttctcttcttaacccagtttacgggggggacattagggaaaccttcagtagaaatacctgggggagatctggtaggaggttaaaggtcgtggatctggatctttaaacttcaagtaaggccacttattcgtggcaattttgggtacatttattattagtgatatttgggaaagatttgtgggaccctttattgacaaaaaaaatttaggcaaattttcggtctcttttttccccaaaggggggaaaaggttattggtgcgtggcaaattaggtgggggtggtcttataatattaacctgtggctgtagaacaccagcgccaattgggggctatctagtatattcttttatatattgcggccctatagaaaatttctcatcccattggttgtggtatataggggaaatctcccgtggtatgtcgcccacttattatgcttaaaattggccagaaatttccttcatcctgtgggattgggttaacccttttcaaaaacctttctaggtaccaccttggtgttgcttttcccccgttggtgtttcagcggggcgacaagggttttcacacagag

SEQ ID NO: 572545 - DNA, 122 bp, Homo sapiens
accccatgtaatcacgggttccttaaacatatgaaagaggtaagagctagtgtcagagaaagactcagccagccattactggtttttgtggatgtaaagagtccacatgccacaggaatgca

SEQ ID NO: 572546 - DNA, 503 bp, Homo sapiens
  misc_feature (19)..(19): n is a, c, g, or t
  misc_feature (31)..(31): n is a, c, g, or t
ctttagccaaacgctgccnaggatggcttcnactcggagctcccagccctgcctccctacatcctacactggagctcctagcacagcaaccctaactggaacaagcctcagtgcaggcccccggatccttctggaagaaatgtaatgggcctcagaaagtcctgtgatagaacagcactggatatgtgaaggagaggaaaacagtctggagccccatttgggggaaagggaaccaaagccaaaaataacctgtcacagcctcaaagataactgcacagaagacctggatcttaaaactcctcatgattctcatcccagtcattccacttctgggattctgttttagaaaataatctaaaagtaatcaagcgtaggcacaattattcatcaccatattatttagaactgaaaacagcctgaatgtggaagttagtaaattatagtgcaacttgataaaaactatgatgaaaatatttataaagcatcttaaagagaaaaaaaaa

SEQ ID NO: 572547 - DNA, 396 bp, Homo sapiens
cagtgtcccgaacaatggtttgacccagtgatgtgctggtctgagtcagctcattccactatgtcgggaacatgctggtaacagagcatgtgccacggacagcagcgctggctgccgcctccctggtggggccgagggtccctgagacagaggcgccgggcccttgaccatcaaggggtaagaagctgcagccgtttggcggcgtcccacccccgcaggtgccctccatctcccgggcccaggaccaagatccctggaccaagcacctgggtgacgccacgcccacaagaaggagccagacatccgcaggcccgtggagacaaggcgcgctgctcacctgcgggatgccgtactggtcgatgacctgccagatgtaccagtcttccttccgggaca

SEQ ID NO: 572548 - DNA, 1489 bp, Homo sapiens
cttgtgggataatctctctggtggaaaaccggaaggctttactacataatcattgtggggctaaacagaggattcgccatcggttctggaggggaaatctcagacggctgttttttaaccccctctgctatgagtggcagaacattatggtgtcctacagaagatgttgtttctaacaatgctttctgttccccgaggacctatccgcgggtttgttattaactttgctgtgcaacatatcagaagatattgtgaatgggaggaccttattatctcactttggggagggcacctctgctctctggtgagtactatttttttcacgggtataccaacgggtacacatgggtggtgtccaacacacatcaaaccgccctttgcgtttgggcgcccctctggattgttgttgccccaccgggcggggtgtgttgcccactttggccacgtttttcacgccccgggcaagtttgccactgggggcgttttttctatagacacccggcctcgttcttcggggattgtttctgtcgggggggaagcctcctcctccgcctcagggtggtgtttcctccgggagttttaaacaagtgttcacacacatttgtcgccgggaaaaaaacattttcacggtcgccccacacagtatatcctctgcctactttagggattttcccggagaggtcttcttgggagagaatttttggttggcaaaagtacataccttgtagagtggggagttttttctacacacgggcggttgtccacaacgcacacgcgttggtggttattaagaccatgggggctttacaatgggcccacaaggggccaacatatttttttccccaccgttctaaatgtgcgttcttttgtcgcacctgtggggtattgaaatgtgttgagaaagagagcaacatcttgacaaggggggagattctacagagagacttgtcgtgtgagcgaaagatggccccctcgccggctcttgtgacgcacacaggagggcgtttttttcaaaggctctctgtgaggaaatcgaaggacgaaaagtaggcaccccccaaggtgggtcgccaaacaccagagaccttcggtgcaacatcccccgacacacccacagtggggtgttaaataatagtcgccacaccggcgggatacacaacagaattggggcttagaatacccccagcacgtggcccaccgagatatttgggtggccctctcaggcgtctttctgttttggagactgatagaccacgtgatgccagcctggggagccaccatttctcagacccccatctatttggaaggatgccccaagagagcacacatggccagagtacaatcttctcatcccggaggcacaagcaatccttgcgatcctccagaatccgtggttctctgtccagattttattcccctttttttccttcccaggggttaagtaaaaccttgtttaaatttttattaatttaaaagatgggaatttgga

SEQ ID NO: 572549 - DNA, 413 bp, Homo sapiens
tcgagccggtaccagttctggtcccccactccgtcctgtcaacagtttgcaggccttctccgcctgggttggcagcaagaacagtaccaaccacagaaaagttgccctggttcctcacaccaaagttcctagatgaaaactctctcggctcagggggccttgggtagacattatggtccccatcagtgccagcctcacctgtactgcacgacttcctgtgtaccatgggtttcaatgggaacgcccggtccactccaactcgtttctttgtaaaggggataaagtcctggttattggctttgggataccaggattgagggcctgacgagtaaaacaaagcatttccttggccctgggaatcactttctggatcttgctggctgattccagtacagtgggggaccaggaactgc

SEQ ID NO: 572550 - DNA, 347 bp, Homo sapiens
gatcccaaagggcctggccaggggcttgggcacccggctcaaaagggatttttggtcagcccccggttttttccgcctccctggtaaagccagcagggccccaaaaggcagtgccttgggcatgtcccaaaggactgttccaggggagcgggctttttagggcccctttcagagagtcaaatatcccactctttctttaggtggaaagaaacccttcccggggtccagcttttgatggggggggtcagtattgggggccgcgggcatttttgggactttgccaagcaactgtgggcggctcatgttgagaaggggtttccgggaaccccgttgttttgtatttttta

SEQ ID NO: 572551 - DNA, 247 bp, Homo sapiens
  misc_feature (28)..(28): n is a, c, g, or t
ggaagtgcacatgcggaagaccagcacnaagagaaaaggccttgcgtgcgaacggcttcacagtacgtctcgaggatacctccaacaacaaaaccacttactgctcgtaaattcattttgacgaaccgtgagattcaacgtgactggcaccccagaacaatatgtaccttattctaccactagaaagaagattcaggagtggatcccaccttcaacaccttacaagtaaagacaatgaagaacagtt

SEQ ID NO: 572552 - DNA, 432 bp, Homo sapiens
acgactgttcgaccagggttgtacgagatatcgccctcagtctgatctagtctaattgctggtatagggacaatgatggaggatgggttcggcgagacaggtaggactggccatctcccatctatccgatctagttgcaggacggaaggatggcttcagccgaaggtggaatggttgtcctcctctggcgcatgctgacctctgggcggcgttccctcgagcagagatccctccttatttattgctagctcattcattcccggatctttgtctttttctttatgatctatcttttcactcgcagttctctttgggtggacagttgtcttgtttgggttgtgtgttcattgtgtgtctgttccgtcggcatgtccgctccaagttactcattttctgctattctgatacctcctttctttgtgcattccagag

SEQ ID NO: 572553 - DNA, 192 bp, Homo sapiens
  misc_feature (3)..(3): n is a, c, g, or t
gtncagccaatatgccgagccgcatctgcaacctacaccacagctcacggtaacaccggatccttaacccaccgagcaaggctaggaattgaacccacaacctcatggttcctagtcggattcattaattactgtgccacgacgggaactccctaagtatgtctttatccttagtaacctgataacctaacc

SEQ ID NO: 572554 - DNA, 695 bp, Homo sapiens
  misc_feature (295)..(295): n is a, c, g, or t
  misc_feature (302)..(302): n is a, c, g, or t
  misc_feature (306)..(306): n is a, c, g, or t
  misc_feature (311)..(312): n is a, c, g, or t
  misc_feature (332)..(332): n is a, c, g, or t
  misc_feature (350)..(350): n is a, c, g, or t
  misc_feature (513)..(513): n is a, c, g, or t
  misc_feature (524)..(524): n is a, c, g, or t
agttacttcagtaatctgttccatgagatatgatctgcctatgcgagtggtgaactaggcttgctatgtaatatagaacgtggctcaagtacatatcttgatatgtatgggcatactcttagtgatattgtatcctgtcctatctgcttgctcatgctagtccctgtgcacggctgagatctcagcactcttctcgttcatagctacagcaaaataatccaccgtctcttacatgaccctagctcaaagggttaccaacaaattaagattgctttccatgtttgaaatttaccantgagagncaangaagnngctattttgagtttagcatngatattgtgaaaataagngcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgctncctaatctttntgtgtacagggattcaggtttcttattcttacaacatgatgtttatatgtgaagcacatcttgctgttgccttatttttgatgcttttattcatgacaagaattgtcaatataagaatgtatatcttttttgcaaccaatttaataaaggagttgaaagaaaaaaaaaaaa

SEQ ID NO: 572555 - DNA, 200 bp, Homo sapiens
tgggtggtgcgaaagctgctcaaggtgtatgtaccgctgctcaacggcgctctgcggcgcgagaaggtcatgtacgtcgtggccgttgcaatgttggtcgtggcgggcctcgtctatacacaggtcggcaagacctttttgccgacgatggacgagggagatctcatcgttggcatcgagaagctgccctcggtcagcct

SEQ ID NO: 572556 - DNA, 560 bp, Homo sapiens
  misc_feature (10)..(10): n is a, c, g, or t
  misc_feature (64)..(64): n is a, c, g, or t
  misc_feature (66)..(66): n is a, c, g, or t
  misc_feature (68)..(68): n is a, c, g, or t
  misc_feature (70)..(70): n is a, c, g, or t
  misc_feature (74)..(74): n is a, c, g, or t
  misc_feature (79)..(79): n is a, c, g, or t
  misc_feature (84)..(84): n is a, c, g, or t
  misc_feature (93)..(93): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (102)..(103): n is a, c, g, or t
  misc_feature (106)..(106): n is a, c, g, or t
  misc_feature (108)..(108): n is a, c, g, or t
  misc_feature (110)..(111): n is a, c, g, or t
  misc_feature (117)..(120): n is a, c, g, or t
  misc_feature (129)..(129): n is a, c, g, or t
  misc_feature (135)..(135): n is a, c, g, or t
  misc_feature (150)..(150): n is a, c, g, or t
  misc_feature (154)..(155): n is a, c, g, or t
  misc_feature (160)..(160): n is a, c, g, or t
  misc_feature (167)..(167): n is a, c, g, or t
  misc_feature (171)..(171): n is a, c, g, or t
  misc_feature (176)..(177): n is a, c, g, or t
  misc_feature (197)..(197): n is a, c, g, or t
  misc_feature (215)..(215): n is a, c, g, or t
  misc_feature (378)..(378): n is a, c, g, or t
  misc_feature (389)..(389): n is a, c, g, or t
tagtgatatntgtcccctgccctctgtcgcccacgccgcccaagcgcaggccgagacccagccncncngnaagnacagnaaaanaacccaccncncncnacnnacncnanncaaagnnnnaaaaaaaanaagaangcgggccacgggggngagnnaccantgagagncaangaagnngctattttgagtttagcatngatattgtgaaaataagngcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgctncctaatctttntgtgtacagggattcaggtttcttattcttacaacatgatgtttatatgtgaagcacatcttgctgttgccttatttttgatgcttttattcatgacaagaattgtcaatataagaatgtatatcttttttgcaaccaatttaataaaggagttgaaagaaaaaaaaaaaa

SEQ ID NO: 572557 - DNA, 179 bp, Homo sapiens
  misc_feature (21)..(21): n is a, c, g, or t
tgtatctagaggatccttcgngtggctgattggattatatgaggaatccaaaagtgttgtcagagtctgtgggcatgcactgggtgagggctgactctcctcgcagcccctccagccctgtgtgtggctttaggctgcggcatgcacaccctaagttgtcagtcagcagacttccaggg

SEQ ID NO: 572558 - DNA, 835 bp, Homo sapiens
  misc_feature (552)..(552): n is a, c, g, or t
gattgtctgtccaaccaaacagccgatctggagacgggagccaaccagggtgcagttggaggttgaaatcaacaacagattagacaccgttttatagataggtgttctatcagcgaccatgtgacaagcacggtctctgacagtcagtttcatgacgaatggatgcgtgacagttcttacaacgagaatgcgttctcaactaggaatctctgcagactatattggagaggaagtcagttatgttatcacagcctctatgatgatacatgaggactagcatgtaatgatcatgaagacccaaatggttcaataagaaagtttcaggagaacaagatatatatcttccaagtagcagaacgtggtctaggataatgaaaaatgccatacctcaaaatcgggaataggattgcaaaagatgcgaaagaaatgtgttcacagaatgtgtaagtgagttcatcagttttataacatctgaaggaagtgaaaggtgggcatcaagagaaatggaaaagaatcaatggaggaagatattctctttgtctatgtctactnttaggcttagacagttatgtggaacctctgaagatgataccttcagaaatgtcagagaggctatgaaaggagaaacggggagcttggtggagtcagtgcacggctatccagatggactaagtgaaagagcttacagaggaggcatttactaagccagttaccagctggttaataaccacagacggtcaagcaaccacactgttatggtttacaacaaaatcatatcaaccagatttctggtgttccagaacatcagttcatgatcttgaaagcaactgatgga

SEQ ID NO: 572559 - DNA, 250 bp, Homo sapiens
aaacaccgcaatctccttcaatgccagttatagagggtgtttttttttaacatgaagagatgttcaattttatggaagccttttctgtgtctgtaagatgatcttgtggtttgtttaattctgcttatgtgatgaatcacatttattgatttgcatatgttgacccaactttgcatcccagaaataaagcctacttggtcatagtggattagctttttgacatacggctagattcagattgcggtgtttg

SEQ ID NO: 572560 - DNA, 102 bp, Homo sapiens
atcatgtaatatgaggccgcaatatagagtgtgacgaagactctggaatacgagccaactttgagcatgcacttaaaatttacaaaagggctgggcgttaat

SEQ ID NO: 572561 - DNA, 145 bp, Homo sapiens
agatgctgcgatctgcatccagcgcgcgcaccaggtcgcgcagggccgccaggctgtgcacggtccaggtgttggccggcgggttgctcaaggtcacgatggcgacgtgcccatcgcgctcgacctgcagaccggtatggaggcg

SEQ ID NO: 572562 - DNA, 980 bp, Homo sapiens
  misc_feature (404)..(404): n is a, c, g, or t
  misc_feature (428)..(428): n is a, c, g, or t
  misc_feature (476)..(476): n is a, c, g, or t
  misc_feature (517)..(517): n is a, c, g, or t
  misc_feature (542)..(542): n is a, c, g, or t
ggcgggtgcgggcgggaccggatttcgtactgtgggcccgggggcggcgggggccgggggagtgaggggccggtgtgagcccatcgtcgactgggccctccctggcgccccgacgttgggcgggcggcggagcggcgctgggccgtccaatgatcgttacatgctcccgctactctgctaccaacgtgctgtgtcgaggtgtgagccagtgccgatcgctcattcggagagatggacctgccgttgtgtctgctcatgcctgacttctggcctagcgagtgggtatccgtaccgtgccatgatacgactgagaccgacgggtccttggtacaggacatcggccagacgaaaggatagcgtgcgcattaaaggaatcgcggttgagtgcttcacgactccttgcntcgcccggcaagcttcggacggcntaagcgagtggcactaggaaagaatagatgcacgtggcgcggtattgntcgctcggaatcatactaatccgggcaaggccaccgaggcntcccagtccgagagcaatgcctctntttaagacataacgggcacagaacgaggaatttctcaatgctggcttcaaactcgtttacagcaacattttccgccagggttcatcttaatcgtttgggtggcaattattcaccacgcaagttgctcgtggaaattccaagcaaagaagttgtatgacgtttagtacggaatccaatgtagctggtcaatggtattatctccttacagggaaaacaaggctacaattcacttgcatttgacctttagggggcactagtcgcgaaccaaaccaaaccataggcatctaagacttgggtgcccaagtgcgacgggaacacatgcccagagagcgaatcgcgtagggaacattcactccgcaacgaacgccgtagtaacacagacgggggtgccccgctagaaagggcccgcgtgtgcctagggatgggtatgttccgcca

SEQ ID NO: 572563 - DNA, 368 bp, Homo sapiens
gcttggtgatctctgcaggatcccgcacgcgctaccaagataggttctagtctctttatgacagaggggttctttgttagtgagggctgtggcgtattgcccaccatactacgagcatgtcactaaaataagattccccttctgttgtttgctggctatcatcctctctcatgacatatactaaacccggacctctgtgatgattaattttccttagatttccttccaacgtcttaacccttaatcatgttcccctttcaattcaaatatgtttcaggcagctttccacaaggaagactgatttgaggattgaagtgatttgccaacattctgagaaagcttattttaaaatagcacggctttataga

SEQ ID NO: 572564 - DNA, 419 bp, Homo sapiens
  misc_feature (4)..(4): n is a, c, g, or t
  misc_feature (8)..(10): n is a, c, g, or t
gcgntctnnncgatcccgtgaaaggtagctgttactgaataaaatgctgagaaatcaaggataaaggtggcagactgggaattcccactgaaaacatttaattagattcacagcaaagcatcatttctggaaattttaaaaacttacatgtacctaccactctagactaaaaaataatatacacaaaggccatttccaaagagaattttcccccacctacttaaaaagtttataaaggataattagcatccatattaagaaactgcctcatgaaattttaaaaagtgagaaagaaataagctcaattaaaaagcttattcaagtgtacccaaactccccttgacttacagagggttaccctaaggttgagataggtcaaggcactatttacaaaatttatgccagtacagcttccttcc

SEQ ID NO: 572565 - DNA, 656 bp, Homo sapiens
  misc_feature (122)..(122): n is a, c, g, or t
  misc_feature (162)..(162): n is a, c, g, or t
  misc_feature (249)..(249): n is a, c, g, or t
gtctctatgaatctgactgctccaggggccacataagagtggaatcacacaggactagtcctttttttttttgagttggagtctcactctgtcacccaggctggagtgctgtggtgcgatcntggctcactgcagcctctgcctccccggttccagcgagtntcctgcctcagcctcccgagtagctgggattacaggtgcgcgccaccacgcctgtctaatttttgtatttttagtagagatggggtntcatcatgttggtcaggctggtttcgaactcctggcctcaagtgatctgcccgcctcgacctcccaaagtgctgggattacaggcgtgagccaccgagcccggccccccttttgtgtccttacttcactcagcacaatgtcctcagggttaaccatatgctgtagcacgagtcagaacttccctcctcttcagggctgactcatattccagtggatggatgggccccgtattttgcttctccatattcatccgtcagtgggcacttgggttgctgctaccctttggctgttgtgaataaagctgctatgaacatgggtgtttaaggacacttgttcttttagtctcactctgttgcccaagctggagtgcagtggtgtgatctcggctcactgcaaactccacctcc

SEQ ID NO: 572566 - DNA, 448 bp, Homo sapiens
  misc_feature (52)..(52): n is a, c, g, or t
  misc_feature (203)..(203): n is a, c, g, or t
cagctctgtagtttatcccattattgtatgtcccctcacctaatcctcatgnagtgtctggccccatattagggtatgtaataaatattacttgaggaatgaatgaatttaacatactaccaattctctgagtgactctttttaaagccttcatcatcatttcacactttcttgtctttcatatgggcatgtccaatcacccnttccatgaatatctgtacctgttacaaagagaggactaggttcctggagttcatagatgtaaacaacatcctaggggtagcaaactggtgggccctgagccaaatcctggcctgcacatgtattttgtttgagttgtacaatgtttgttataaatgaactggctgataatattttttaattggaaatgtttacattaaaaacctagacttctagctgctcttaaaaaataaaaatacggctgggc

SEQ ID NO: 572567 - DNA, 342 bp, Homo sapiens
tggctgctccccacaaatgatccttcctttcaccattgcattgactcgctggggggaaccttctgcaacacattgcctgccattgccgtatagccagcgacacagctgcaggagaatgccgtggtgtagtcgctgcactctgcgtgacccgagcactgttgtctgtggtcagcacacgtctggcgggaatccgtgtcatagctgaacacaactcctgttacctcaatttcatccacatctcttacctgagggtgctgctggtgacacgtctccactgccaactggcctgacctggtcctctctgtggcaggtccaagtggcctatcttgacctggcctggga

SEQ ID NO: 572568 - DNA, 205 bp, Homo sapiens
gattcaggcacgaggctaggtccaagcgcacgcccagagcaggcagtccgctgtcgccgccagtagcagccttcgccagcagcgccgcgcgaaccgggcgaggggagcgagcgccccgccagcccagcccagcccagccctactccctccccaagccagggcagcagcgctttctcacaaagaaaatgttggaggaggaatccag

SEQ ID NO: 572569 - DNA, 3710 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572570 - DNA, 3809 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagtaagacccagaaaacatctttaattggttcttatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572571 - DNA, 4958 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctccaggtctgtgggttcttggagggtctattgcccaggggttcagatcagtggctgcagttgaggcacagacattctactttgataaacagttaaaaaagtctaaaaatgtaataggaagcttagatgcatataatggacaagaatgactgaaaattattcttggagaatatcaaaattgcaatcatagggaggcctttagcttaagaggcctgtgattattcctgatagaggtatggaaagaaccatgcagaggaatattatgacttggacctcattttattaaaacagaaattaatcttacaaaagattgtcataagtgacagtttaacttttttctttaaattttgttgtgtatatttaaggtatacaacatgattttatgggatgtatatagatagtaaaaagcttactaaagcaaagcaaatgaacacacccatcatctgacatagttacccttttttgtgttgttcttgtggcaagagcagctaaaacctactcacttagcatgaatcctacatacagcacaatgttattacctataatcctcatgttgtacattagacctctagactggttcattctacgtatctgctactttgtatcctctgacctacatacgtctttcacagtttcttccattcccatttcctgtcattttttttctctagcttgatatttattatatttttccctaaaagtctaaaaccttaaactttcaatatctttattgcatgagaagccatacaaatccacagaactagccttatttctcatcacatcatgctgttttatccttgaacttctatttagcaccagtgcactaattctgcatctgggcaggatgactttactgggttggaagaaatatcccaaaacccattgtctttactccatgaagggtccctgaccttctgagaggggcctgcctcacttcttccatccaaagaattatgcatctgctactgtgtcagggaacatatttaaggaacatgtactgttactgtgtcaggaaacatatttaagaaataggaaagactttctctgccccttaaatcacacatgcttttcttcctagttatgggtggtgtttttagttgctcaaagagcctcacagttacgtgagaagaggtctggtttatttcccagtaattattttcttcctttcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572572 - DNA, 154 bp, Homo sapiens
gtttcacaatacacacagttctatgtttataaataacaggtttcaaaagaaactcaggccagtatttaaacaagttcttaacttttattgaccatggcatttttaatatgtaacccagcggattcgtgtttccctaccagagctttaccaacca

SEQ ID NO: 572573 - DNA, 419 bp, Homo sapiens
gcagactatggtgatgcagtggccatggagaatgtgtagaaactcatataattacacctgcaactgtgatgtggggtactatgggccccagtgtcagtttgtgacttcacgctgtgacgcctttggaggccccagagctgggtaccactggactgtactcactcatttgggaaacttcagccttcagactcacagctgctgccttcagactgcctctgcaaggaacaaaccttacactgcggattgaacgaaaccaccatgtggaccactttggaaatctggtcactctccaagaaccaatcctgtcaagctgattcagctgtgagccctctatcgagcaccagacttcggcggatcatgacactgtagccatccccctggccaagcttcagactttacactgacatgtacgcttcatc

SEQ ID NO: 572574 - DNA, 3793 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572575 - DNA, 353 bp, Homo sapiens
actctaccggtaccaatttcctgtattattccattttcacactgctataaagacataactgagacttactaatatataaatataaaaggtttaattgactcacagctccgcatggctcagataacttacaatcatgggggaaggcaaaggagaagcaagcaccttcttcacaaggtggcgagagagagagtgaaggggaagtgccacactttgaaaccatcaactctcatgagagctccctcactatcacgagaaccatgtatttgatgtcttttgaagtggcagatgtttaaatgtgtgtatttttctacataaaattgaaaaaatcctctacattttctacaaagtatctg

SEQ ID NO: 572576 - DNA, 322 bp, Homo sapiens
  misc_feature (42)..(42): n is a, c, g, or t
  misc_feature (46)..(46): n is a, c, g, or t
tcaaagttcagtgatggcagatgtccctccccccgaccaagntgantgtccgagttcgacttcagactgcagtgctagcatcgagaatttcaaagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572577 - DNA, 439 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgcgtccagaacctgcactggaattagcccatccaggggctttgatagcagttggacatcccagct

SEQ ID NO: 572578 - DNA, 2476 bp, Homo sapiens
gtaggtcggtacctccagagtatagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572579 - DNA, 131 bp, Homo sapiens
agtttctctgatcgctccacggctgtgcagagacgggcggctaatagtaggtttccttctccaaccagcacgcaggggatcgcctgatgatgagttttctgacttcgtacatatacgaaagatgagaaaga

SEQ ID NO: 572580 - DNA, 212 bp, Homo sapiens
  misc_feature (28)..(28): n is a, c, g, or t
cccccccttttttttttcccctggggtnttttagtaagggggcccggggagggccccctgggtttttttggcccccaagccccccccttttttcccggccaggggggggccccctttttttttttttttaggggggggggccccccaaagttttgggttttttaaggggggtttttttccctttaaaaaaaaaaatttttttgggcccccca

SEQ ID NO: 572581 - DNA, 3733 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacagctacatgtctctgatttttcagacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttga

SEQ ID NO: 572582 - DNA, 292 bp, Homo sapiens
cagcagtcaagagatgattcctgctaatattcttaccaaagaatatcccttatatggccaataatatcacaaagacataatagaaatgttttggtcctagatcactaatctaaagtagaagcaatgaatacattagtgtctgttcagcgtgtagaacggatttaggacaaggttgaacatggaaaacactcctatctgtcatacatggtgatcaatatcattcaaatagttctggctaatatacacaagaatcttcccatcttctcttcaaatattatacccaggtatttat

SEQ ID NO: 572583 - DNA, 4066 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgggggccca

SEQ ID NO: 572584 - DNA, 141 bp, Homo sapiens
cattattttacaagatacaatctgaatcttcagtagctgaaggcagtggattaaaacagtttacatcttctgactttgttcagatcatggtagggaacacactttgatggatgcctttctgtgagggtattcttattttta

SEQ ID NO: 572585 - DNA, 3882 bp, Homo sapiens
  misc_feature (3751)..(3751): n is a, c, g, or t
  misc_feature (3756)..(3756): n is a, c, g, or t
  misc_feature (3771)..(3771): n is a, c, g, or t
  misc_feature (3820)..(3820): n is a, c, g, or t
  misc_feature (3833)..(3833): n is a, c, g, or t
  misc_feature (3849)..(3849): n is a, c, g, or t
  misc_feature (3871)..(3871): n is a, c, g, or t
  misc_feature (3882)..(3882): n is a, c, g, or t
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgaaaaaaaaaaaaaaaaaaaaaaaaaaaaaaaaaaaaaaaatncctgnggccgcaggcttttnccctttggtggggggttaattttgggcttggccctggccctccgttttncaccgtcgtgccnggggaaccccgggggnttcccccactttatccccctgncggcatccccn

SEQ ID NO: 572586 - DNA, 110 bp, Homo sapiens
ctgcgcgaatacactagtgatatgtgagctgagatactgcaccaagtacctttctgtaatgtgggctgtggggagaacctatcgtgaacagatattccaatggcctcttt

SEQ ID NO: 572587 - DNA, 182 bp, Homo sapiens
tcgaagcggacccccggacagtggctctgacggcgtctgatggtgctgctcacatctgtggtccgggaacggggccttgaacgccggaccgccctgatattgcaccggctccggctggccgatggtgaagttgaccggcacgccgcgcagcgaggccgaaatcgcgttttcctcggcttcca

SEQ ID NO: 572588 - DNA, 310 bp, Homo sapiens
tggctcaggttacttctgtagccattgttataggaatcagccactcggctaggggggtggtaacaaggcacccctgtgaattccatccttagagtggctgcctggctccagatgaagggatgctgtcctggtggggggtagggtcgccctaggagggcactgtctgcgggaaggtggcaatatggtgcgtaggcccccgcacacatggacccccatgccaacgtgcctccgggcgctccagcgcagcggactccgcgccccagagcggccgaggcgatagtaacagtccccagggctagccagatggaaa

SEQ ID NO: 572589 - DNA, 303 bp, Homo sapiens
cagcgatgacgtcttaaccatcgcactcaagagacggtagctaacaaacagaaacactgaccttttgtttggaatgtgcacggccttgcagcaatccaggtctgctgagttcagccttttcctgtgcaccttgttaggcctggcgaatttcccttgggcgaggctggccgtgactgctccgtcttgcgcctccctcgtcagtgtgctggatcagtggtggatgtctgtgggctggagggagcctctgagggcactagtgctggatgctcatgccccggattgtgaggtgcctactggcgcctc

SEQ ID NO: 572590 - DNA, 814 bp, Homo sapiens
ggtgtgcctggcctgatgtgtggggcgcgggcgtgtggcctggctggcggccgctgcagagcaccgagctgtgtccgggcgggggagccctgcgttgtgtgcagtgtgctgtgcgctccgaggcctgcctggtgtggtgcgaggagcggccagtgccctgggccgagtggccctgtccagtggtctgccagcagccctgctttcagccacctgtgtgtgcgtccggcactctggagcccagcggggaagctagcaccagcctgggcctgcacacacgctctgctgcaccagctgccctgccttcgggctgcatggcctcctgcagacaactcttcctggtgcccactgccaccacctggcctggcgtggcccacgttactactcactctggagcccaggcaagggcaaagtgatggtggcttgcccacggcttggtctctcctacagtaagagtctgaatcctggcacgaggggacacatgggacttccggacctgctccgaggccttcctggcgttgctgtcccccagggagccactggttgtaccacacctgggacccaagtcgccagggacctgctgttgcttgacttcgggggcactgtgcaggctattgcagtcccaggttggtacgcgggctgatgggcacccgtgcaggacggcacccttgtagggccccgataggaggtcattgaagggccctaaggcacaattatcaggggcacgtcctggcctagtgtggctggtgctccaaaattgggaaccgtgttgaacattgggccagtgaggaagctgcttgcagacggaagggtccca

SEQ ID NO: 572591 - DNA, 345 bp, Homo sapiens
  misc_feature (329)..(329): n is a, c, g, or t
gggcagggttcagaaagtcactgccttaggagtttcccagtttgcaagaggcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgaancctgccctagccgtat

SEQ ID NO: 572592 - DNA, 589 bp, Homo sapiens
agcgggagaaagtgtcggtctccaagatggcggccaccttgccgtctggtccgtcatgctccggaggccgtgacggccagactcgttgagtgtccatgtggttcgtctcagatcacgtacaggagccctggggggctgtagccaacatccgaacgggggcagaggaagtcgcatgtaagtgcgaggaccgtcaaagtgggacaatatattatgtaaagatccgaagaaactacaagtgaacgcgtagcgcgaaggccaagccaagttgtaccacgtggtacagaagcgtacagcacgcatccaatggtctgtccgtggttgggcgccaggaagaacagcaagaccacgtaacccgtggggtgacagggagtgcgcaaggtgcgcccaaagggcacacaccaacgcactacaagcaacatgccgcgaaacacgcacaaggcactcagcgacgtggacaacgacacccaacaggaccacgcaaaggtaaatcctcggccccggcacagacccgggtaaacaacctggggccaccacaatgcccgcttcaacacaccaacggcggggaccaaggcatcagccacaatgcgga

SEQ ID NO: 572593 - DNA, 300 bp, Homo sapiens
aagggggcccctttttttttttgggttttaacccctctttttcccgcccaaaaatttttttccccggaaaagcgggaattaagggtgttttggggggggtgggccctttaaaaaaaacctttgttaaaaaaaaaaaatttttccggggggcctcctttcttttgggggttttccttaggcctttcccccccaactggggattttaaagtaaaccccccccaaatttttcccaaggttgttttttgggccctggttttcccctaaatttgggttcccccgaaattaaccccccccttttta

SEQ ID NO: 572594 - DNA, 456 bp, Homo sapiens
ggctaggctggaagttcccgcacgtttccggtatctccgctgggtccagcctgaccgcaaactacatctcccgcgatcctgaacgtacccgtctcagcttcactgacttcgctgcggacccccgattcggcaacctcggtacctggctggcagggcgtggatattttgacggcgagtacatctaccagcgaaccgccgagccccatcaagccctcccctttgatttcctcaccttctgcgcgtcaagtcaggctttccgcatcggcgcgacccgtaccagcgacggcgagcaggaatggttcactcgcgaggatatgaaaacaatggacgacctcatggcgcggatacgagtctcctcaaccatgcccggattcatgccgccggtaaccatcgagggcgtcgagtacgtcgacggagccttggggacacaggtggcattcctatcgacggcgctca

SEQ ID NO: 572595 - DNA, 840 bp, Homo sapiens
tttttttttcccgggcgttcaaaatgtcaaagcgaggacgtggggggccctcgtggtgcaaaatcccggattccctgtgggtctcccggtaggagctgtaatcaatggtgctgacaacacaggacccaaaaaccgtgtatatcactcctccgttgaaggggactcaagggacggcttgaacagacttctcccgcgtgcgtggtgtgggtgacagtggtgagtggccacagctcaaaaaaggcaacaccagagcctcagaaaaaaggtacactccagcaggtggctcatctcgacaacgaaagagtctcatcaccgttagaaaaagaagtggcgtgtgtttctcctctataattgtgtgaagaataagtgcaggagtctcattagtgtaaacaattaagaggcgagaattgaagaggtctcgtcgccatttacgaggaaccagttaccaagagcgagttgggtgcacacactgtgtgtgtggcgcccccgggaattgtgtcatctccaatgtggcgtgcgccacgcatgtgtgcatgtgaaaatctcctcccagctatattatttgtgtctttaacacaacattctaaaccaaaaaaaaaatcttttaaagcacccccaaaaaaacaaaaacaaatatacaaacaaaaaactccctcggggacggcctcttcttatgtgcccgcggcgggctgcgcggcggacacacagaggcggggtctatctgcaaaaactttcggcccacatttgtgcctcaatatagcccggtgttttcccccttgaccccccccagccttttttttttgttccccccagctggtcgtcacaactcggccgcgggac

SEQ ID NO: 572596 - DNA, 141 bp, Homo sapiens
gcatctgttgaaatgctcaagacttaattatttgccttttgaaatccctgtaaatgcccccatccggttccttttcttcccaggtgtgccaaggaattaattttggtttccctacaattaaaattccctcctttccaatca

SEQ ID NO: 572597 - DNA, 219 bp, Homo sapiens
cgattgcagggcttcatttctatcaatcaccaccaccgagaactacctcacaccttcctcccaggttcacttctttgatcaccaccaccaagaccacctcacacagtcctcccagcgtcacttctttggtcaccagaactgagaccacctcacacagtcctcccagcttcacttcttcaagcaccaccactgagaccccttcacacagtacgtcccggg

SEQ ID NO: 572598 - DNA, 175 bp, Homo sapiens
gacctccttatgctgcttcagcagaagaagtggccaaagaccttaagtcaaaatctggggatcgaagtcctctcctatgtcttcagacgggccctgctgaaaccgagtatgccccaggagacgccgctccccagatgaccggaccagggtacgcaggccccacgcactttaagtc

SEQ ID NO: 572599 - DNA, 261 bp, Homo sapiens
tatcctgaataaaactgcaataaacaggggagttcagacttctctttgatatactgaagccctattaactgaagataagcctctgcgtctgttttgaccgggggaaaaccccaacccggggggggggggaaaaaaagggggcctcttttttaagctttgggggaaacccaaaaccggcccccaaaggggatcccttaaaagcgaccctggggccttccaacttggacccgggcggggtttaaaaaagggggggtggggaaa

SEQ ID NO: 572600 - DNA, 385 bp, Homo sapiens
  misc_feature (328)..(328): n is a, c, g, or t
ctttctttctttctttctttttctttccttctttctttcttttctttttcttttcgagacagatcttgctctgttgcccaggctggagtgcagtggtgcgatctcggctcaccgcagcctctgcctcccaggttcaggtgattctcttgcctcagactccagagcagctgggattacaggcgcccgcatccacacacggctaatttttctatttttagtagagacggggtttcaccatgttggccaggctggtctcaaactcctgtctctaccaaaaacacaaaaaccagcctgacatggttgttgcatgcctttgggtcccagctanttggggagcctgagggagggaggaattgctgggagccccagaagttgtcgttgtagt

SEQ ID NO: 572601 - DNA, 547 bp, Homo sapiens
  misc_feature (139)..(139): n is a, c, g, or t
  misc_feature (182)..(182): n is a, c, g, or t
  misc_feature (190)..(190): n is a, c, g, or t
  misc_feature (195)..(195): n is a, c, g, or t
  misc_feature (241)..(241): n is a, c, g, or t
  misc_feature (266)..(266): n is a, c, g, or t
  misc_feature (274)..(274): n is a, c, g, or t
  misc_feature (388)..(388): n is a, c, g, or t
  misc_feature (484)..(485): n is a, c, g, or t
  misc_feature (489)..(489): n is a, c, g, or t
  misc_feature (494)..(494): n is a, c, g, or t
  misc_feature (505)..(505): n is a, c, g, or t
  misc_feature (512)..(512): n is a, c, g, or t
ccgcccgggttgcactctgcaatagtatgatgaggccaggtgagggcacactgaggcactatgatgaggctgggtgagcgcacagtgggacactatgatgaggccaggtgagtgcacactgagacactatgatgaggcnaggtgagcgcacactgggacactatgatgaggctaggtgagcncacactgngacantatgatgaggctaggtgagcgcacactgggacactatgatgaggcnaggtgagcgcacactgggacactangatgaggntaggtgagcgcacactgggacactgatgaggctaggtgagcgcacactgggacactatgatgaggccgggtgagtgcacactgggacactatgatgaggctacctgagtgcacnctggggcactatgatgaggtcgggtgagcgcacactgggacactataatgaggctaggtgagcgcacactggggcactatgatgaggctaggtganngcanactgnggcactatgangaggccnggtgagcgcacagtgggacactatgtgagggggtc

SEQ ID NO: 572602 - DNA, 675 bp, Homo sapiens
gatcagagtatataaatcccatgcaaacatatctcagcataactgatatttgtttctaaataattacacaggataccatgttatttgttgtaagctcgttgacatttgctaaggaaattttgtttcactgaatatgttctagacgatgccgccagaacgattaaccagttgtgctcattttgtatgtaagctgaagaaaaatgaaactagatagcatgttctccatttcgcagtctacaaaggggaagttcttcatttgcttaaagttcaagatctcattttctggccagtgcaagagacttttatatctacaatatggatgtacgtttttcatatttctagagttcattgtatggaaaacataccatcaaagttgatccgaaagatgttgcaaatccgtttacacagttgtttgtcataccattaaagtcttatggttaattttatgtattctatcttgttctcttgtctaggttagttggcagatctcagtctttctgtctttcgacaaagaactctatgaagaggacgatcagggaaacccacgtatgcctttgaggctagggactatgttgtaagttcacctgtgatggccaggtcattcagtcagtggcacagccactaaccccattcacagcaccaagactggtaccccgatggcttgtaggcggtctt

SEQ ID NO: 572603 - DNA, 103 bp, Homo sapiens
aggtatgacagtcgagaattctgcgcatgtgagtgcgtctgtggagagcagctgtggcttctaggtgccgagtagcatctgtgaaccctccccagtgctctcc

SEQ ID NO: 572604 - DNA, 477 bp, Homo sapiens
  misc_feature (26)..(26): n is a, c, g, or t
cccggggtgttgctggcacctgtggncctagctactttgggccgtctgaagtgggaggatcacttgagcctgggagttcaaggatatagtgagccatgattgtgcccactgcactccagcgtgggggccagagcaagaccctgtctcagaaaaataagaacgtcaacaaaggatagtagaactggaaaaggggccgggtgcggtggctcatgcctgtaatcccagcacattgggaggccaaggtgggcggatcacgaggtcaagagatcgagaccatcttggccaacatggtgaaaccccatctctactaaaaatacaaaaattacctgggcctggtgacacatgcctgtaatcccagctactcagaagactaaggcaagtgaatcgcttgaacccgagacgtggaggttgcagtgaagtgagccaagatcgcgccgttgcactccagccttggtgacagagtgagagtctttctca

SEQ ID NO: 572605 - DNA, 229 bp, Homo sapiens
tggaaacggagtttccgcttttggtggcccaggcgggaagggcaagggcttgatctcggctcaccgaaacctctgtctccggggttcaagcagctctgcttcagcgtccggagtagcggggattacgggcgtgtgccaccacacctagctaatttggtatggtaagtaaagagggggttcctccatgtggtccaggctcgtctcaaactcccagccggggcgaaagaag

SEQ ID NO: 572606 - DNA, 285 bp, Homo sapiens
ggccgtgcctgaagcctggatagagcgggattttctcttcaatacgcagtaagttacttgccccgtggttgcctatatctgtagctaggggcaaagacaataagagagctttctcggccgggtgcagtggctcatgcctgtaaccacaatgaacatacctattaaaacagctgaaatgaaagagactgtacacaccaaaatgctggtgaagatgtgcaggaattagtaactttatatactgctgatgagaatgtaaaatggtacaaccatttgggaaaataatgt

SEQ ID NO: 572607 - DNA, 424 bp, Homo sapiens
atgcacttgtatgtgtctaaacacgagtcttgctctgtcgcccaggctgtagtatatctgatgtgatctcagctccctgggaggctgcgcctccctccaggcttcaagcgattctcctgcctcagcctcccaagtagctgggactacaggtgcactccaccacacctgtctaatttttgtatttttagtagagacagggtttcaccatgctggccaggctggtctccgactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtt

SEQ ID NO: 572608 - DNA, 710 bp, Homo sapiens
aaaactcctgcagctagctcggtgtttgcccaaacagccacccagctttgagcttgaaaggcaggccctggtggtgtaggcacccgagggaatctcctggtctgcgggttgtgaatgaccgtgggaagaagcatagtatctgggccgagagtgcaccgttcctcgacggcgacgagtatctcatggcttcccgttgtgctaggggagggagttccctggcttcccttggcttccctgggctaggggagggagttccctaacgctttgtgcttcccaggtgaggcaacaccccacccttcttctgctccccatccatgggctgtacccactgtctaaccagtcccaatgaggtgagctgggtacctcagttggaaatgcagaaatcgcttgccttctgcgttgatctcgctgggagctgcagaccggagttgttcctatttggccatcttgccagccagccgagagatcacttgttactgctgataggcaatttactgcagcagaggaactgttcacacagagatgattagtgtcacatggtatcgtgagtagatacttgcaacagcgagctcagtcgcaatagcaacaggaggtgaccacaaagcttattacagtactagagttaagtttcatgcagttatgatttaactactgtgtcttggcattggtagcattctttcaactgcaaatggtactaggtaccgtctata

SEQ ID NO: 572609 - DNA, 685 bp, Homo sapiens
cagggtctcttacatcgaccgtctaagagtcgcgctgtgagacgcaacaacctctcctgttcgtctccgccatcagctcgtaagtcgtagaagcattagccatgcgtgagtgcatttccatccacgttggccaggctgcagaccagattggcaatgcctgaggtgagctgtactgactgcaacacggaatccagtccgatggtcagatgccacgtgacaagaccattgggggaggagatgattacttcaacacctagtgtagcgagacgtgggctggaaagcatgtgccctgtgcagggatagtagacttggaacccacaggcattgatgaagattgcactgtaacgtaccgtcagctattctacgctgagcatcttatcacaggcagggaagatgctgccaaatgctatgcccgagggcactacagcattggcaaggagagcattgacctcgagtcggaccgaaatgctaagctggccgagcagtgcactggactgcagggctgcttggcatagcacagctgtggtgactgaacttggtctgggttcactgctctgctatggaacgtatctgagttgagtatggcatgaaagccaagcttgagtattatatcgacacggagccccaggattgcacaagtggagttgagcactacaattctcatctcaccaaccacactacagtt

SEQ ID NO: 572610 - DNA, 134 bp, Homo sapiens
ttgacacttcgtccgccgatgacagtgtactcgtaggtccgtccccttggtggccacttgatttgctggtaagggagggatcgttgacctcgtctgtaatcgactgcttagcttcccaggcgggtcccgagaca

SEQ ID NO: 572611 - DNA, 2157 bp, Homo sapiens
  misc_feature (198)..(198): n is a, c, g, or t
  misc_feature (310)..(310): n is a, c, g, or t
  misc_feature (328)..(328): n is a, c, g, or t
  misc_feature (380)..(380): n is a, c, g, or t
  misc_feature (387)..(387): n is a, c, g, or t
  misc_feature (518)..(518): n is a, c, g, or t
  misc_feature (711)..(711): n is a, c, g, or t
  misc_feature (722)..(722): n is a, c, g, or t
  misc_feature (925)..(925): n is a, c, g, or t
  misc_feature (2043)..(2043): n is a, c, g, or t
acgatgcatgcggccggcatggactcatatcagtatctagagaattgctgagatatatgcgctacacacactcagtatcctaccactactatgaccatacaataggtgatagattacgtagtcgtctatgctatcagtctataagcgatactatcgtcgatagacgctctctagagcgagtcacatcgtccactcgtntaggcgcgaatctagttgttgccatagattggtcagatacgtagggtcgtgtagtcagccctgtcgatggcacacgggtggtggccatggagcacacatcatgtgtagttcntgccgagatacgtgcccngaacataggtattcatgcgggccctaaagccaataaacaagcttagagattngacaccncgtattagagagccattcacgtacagccagattgggcatacacaacaaacattccacatacagtacacgcggataaacagactctattcattgtacctttaggccaactgtggggacgtatggccattctnatgtccccattaaacacaaaagcaccacattcgagattcttattgggtaattctaaaacagacgttacacactcaggctcataactgagacgcggtaaacggtttccatttcgagagcaacatttcccactctcctcacggcgttaaccgtatatgctatagtgctattaaaacacggattaagttacagcanagcataaacgnaaacgccataaattatatctaagacgaggtgattggtcactcgcgtaaaaagacggctattccctcctcatttacacgagaaaaaccctcctcataaaagacccaataggcggccacactcggtactcaattcacaaattaacagttaggaggctctttacacttgtgccaatctctcgtaaacccgccacaattcgaaacgnacactcctgagtcggggccaaaggagcgcccaaaacaggtcgcaagacattttacactcggctcgagggtcgggaaaacactcaaccaataagcttcgaccacggaaggcgacaccacaaggtatgtctattatccacattccttacgttatatcatcggttacgagagatactattctccccggtggatacaattcacaagttcaatcccccgggttctccacattttctcaacgtaaacaccagcatgatttcgccacgcagtggcggcaacaagatatagaaaatcctgtaagaagttcaacatcatctggtatgaacgtcaaatacgatgtgtcggatataggcagagaataatactccgagacacgagcctttataggtgttcctccccgaagagcactaggggtgggcacgtatggtggagaaggtcacaacgacccaggaacatgggacagggtcgtcatagagccaaaggtctggccaaagaagagtcgcgctattggacaacgagggtacaggggtcaacgaggacgtagacacaagttcacgcggtaaaatgagcgttaaaaccatcgcccggtaaggttaagaggggctacgccagtttacgccctctaacaggaagatttcagcgcaccgaaactgtcgtataccacacattcgagacaaacacaggaccgagtaagggaatatacgtaagcaaaccagtttacgtacacagacaacgaccacatgtacatacacaagcgcacgccaaagagacaccaaatgatgacagcctcccttgtaggacagccagcagccattagagtaactcgaagccatgaggggtaagcaccacagaaagagtattgagatacgcaatgggaatcacatcgtgaacaggagacagctcagaacatgaagaccgacataaggccacagaggctagagaagcgaagcaacaggcgagatacatagaagcgagtgggcagaaaagaatcaagcaagagagaggacagaagagtaaaacgcgacagacacatagtcaacgcagcgacacaagagaggagtagcatcgggataggaatcaatcgagagagcaaaaagacaggcgtgtgagagcgaagaaacanagggaagtgcaagcgaagagacggagaagtgaagcaggatggacgaaaggagagaaaagtagcacatgacagctgctcacactcgcatcctatagtagaagacagaagtaggac

SEQ ID NO: 572612 - DNA, 174 bp, Homo sapiens
gtgaaacttatcgcactggcgagtcttcacggcattacttagtcgtaaaggcgtagctgactcaatagcagaggtgggaccacccctcattggtccctacatgggcttcccatccaccctccaggtggtcttccatggctggggtggggtgcaagtggggtccttcataagctg

SEQ ID NO: 572613 - DNA, 280 bp, Homo sapiens
  misc_feature (131)..(131): n is a, c, g, or t
cccgctgggccaggaccacccaaggtggcccaattactcgagatgatcatcacaaccaagatgatgctaacctaatatcctctaacccttcgcggtgctttgtctgggaaaagtcttttggccccatgtcnaatttctattgcattgagagcccaagagccccctggtcagtcaggcttccatttagcatggcgtttgcaaggtttacccatgttgtagcatgtgtcagaatttcattcctttctatggctgaataaaattccattgtatgaatataccc

SEQ ID NO: 572614 - DNA, 392 bp, Homo sapiens
aagcctgcactgtccaaagtcttggaaacttgctggatatgatgtaccgggagccatcacgatggtcctacacattccagacattttcctttttgagccgcctgaaagtacagctggagcccttccctgagaaactcttacaggccagtgaagccagtccagatctttgagaggtctgggtactgtgacaggtatatctttgtaaagaatctttttgaaaatggtgccctcaatgacattcaccggcatatctttcaggactggcattctttttctctcgcgggagtttgcacacccgaatcaaattacaatggctttatctaccctccaggtttattcacaaagtttttatgaagaaaactgttccctttatgccacggttttctgagcaa

SEQ ID NO: 572615 - DNA, 263 bp, Homo sapiens
  misc_feature (211)..(211): n is a, c, g, or t
  misc_feature (219)..(219): n is a, c, g, or t
  misc_feature (258)..(258): n is a, c, g, or t
caggctggagattttcacataggttagattttcattcccggggctagttagctttaagccccctaaaggactagggtaatttgacttctcccttcctaagttcccttttatatccccaaggtagaaatgtttatgttttttactcccattcataaatctattcataagtttttggggcaagtttacatgataaaaaaaaatgtgatttgtnttcccttntttgcccttttgaaataaagtatttatttcctgtttccngttta

SEQ ID NO: 572616 - DNA, 128 bp, Homo sapiens
ctctagaggctccccgcgtttcaggcgcacttctgtacgtctaccatcatcacagaccaaaggtagtataaaatgcacaaagcatgtggaagaaaacagatcacgaaaaactggaatactcataaaga

SEQ ID NO: 572617 - DNA, 1564 bp, Homo sapiens
  misc_feature (379)..(379): n is a, c, g, or t
gcatcacctccaatgtgtgagcagtacgagcatccagcctgaccatatatgcgctagaatacagcttatctcgtagcataagaaaattatcgaaacacttgagcgtgaaccggtatattgaggctcacgtccatggtgaaatcccagacataaccctagtgaagcgcctgacggtcaagcgaatgaaactcaggtatgtacaccacgcgtaatggcatgtacgtggttagtcaagtggaagtccgacgtattagcatccacttgtgacctaccgaaggcactcgcgcaagcatgaaagtagcacactcgtacatacacaagaacagaagacataacactaaaaaggagaccacggtagacaaggagtgcatcaccccgntgttatagtcacgccaacacattatgtggggggagaaggactgtcggagtaacggggtaggactgccgactgagagaagccttaaccgagaagtctctacgagtacgcatacaggcttgggagtcaagtccctacaagaaatcagccaatctgtgtgcaggtatacgcaaacgtgtgttattacaattattgcacacaaactatagacacacaccatcttacacacatgcgcgcgctatatagggtgtagagagtgtgtggagcacactcgtatgaagttccctcacagaagcaagtgggacactactgagcgatacggtcttgtgacgagccacgttggagggacactacacgaggcactctgtttgcactccagtcgagccaggacgaagtttcgaaccacgacgatattgcccaaacgggacacgccgctttgaaagattatatgggccgccgttcacacaacatgggtccaatgtctctcaccccgacactacgtgtgtagaagggcaaaacacgctggttctccccaggcgtttccaaaaagaaacagcgggacaatatatctttaacacaaacaattaccttccgcaaaaccgagttgggttatcccgcgtgcagattatgcccggtggcactcaaaccttgccacacttttgggtatttctcatccgtccgtaaatccaaccctctttgatgtaaggcagacggcacaaccgcgaagtggggtcaccagggaattcacacgggtagggccactagggagacaggacacttctgtgagttaccagttcacggcgcgagtgaaacagacacattggtcggtttgagaaaatccccaccggcgcattgtttgttaagctatgagctccaagttaaaccggaagtaccccatggtatgctgtatcggaaaatcccgagcacaggcccatgtgtaaatatcacttacccacacatataggtgagacgtagacgccgccagccaagcaggcgaaattgatctatattaaaccgcacgaggagggtcacacaacacagtctgtttgatcgagcgaaagcacagcggcgggccaactgtttatacaccccgagagctcactaaccggagggaacagtacgacgcgataaagaattcggcagtcatagacagaggacacgactacgaccatggactacaatgcggcg

SEQ ID NO: 572618 - DNA, 294 bp, Homo sapiens
atacgatagttgatgaagtataaattgatatagccactttggaaactgtttagcaatatctactaaggcgacacatgcatacttcataacccagcagttctacttttaggtatgtgcccatccaaaatgcatatatattgtttaccaaaagacattgtggtaatgttcataaaagcactatttgtaacagtgcaaactggaaacaacccaaataccatcaataggagaatgaaaaataaattgtggtatatttgcacattggaatagtatacatcaatgagaagaagtgactta

SEQ ID NO: 572619 - DNA, 233 bp, Homo sapiens
ggacgaccctagaggatcccgaatatacaccataagccactataattataggaaggcctgtgtaactgatagatagatccaagttaaacttactccattaactagccgaatgatcttaataggacagctcccacctctggttgagaaacttttaacttacttcttcttcttcctcctcatcaggctgtgtttctgagtcttcctcaggtgtgggtggatcagggtggtatcag

SEQ ID NO: 572620 - DNA, 985 bp, Homo sapiens
gggggtcaggttatgtgctggtatttctcccacctactgtatcatagagagcttagattcccagctagcttgctctacagctgcagttactctgatggacttgcacagggtggaccagcaccccttcctctatgtgtgtgtctgctgctgacctgtggatttgccgaggcagggaagctactggtagatgcccatggatgggagccactggttcaccatgagagtcggtggtggagaaactcattactcagggggcatgaggtggttagtagtcatgccagaggtgagttaggcaactgggaagatcactgaattgcacagatgaagacttattcaacttcatataccctggaggatctggcaccgggcagttcaaggacttaatgcccatgctcaatggaaagcacgaagtaccgaagtatcatattctctattaatgggttcatacaatgacactcaacgacttatcagaataccaaaatagccagcaagtcgtaaaagcacaaaacaattagtagaaactacttacacgggagagtacttgaggaagcaagagataacatcgaatccctaatgataaactgtggcattacattgctaggcccaaatattatctaccatacactccgagactcaaccagaccagggggcactacttgcgggcaacaaatcaggacgaaagggtgcacaagaggcacatggatcccacttagcgaactgtacccaagaaacacctccagaaggggaacacaagatgcacagactcccaaaggagaagagaaaagggaacgaaaataaaagcacatgggagagaaaaagataaaagtagacaacaggaaaaacaaaaaaagtgccgaaaaactagagctaggaaaagtacgcccaacaccagacaacagaacaagaaccgaaagcacaaaagcaaaagggagcaggcgaaggaccaagaacggccaacaccaccaccggaagcagacagaagaaa

SEQ ID NO: 572621 - DNA, 130 bp, Homo sapiens
aactcttcaatctcttgcactcaaagcttgttaagatagttaagcgtgcataagttaacttccaatttacatactctgcttaggaatttgggggaaaatttaggaattttatttgccaggttttttggaa

SEQ ID NO: 572622 - DNA, 675 bp, Homo sapiens
cccacccgccctgaggcctccgccgcgagtttgcctcgttcaaggaggtggcagagctaagaagcaggtggagagtcccaagttaagaaccaacggctccaagagggttttccagaccaagattcgaagttccgcaaggccttctacacctctaccggcttccagattgacatcccacggagaaacagttccggctgacctcgctgtacgccgagcacccaggcgactgcctcattttcaaggcccccagcccctcgggtttcaaaatgcagctactggaaacaaagttttcccaccccgtgggcgagctcatcgaggtgccccttcggggccaggacagcattcctgccttcctcaggttggtcaccctcgagcttttcaaccgccaaaccgtggggtaacctgcaggctcgggggcataaccggaacccctttggttggccttacctgcaggttccctgcccccccaaccacagggtggggggcacgttctgcctttccagccccccagggcaacagcatgacttacaaacccgctgggacctacgtcggggttcctgctggggcggccagccccctttccccgggcagaccccatgggtcccggagcctggggtgtgggggtcggcccccagcctgggttcctccccttgtgaaataaaattttttccccta

SEQ ID NO: 572623 - DNA, 458 bp, Homo sapiens
caaagtggaaaatgacttaatttcattattctagcttagaaagtttgttttgctttttattttgtttggcgatagaatggaaatgacaatttcccaggagaatgcctacctttgggggtgctgaacgactcggataatatgtgacctcaaatgactggtcatccttagtcgtcgcagataggaaggtcatgcccttcgcattcactccgagcggtgggcaggctcggcctcggccatcggcgcataggggccagtaaccatgacgacgcccgttggcaaggccgagatccaatagaggcgtagccggggctgcttcatggacttaaagccagcattgaaaaacgttacatcgttgggggaggggaaagtcctgagaggacccggggcccctccctgaggttcagaccaggcatggcggccccggccgacacgctcacttgcggcccttgggcactttg

SEQ ID NO: 572624 - DNA, 755 bp, Homo sapiens
  misc_feature (89)..(92): n is a, c, g, or t
  misc_feature (383)..(383): n is a, c, g, or t
  misc_feature (523)..(523): n is a, c, g, or t
  misc_feature (526)..(526): n is a, c, g, or t
  misc_feature (541)..(541): n is a, c, g, or t
  misc_feature (558)..(558): n is a, c, g, or t
  misc_feature (581)..(581): n is a, c, g, or t
  misc_feature (591)..(591): n is a, c, g, or t
  misc_feature (678)..(678): n is a, c, g, or t
ttcgccgagctttcggaattcggcttgagaccccaattagctgaattcgcgtgtggcagagggaggaaaaggaggcaaacgtgggctgnnnnatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctncctgagaagataaccggctcattcacttcctcccagaagacgcgtggtagcgagtaggcacaggcgtgcacctgctcccgaattactcaccgagacacacgggctgagcagacggccccgtggatggagacaaagagctnttntgaccatatccttcntaacacccgttggcatnttctttcgcgcttccgtacttanctactgaccncactttggatttagcgcacctgtgattgataggccttccaagagtcccacgctggcattgccctcccgaggacgagatgaagagtancaacggaagccaaacgcgttttctaaccaatcctaatctgggttggggggccttatacctggtatttataccccgtg

SEQ ID NO: 572625 - DNA, 199 bp, Homo sapiens
tagaggttgggacacggtgcacagaataggaaggtattctgtagtgtgaggagggagttagaggcagagcactgtcagccagggttttcaaaatgttctaattcggacgccctctgtgcaaacaatcatatataggagtgtgaacaaacaaaacttaaaaaggcagcactctggagccacggccagtccttcccctctt

SEQ ID NO: 572626 - DNA, 714 bp, Homo sapiens
  misc_feature (89)..(92): n is a, c, g, or t
  misc_feature (383)..(383): n is a, c, g, or t
  misc_feature (523)..(523): n is a, c, g, or t
  misc_feature (526)..(526): n is a, c, g, or t
  misc_feature (541)..(541): n is a, c, g, or t
  misc_feature (558)..(558): n is a, c, g, or t
  misc_feature (581)..(581): n is a, c, g, or t
  misc_feature (591)..(591): n is a, c, g, or t
ttcgccgagctttcggaattcggcttgagaccccaattagctgaattcgcgtgtggcagagggaggaaaaggaggcaaacgtgggctgnnnnatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctncctgagaagataaccggctcattcacttcctcccagaagacgcgtggtagcgagtaggcacaggcgtgcacctgctcccgaattactcaccgagacacacgggctgagcagacggccccgtggatggagacaaagagctnttntgaccatatccttcntaacacccgttggcatnttctttcgcgcttccgtacttanctactgaccncactttggatttagcgcacctgtgattgataggccttccaagagtcccacgctggcattgccctcccgaggacgagatgaagagtattcagcgtgatgcccatgcttataatttttagcccct

SEQ ID NO: 572627 - DNA, 150 bp, Homo sapiens
actctcggctgtctcctcgcgacgagtacaagccactggatctgtcctattccacattgtcttacacttaaacggaggctaccaactccctcatcacttctccgggtgaatactcagacgccagcatgtctccggagctacaatgcctag

SEQ ID NO: 572628 - DNA, 270 bp, Homo sapiens
  misc_feature (7)..(8): n is a, c, g, or t
  misc_feature (10)..(10): n is a, c, g, or t
  misc_feature (30)..(30): n is a, c, g, or t
  misc_feature (43)..(43): n is a, c, g, or t
  misc_feature (87)..(87): n is a, c, g, or t
  misc_feature (165)..(165): n is a, c, g, or t
  misc_feature (187)..(187): n is a, c, g, or t
  misc_feature (215)..(215): n is a, c, g, or t
  misc_feature (217)..(218): n is a, c, g, or t
  misc_feature (255)..(256): n is a, c, g, or t
  misc_feature (265)..(266): n is a, c, g, or t
tcctagnngnctgaaaagaatgcaaaaganggcctgaaagccntgttaaatatctgacgagcaagtagcggaagagattcttttccnccggtcattggaggatagaactaggaagcagatttcagcttccggtgaagaagttaaaggatatatagcttcctctcncgttttccgatccagtatcccngggttctgacctgatatttcatagctgngnngcactgcaggagttgctccactattctaagcctcagnntttcgtctnnaaaa

SEQ ID NO: 572629 - DNA, 103 bp, Homo sapiens
ctatgggaactgctggtatcaacccagaaccatctgacttaagagtctaaatgttaaatcacactctgctccttccttagatactcgaaaacaccctagaaca

SEQ ID NO: 572630 - DNA, 637 bp, Homo sapiens
  misc_feature (89)..(92): n is a, c, g, or t
  misc_feature (383)..(383): n is a, c, g, or t
  misc_feature (523)..(523): n is a, c, g, or t
  misc_feature (526)..(526): n is a, c, g, or t
  misc_feature (541)..(541): n is a, c, g, or t
ttcgccgagctttcggaattcggcttgagaccccaattagctgaattcgcgtgtggcagagggaggaaaaggaggcaaacgtgggctgnnnnatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctncctgagaagataaccggctcattcacttcctcccagaagacgcgtggtagcgagtaggcacaggcgtgcacctgctcccgaattactcaccgagacacacgggctgagcagacggccccgtggatggagacaaagagctnttntgaccatatccttcntaacacccgttggcatatcctatggcgcgatccatcgcgaacgtactgtcttacttcttgattatctagcgcacctagtggtagctatgcaatcac

SEQ ID NO: 572631 - DNA, 256 bp, Homo sapiens
  misc_feature (225)..(225): n is a, c, g, or t
gcgggatgcatgataatgtccccgacgtgtctgtcgatgatctttcgtcccaatgctccagattcatatacccatggcgcccattacgctggatcaattcacgatgtttaacagtgcatccctgcacgtcgcatttccacgctacgacgtcgctgttccaccgtatgatgtcgtctttccacgctagactgtcgactttccacgctagcacgtcgactttccacnaggggataccgagactcgacattcgataatc

SEQ ID NO: 572632 - DNA, 104 bp, Homo sapiens
acttccatatacacgcatctggcgtaccagggactcattggttccttcacgggcatccacttcacaggtgagggactgcacctgtctaacagatactcagtgaa

SEQ ID NO: 572633 - DNA, 534 bp, Homo sapiens
  misc_feature (204)..(204): n is a, c, g, or t
cagcgaccttgaacagctttttcatgcagtctcctcagaatgacgggccatggtagcgaggcaaggcccccgccaacatcgcggtaagtacctaacgcgaaagtagtagcctgacgcgaaagctgcgcatcttaaggacattgggcgccaaatcctcgataaaggccgacaacttgcatggccatggggcgccgccctgccgcnttcttgatgcagcgcaagccgtccgggtgggacggcagcggcgcgcgcccgctgcgaatggcgcccccatccacgtggctagaagctctcccaatcgccggtgctggtcttcgcggcgggcgtttcggcggccggcaggcgcacaacgggggtggcatggcgcaggccgatgcgctcggggctggcgtacggcttgcccccatggtgaggggggcggcgggctacgggggtgggtgccgtagcggccggtgctgcgcccggggcgagtttgaacacggccacggcctgcaccaggtcctgggcctgctggttcaggctggaggcggccgc

SEQ ID NO: 572634 - DNA, 378 bp, Homo sapiens
cgatgagtctcaagctgccgcccgtttgggactcatcgatgagtctcaagctgccgcccgtttggtgcgacgaacacgcggtgcagaaagcttgcgaccagcggtgcatgcggtgaggtcagtaaccgccaggcggggtgcctctcacgcaaggtggtcagggtggcatggtccatctcggtcaggcctggatgctagggaatctgttgcagtgagcacgatgcttgggcggcgcgtcttcccgtggtcgggtgctgtcagcgcaatgcggttgccagcgcttgcggtggtatcggctgtggctggctaaggcggtgccgcgggtgcgtctggtgtcgtgtgtctgccacaggacacgtgcagtgccgcaggccggat

SEQ ID NO: 572635 - DNA, 1096 bp, Homo sapiens
  misc_feature (387)..(387): n is a, c, g, or t
gtgtgtacagcttgttgtgttagttgggctaggttttacgtattagcgctactatcgcctggaatgagtgcgcgggtggtgtctcgtggtcgcgagcgtgtgtgtggtggggagaaaagccggcctgtgggagacagttttctcgccgcgactttgttttgcagcgggctgataataaagacttcgggtgcaacaattttggctcacagagttgttacatggggaaacaaccaccaggggtgtgttggcgaagaatttcgcgaattcgtctaaaccttagtatgggtgatatgtgaggtgtgtgttttttcttgcctctcgggggcatgtaatgtggggttgcatctgtaggtattatttggggatttttcaaaccataggatcccncccatctgccagattgagatcactttgttttctggttcaggaagtacgtgttcgtcagaggtaaagttttaaaagataattgggccaggtgtagaattgtagggcaccgtttgtctttttcttaagttctttattcgccaacttcttgtttgtatgagaaatcttaggccccccctatatttagtgctctgtaagtaacacagttctttccctcttttattcctctttaggatttcccttttaacacctggttttgatggatttgattaaggtgttccctctggtgaagattttcttcacagtttcttgttcttagaataatcataatttctgtaataatttgaagatttataggtttcccatggagcttctaaatctttcatcccagtatagttttaaataatactttgtctctcttctcccctacacgcccttcagggattccactttagccctatactggggggtttaaagttttgaatgctgatggtctttttaagttttcaagtcacatttgttactgtgtgtttcatttatgttagtttcaacttctattccttctagttcaataatcttctcttctgcacaatgtttaatcccctgccttcttccactttcacgactgtaaatcataactttttaatttgcagaaatttgatatttaaaaaattttcaacctcccccatttaattaaaataccattatacta

SEQ ID NO: 572636 - DNA, 609 bp, Homo sapiens
acctgcgaaaccgtctgtctgcaagcccattaagtccgtaacgcagatgtttgccagtttggacgttgtatactacgtccagtgaagtgtaccggtttcttagagctctatagatacctttgcatagctgctcatcagttacagactgtctactaatcagattctaatgcagagttcattaaaacacatagcatgcgtccggttttctggtatcgatgcttcctgtctactaagatcacaagtatgggctagtctaccaagctcagaatccaggtctccggtttcgcagtagtatgctgccatgtccgagtactgtgatcctatttcccagtcgtgtgcactctcctttgccagtactgtggactcgcatttcacagtcctgtgtgtcgtcatttataaggcctgcatgcccatttgcgagcactgtgctcccatttctcagtagtggactcgcgtttatcagcactgtgctcccgcttctcagaactgtgctctcgcttcccagtgctgtgctcccatttccctatactgtgctcccattttacagtgctgtgagccctcatttcccagtactgtgctcccatttcccactactgagctcccatttcc

SEQ ID NO: 572637 - DNA, 334 bp, Homo sapiens
gcccacatgagcagccattgtcggtcctcatgtccatattgttgaacagcagaggcgtacaggtcattcgccggtccgatcaaagctcactgactgctgcacatcaccattgcatgactcgcagcagtgtagtccatcagtaaggatccggcagcagtcgacaccgaccggtgcacgcgcccgtgcccaaggggccaggcccggagcagcctcagcgccaggggtccgcgctggttcgcagggcaggcccgggcgcgggagctgcgctctctggctgggccacttatcacgctcgcgcggttcacagtcctctgccccagtgccagcggcgccc

SEQ ID NO: 572638 - DNA, 331 bp, Homo sapiens
  misc_feature (127)..(127): n is a, c, g, or t
gctgccgcagcctcctgagaagttggaaccactgatgcgtgccgcgacacctggctaattttaaagaaatttttttgtggagacagggtctctcactgtgttgcccagggtggtctcaaactcctgntcttgggtgatccttccgtctcagcctcccaaagcactggagttacaggcatgagccactgtgtccagctcggctttaatttataaagttccaaggctctgttcccctacgctcaactgactcccttgcggtgttgggggtggcccctttccccaaaagactggagttgctttttctgacctgagcataacagaggccccagta

SEQ ID NO: 572639 - DNA, 809 bp, Homo sapiens
cacggctgcaaactgatctggcgcgcggggaggagtgagagctgcagtgcgagcgaacccgcgagagagggagagagcgagcgagcaacagcgagagcgagagcgagagagccgggagtgcagagtggagtagtgacctgccttcctggagcctgggattcatgcctgtcctcggtgaccagctgaagtgggactttacggctgagtatgagccaggctgctaggagccaggtacccccacgcctgcagtccccgcgcctgtgcccggaatgcgagctggacgcagtggctctcccaagttcccacctgatgccgaataaaaagcgtccagccctgcagctctccgccaaagactggacatttgactccaggactccacagaatggagcaagaatgagagtgaaaaatggcctggcagaaaagcatcgcaactggacggttttgtatgagcatcctctacttccttgttatatataggggccgtaatctcaggtgcaggccctcaccaccaggaacccagctgggacaggaccaaagatgtctccaaggaaatctgattggcatcatatcaggacacgggggccgtttccaccaagtccagagagctacctatcctttgtggaaagagacacgtcacaaggattgacaaacagatataagaatctacaagggagatcagagccgcgttcggaaaggcatgacggaacacaggccaatcgaagaggacgagatcctggacacagagcaaccagtgacccagtcatggcggagtaacaaagaggagcatccgcatgattgagagtgataac

SEQ ID NO: 572640 - DNA, 118 bp, Homo sapiens
tagaccagacccggcaatggagcgagactccccaccttctacaaataaaaagagggtaaaagtagccagatgtgatgacgtttgcctttagtcccagctactccagaggctgacgaag

SEQ ID NO: 572641 - DNA, 724 bp, Homo sapiens
  misc_feature (434)..(434): n is a, c, g, or t
gttcatagagccacgaccaactgggttggtatcatgggagcaaggggacgcacaataaacaacgtgagacagctgggacctgaggctggaagaaccccctcccctccccataacatgcccactgccccaaataaaaaaaaaaccaaatatgggtagagcatggcctaaacagaactaggggcaggtgaaagagacatggaactcgagggacagcggtgaatgagaccatgcgtgtgctgggagggcccacaggcagcggtgggacattaacagagcaggtacgatgctctctgtgtcttccccggggatgatgctataaaatagtagcatgagatgaggcctgtcctactgcctctggtctcccttgcagctcacgaactggctcaacagctgatctcctgctcctctttcgcatatcgatgaggcataaaagnggaaagagagaggtggacttgacacaatgatcgactacaaaccgagagatgcgtcttgcaacgacccgacggtacgagatctagaatctatcgcgagtgcttaatcgtcgctgatcaacgagaggaaatgcgacccaaggctgttccacgcatgaaaggtcgccattgagagaggatccgcttacttggcctcatagtacccttgaataagtggccagcactggccatagcgttgaacgccatgaatctgcatgcaaccaccccctcgcacatcgggatcatgatgaccc

SEQ ID NO: 572642 - DNA, 793 bp, Homo sapiens
  misc_feature (669)..(669): n is a, c, g, or t
  misc_feature (793)..(793): n is a, c, g, or t
ctttatttctacctaatttttctcttcttttttcttttaagtggagtttcactctcttgcccatgctggagtgcagtgagccaagattgcaccactgcactccagccgtgggggacaagagcgagacttcgcctcagaaaaaaaacaaaaataaataaataaacaattcggggatttgaagaacgcaggttcttctctgagaccacagtgagagcccacaaactcttctctcgagtgtccccccctcgagatattcctccatgatgagctcctcccgccagggggaccctcttgggccagttgtcctggagagaacattttgggaagcgtggcgcacactatcatctaagggggggcgggcgtggagaagactggcgtaccgtgggacatttcatagagggagaaatagagaggcgccacagtgagtgtcgctcgcgattaaccactatcctccaccacctttttgtttttttgagaataacgccgcccgaaaggaccacacccaatagagaaatttgcacccagggccccccaaagtgttgtcctaatgaagcgccacgcgagagggcgccccatagataaagcgccacagctttctttgtgtgtgtgcttaagagacacacagagagacagtagagcgagaaccaggagtgataacgccccgttagnagacatcgggttccggccatcctgtgtgtggcgtacccccccgcttgtggagagtgattgtgcgcctcttgcggtcccatactttgtttcttttgaggagacagatgtccctctcttatataan

SEQ ID NO: 572643 - DNA, 442 bp, Homo sapiens
tcatttgttacttcttatagcattcttatattcgtgagctgctgctgtttgtttagtgtgtactagagatagtgatcagggaactttagttggtgcatatatcctttctctgtagggcgtcttaggctatctagatatggaacatctaagcaagctgaagggagaagggggttcgcagaagtcacatcgtgtgcagggaacggtggacttagttagtcatgccgtactggagggggatcaactgcttgtacaattacgtttcacttttaattaattgtgcttaaggctttaattaaatttgggggttcccttcttagagcagctcgtactgacgaaggtgcatgcgctgaatgatgtcacggcagtcgttgaacacacggcggatattctcagtgtccacagcgcaggtgaaatgagggtagcagtagtgacgcccatctcc

SEQ ID NO: 572644 - DNA, 170 bp, Homo sapiens
aaacaccacatgctggtattcgatctgcatgcatgtttcttccgtatcacacttaaatcagaaagcaaaaattaaatactgctaagtatttgccacgaactcaaaggtgaataataagataaaattcagccaggtgctccagcagccaggttgtatgaaagcaagactgg

SEQ ID NO: 572645 - DNA, 310 bp, Homo sapiens
tctatcattatcattgcaggtttttggtttaagtccttaatcttgtcttgaattgatttttgtattacagtgtgacgatgaggatccaatttcattctcctacatgttggttagcccagttatcctagcaccaattgttgaaaagggtatcctttccccatttgttttctgttggcttcactgctacagtttctctgtcagctttgatgccttgagcttccaaagtcaattcttccagttctttcatgatatcatcttcatcaaagtcctgctttgtgtctcttttttattttacattatgtgatagcct

SEQ ID NO: 572646 - DNA, 293 bp, Homo sapiens
cacgaggtgtgtagactctcttggggcacaacgtcacagttctcacctacgtcattttgggcaactactcacagctcatacacatagaggccctcgattcagtgaggtacacctggatcatcaacaatggttatatgggtgggatacagttttacaccgccctcagcagctccacagggaaatgagtgtgatctctatgcatatcatacaacgggcaggatattggtggctctgcattacatcctcgtctgcatcattgggatctcgagaaaattactagccttgtcctccag

SEQ ID NO: 572647 - DNA, 844 bp, Homo sapiens
  misc_feature (77)..(82): n is a, c, g, or t
  misc_feature (84)..(86): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcattgccaccagcgctcacctcgcctgacttaaaaaaaagtttcgtacaacagacactccttgacaccaaggatctttcacttaatccctcaaaaataaagactcgagctgggtgcggtggctcacgcctgtaattccagcactttgggaggccgaggcaggtggatcacgaagtcaggagttcaagaccagcctgcacaaggtggtgaaaccccgtctctactaaaaatacaaaaattagctgggcatggtggtgggtgcctgtaatcccagctactccagaggctgaggcagagaattgcttgaaccctggaggtggaggttgagatcgcgccactgcactccaccctgggcgacagagcaagactccgtctcaaaaataaataaataaaaataaataagtaaataaaaaaaaa

SEQ ID NO: 572648 - DNA, 145 bp, Homo sapiens
  misc_feature (145)..(145): n is a, c, g, or t
ttccccgacgtggattggtcgtcgctctcgcagagccctgctccctgcagtacaagcggccccgggtcgggtgggaggaggggactccgggaggaggaacatgcggttggggacctcgctctcattcctgatgttggcttcgatn

SEQ ID NO: 572649 - DNA, 927 bp, Homo sapiens
  misc_feature (44)..(44): n is a, c, g, or t
  misc_feature (100)..(100): n is a, c, g, or t
  misc_feature (156)..(156): n is a, c, g, or t
  misc_feature (162)..(163): n is a, c, g, or t
  misc_feature (168)..(168): n is a, c, g, or t
  misc_feature (172)..(173): n is a, c, g, or t
  misc_feature (175)..(176): n is a, c, g, or t
  misc_feature (182)..(182): n is a, c, g, or t
  misc_feature (185)..(185): n is a, c, g, or t
  misc_feature (196)..(196): n is a, c, g, or t
  misc_feature (199)..(199): n is a, c, g, or t
  misc_feature (209)..(209): n is a, c, g, or t
  misc_feature (212)..(212): n is a, c, g, or t
  misc_feature (214)..(214): n is a, c, g, or t
  misc_feature (233)..(233): n is a, c, g, or t
  misc_feature (244)..(244): n is a, c, g, or t
  misc_feature (252)..(252): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (269)..(269): n is a, c, g, or t
  misc_feature (271)..(271): n is a, c, g, or t
  misc_feature (274)..(274): n is a, c, g, or t
  misc_feature (284)..(284): n is a, c, g, or t
  misc_feature (286)..(286): n is a, c, g, or t
  misc_feature (289)..(289): n is a, c, g, or t
  misc_feature (299)..(299): n is a, c, g, or t
  misc_feature (309)..(309): n is a, c, g, or t
  misc_feature (318)..(320): n is a, c, g, or t
  misc_feature (324)..(324): n is a, c, g, or t
  misc_feature (327)..(328): n is a, c, g, or t
  misc_feature (330)..(332): n is a, c, g, or t
  misc_feature (334)..(334): n is a, c, g, or t
  misc_feature (340)..(340): n is a, c, g, or t
  misc_feature (353)..(353): n is a, c, g, or t
  misc_feature (359)..(359): n is a, c, g, or t
  misc_feature (379)..(379): n is a, c, g, or t
  misc_feature (381)..(382): n is a, c, g, or t
  misc_feature (386)..(386): n is a, c, g, or t
  misc_feature (390)..(391): n is a, c, g, or t
  misc_feature (404)..(404): n is a, c, g, or t
  misc_feature (415)..(416): n is a, c, g, or t
  misc_feature (445)..(447): n is a, c, g, or t
  misc_feature (482)..(482): n is a, c, g, or t
  misc_feature (508)..(508): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (523)..(523): n is a, c, g, or t
  misc_feature (527)..(527): n is a, c, g, or t
  misc_feature (550)..(550): n is a, c, g, or t
  misc_feature (595)..(595): n is a, c, g, or t
  misc_feature (662)..(662): n is a, c, g, or t
  misc_feature (906)..(906): n is a, c, g, or t
aaaaaatttaacaagtttcacttagcaaaatacacccaaaaggnaatcacagtacaaagaaagttttaagtcaaggcctcaccaattcctacagtaaaantattgtgtctcaattctcaaaactaacttttaaaaagcttaaacttaacctaaagncttttnnatganaatnnannccagantgnccaaacatganccncccccccctnccncngggggctagcacctttgtnttttccaaatntgctcgtntccccggngngngcacngnggnggggggtaangngtncacatttaanatacttaagntggttgggnnngggnggnntnnntntggggngtgctgccggggngggggngggggggggggggggggggngnngggntggnnattatcacatgcnagaggggggtnntgggtgggagaacactgaggaggtaattnnntaatccagattttttacaaactcatggtgcaaaangggtcccccagcttcctctattaggncngcnctnaattgcntgtnggctgcctgtgaaaatgattgangtaactcaaatgttcctaacaaaactggtcatagccacccatgcngttctgcccactgtagccggccccgtaacagccactcactgactggctctccaggccactgtaagtntggggcaagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtnaatgtcgttctcggtcgcttt

SEQ ID NO: 572650 - DNA, 1034 bp, Homo sapiens
  misc_feature (668)..(668): n is a, c, g, or t
  misc_feature (718)..(718): n is a, c, g, or t
  misc_feature (860)..(860): n is a, c, g, or t
tggaaaaagtagttagcattaaaggaaactccctccatgtgtgggcttaaaggccaccagggacacagggcccccccaacattgcttgaattctttctcctgcagtctctttctggctgagaaaaattggggccttacacagatgagacagggctggctatggggagagctttccctattccccaagaaacttgtggtgatgtaaccgccggatgcggccaccaacatatcaaatggtatgggagacgaaggccccagagtctggggtgtttaacacgccacgcatattcaacccgcggtggtgcgtggtgctccacgtggcaccacaaaaatgtcacacaccaacatgtgtggtcacagagtgggtgtgagaccagtgtgtgtgggccacagaacgtctctcctggtgttcctctctcttgtataagtgtgccggtaaaactgtgtctttaacaaataaaccacaaaatctatattcccacacacagctgataacgctcgtgggtgtgcggttactcttgtgtgtcgcgagaccaatgtatgagaatcacgccgggtgtggtgagacatagacaagaaaccccaccccagagggactataataacagcgcagggcggagccggcgctctactctaaagagagattatatcaccctcgtagcgagagngggggcgcctacaagaggtctataaagcggcgtaacacccccgaggtctntatctcttgggtgacaccacagggtggggtcacctctataaaataaggggtgagagggctcgatgtaattatataaattaaagggcattagcggagcatctttgggtgcgcgtggctacgtgatgttttactaacacaaaantgtggttgcgttggtgtagcaacttggggggagacacaacaatgtttgggcgataaccggctattagcggggagaactcacttatgtgaggttacgacaaggtggggaaacccccttttatacctatttctcatgtgtgtgggtggtggttcggacctattattattgtggggg

SEQ ID NO: 572651 - DNA, 321 bp, Homo sapiens
gtggcttctctctgaaaacggcagatgtctctggatctcgagataaaacatcagctatggaataccctgggtgtgtgcaattacactggtcagggatgagagccactcagagtgggtgtcttgtgtccgcttctgcccaacagcagcaccctatatcgtcttcctgtggctggacaagctggtcaggtatggaacctggctaactgcaagctgaagaccaaccacattggccacacaggctatctgaacacggtgactgtctctccagatggatccctctgtgcttctggaggcaaggatggccaggccatgttatgggat

SEQ ID NO: 572652 - DNA, 152 bp, Homo sapiens
  misc_feature (2)..(2): n is a, c, g, or t
gnaccccatgaaggatccttggatctgtccagcgagatgggaaccgtgtcggtgggagtgcctgagggaactgcggtcctggccgactgccactccgacttcggtcgagtcgcaaccgacctgccccgccaggaccaccccgatgccctcga

SEQ ID NO: 572653 - DNA, 1296 bp, Homo sapiens
tggaccgcgggccccggctgggggccactgctgccaccgccgcgccacctcgtctcctccccgtcccagtacagtcacaggtctcacgaaacactcgagccgtggtgggtaataccaggggcacatgagggaatgccagaaagttgataggagcgagtaatgaggccggagcgcgtggaggatcagcaacaagatagcgtagaccagtgagtcgtgaacgaacgacgagagaggaaaataatcgaagcacctgagttgaaggaaagaaacgaaaaaagacacaagtgtgtgacagccaaatcacagcatgagatattgagaagaagcaaaagaaaatgggtgtgtagaggaagaagggagaagataacgaagtgagagcagaggaatgatatagatgaaggaagagatagagggataggaaaaggggatatagaataagtgagtagagggaggagagatgaagaggtggggagaagaagaaaagagaaacacagaaaggatagaggtagagagaagctggaaagatacgaatagtgacggagaaagataccgcggaacaacgcgcacggaagaacagggagagtgcgcaaaaaagccgaagacaagggagaggggaacaggaaccgaacaggaagagcaaagaaggcgagcaggagaagacacgagggaagacgaaaggaaaaaacgaaggacagcaaagcagagagaaaggagggcagagccggcgggggcagaagaaaggagagggcgaagcggagaagcagagagaacaagaagagcagcaagggagcgagaaaagagcacgccgcgcggagaaaaagggcaaaggcagaagaccgggggaaagagacgaggaaagaggagagaacaccgagagcaggggcgacgacaaggccagaaaaacaacgcgcaagcacgggagcagagaggaaacaggcaagagaaggcaaagaagcggaaaagaagaaggagagaagacaagaagagcgcaagagcaaaggaaaacacagaggagacgaaggcaggacgagagagagaaagcagaggaagaggacggaggagagagagaggggagaaagaagagaaaagcagagagagggaagcggacgggagagaggagaagaagcgagagaaagaagaagacaaacaggagagcgaaaaaagagagcgcgagaagacagagaaagaggaagggaaagggagaggagagaagcaagccagggaagaggcagaggggacgagagaagaggcgcgagagacagacgggagaacgaagagagagagaggcaagagagg

SEQ ID NO: 572654 - DNA, 100 bp, Homo sapiens
tatttctcaaatttgccctcctagctcatcccctctgacagatataatccgcccaatttggctccctacttccacagtttctcaggctcttggtattcag

SEQ ID NO: 572655 - DNA, 772 bp, Homo sapiens
  misc_feature (448)..(448): n is a, c, g, or t
aaatcatagtcaatggtgcctcaaacatagcaccttaagttaaaggctgctagtgctctagcggaaagcttagctgattatcttcctggatctactcacccccaaaaggcagaacaagcaacacagtgcactgggtggtggtcattttgtaattgtgaaagatacagttatatcatatatcatttgtaattgaagagcaaggtatatacgtcattatatgaatcacatttaacgacaatttcaaaattaaacccaagaagtagacatattctataatactaggtctatggtattattttccatagaactatattgcagagtaaatataccatataacatttcacacattgacaagatatcaatctcgagaagactacagaagaccatagtgtatatcctgtacacacggagtagaaacttgtctacctggtgggttttgggcacaaanggtaatacaaaacaaactggcttgcaggtatttgtgttgttgacaattacactacattcaatcattctgaggctaaccttctaaaatggtattcgagcgagtctgtggaacatgcggtaagtgggcccaaaagtaacaactatttgctcgacttgtgcttatttaattaaacacgtaacattttccgtcatataaggccacacctaggcgttctaggtaagtcacaggtggcttataatcttcacggagattttcattatggagctgggtggttaaaggatatggaaggagtttggtggctccactattgtggggaggggatat

SEQ ID NO: 572656 - DNA, 404 bp, Homo sapiens
atagaatttctgttatctcctttggaaaactgccccagactgggaatgcccaggctttcagagccatattttgtatatctgtgttcacagccacttacacagaaacatacatccacctccaatgtaaagtttaaccacatataggacatataagattcctgctttcacatcataaggtgaaagaaacctcggaaattctaaggtaaagtaatatgaactataatattttattgtgttggggactttattttgttatattttgcagttataaattatcaaaattaagtccatgtgcggtggctcacacctgtaatcccagcacattgggaggctgaggtgagaggatcacttgagcccaggagtttgtgaccggcctgggcaatatggcaaaaccccatctttac

SEQ ID NO: 572657 - DNA, 287 bp, Homo sapiens
tgagagaccgtgtgcaatggtcatgcctgttatcttagcacttggggaggcgagacaggcaagatcacttgaggtcaggagtttgagaccaacctggccagcatggtgaagcctcatcttactaaaagtacaaaaattagctgggcatggtggtaggcaccctgtaatcccagctactcaggaggctgaggcaggagaatttcttgaatccaggaggcaaaggttgcagtgagccgacattgcgctactggactccagcctgggcaacattgcaacagggtctctca

SEQ ID NO: 572658 - DNA, 172 bp, Homo sapiens
gatcgcgcctacgtatcggtactgggtttccctcacatgctcttcatgttgcatccgagtaccggcccaagagacctgccaaccagtttgtgcgcaggctctacggtattcaatgatccatccgtatggcctaccagtctgcagctccacagccgccagtcaacttcaacga

SEQ ID NO: 572659 - DNA, 302 bp, Homo sapiens
  misc_feature (23)..(23): n is a, c, g, or t
  misc_feature (120)..(120): n is a, c, g, or t
  misc_feature (149)..(149): n is a, c, g, or t
  misc_feature (180)..(180): n is a, c, g, or t
  misc_feature (194)..(195): n is a, c, g, or t
  misc_feature (218)..(218): n is a, c, g, or t
gcacgaggtgaagttgctcgcangggtcgttgggccctgtcgacctgtaggcgggcgagcgagccagcgggacaagactgcgggtgaggctgagctagcgagcggccggcagggggggcncccgggctgcgagccgctgagcccagccncgctgccgccgccggcgttcgtggggccganatgggcaaggcttnngtggcgcgggcctacggctgtgngctgccgggtagagtcctgtccccgcccctcgccttgcgcctgacgccggccgtgctgcccggggaccgagcggcgggcccttt

SEQ ID NO: 572660 - DNA, 303 bp, Homo sapiens
  misc_feature (34)..(34): n is a, c, g, or t
  misc_feature (64)..(64): n is a, c, g, or t
  misc_feature (67)..(67): n is a, c, g, or t
  misc_feature (75)..(75): n is a, c, g, or t
  misc_feature (98)..(98): n is a, c, g, or t
  misc_feature (101)..(101): n is a, c, g, or t
  misc_feature (109)..(110): n is a, c, g, or t
  misc_feature (124)..(124): n is a, c, g, or t
  misc_feature (136)..(136): n is a, c, g, or t
  misc_feature (145)..(145): n is a, c, g, or t
  misc_feature (150)..(151): n is a, c, g, or t
  misc_feature (168)..(168): n is a, c, g, or t
  misc_feature (171)..(171): n is a, c, g, or t
  misc_feature (177)..(177): n is a, c, g, or t
  misc_feature (199)..(199): n is a, c, g, or t
  misc_feature (202)..(202): n is a, c, g, or t
  misc_feature (297)..(297): n is a, c, g, or t
gctggggtggaagaactggaaagtgaaacaaganacctgccacgcaaaaaagttgaaggttgcnaanaatttatnctggaaactggcatttttccaanccnagagaagnncgaatggccttttncagctaactacnatgtgtagncaggnnttatattataaagtatncantcttancacctagtatatagttagtttntanagtgatttccccccagtttcttgaacatggtatcttcacatcttggaccttggtcagttgtgctattcattattaaacactaaaactttggcggntcttgc

SEQ ID NO: 572661 - DNA, 221 bp, Homo sapiens
ttaggcgactcccaagatggggacacagtgttcactgcatcatcttcctgcttggtgagaccgtgggcaggggacaaagaggaggcccagataatcaaccgtcttctgcttccaagctcacacggctgtctgctgtgcacacggggccgaccccagcagagtgcccagcccacgacgtccctcacccacattctgcctgaatgagctttaaacgtgcactt

SEQ ID NO: 572662 - DNA, 163 bp, Homo sapiens
aaaaaaaaattttgtgttattaacaaaaatttatatttggggtgggttaacggtatttcaaaaggtcatcagattgtgagactgcttccctgaaacatttttggggtattgttttaaaaaaaaaattaaaaaacagttggggttaataaaaatgtcaatgtga

SEQ ID NO: 572663 - DNA, 174 bp, Homo sapiens
tgtgtatctagcggatcttacgaggccagttcgctggggggcttaaggcagcaggtctcaaggaggctgcagtgctctgtgggctggcacagtttccgggacgagcacccgcttcagcagctgctggtccccctccgagtagccaggccagtccttctggcacatctcttgtac

SEQ ID NO: 572664 - DNA, 119 bp, Homo sapiens
cgagactacccgtgctgagacgccatattcttcgaagctatcgctatctgtatgcctgtcacatacctcaagctcatcacattcagaacaaaattcttcttcctcaagccagtagtggg

SEQ ID NO: 572665 - DNA, 774 bp, Homo sapiens
ctgagcccagccagaccccgcgccgcccgcgccccgctcgactccggaggctcccgcagccccgagcgtccagcaccgttgacgctcctctcccacggtgggccatgtggggcgccccctgggctactggccctcgacttgaggtgcactcgtccatccacctagcatgccccgtcgccagacttccatgctcgcgcccggtgcccagcgatattctgcgccccgacagtagcacggaagtaccagtcaggccttgatttgctggatggcggccttggctgggcctgggcttgggcctgagcctcattttcatctgctgtctacctcatccgcttctgctgctgccggcccccgagccccccgggtccaagatcccctcgcccagggggaggctgcgtcacctggagctgcattgtcgaccttctcgccggatgcaactggcattggcaatcggatttactatggacaacaagtgagaccagtgatggggatgtcaccagctcagcatctgcgctgcatgcaccgccaagccacacacatcagcaaccaattgaccaaccctggtggatggagacaggtggaacaaggctgacgcgagagcaggtgaggaccaaagcttgaccaaaccttggaagaggtgctcgaaccgagcacggtagcatgaatggcatgcacgaacacgatgggactcgaatgagaaaggcgaaggcctgaagcaccaacagataaaaaaggcatggacattcatacaaaggagtgcaccctgaaccacaa

SEQ ID NO: 572666 - DNA, 141 bp, Homo sapiens
gcgggttacgctgggcaggctgactgtgggaagatcgctattatggcccaaaaccgtcaaggttgcagtgagctgaaatcgcaccactgcactccagcctgtggtgacaaatgtgagaccctagtctcaacaaaaaaaaaa

SEQ ID NO: 572667 - DNA, 129 bp, Homo sapiens
agtcccagtgtggcctggcacccaccatgtaatgtggtcaaggcactatctgccctgtcaacgagatcctttggcttcaccgactgaccatgaggtccaactacgggctggccacggctgattccccca

SEQ ID NO: 572668 - DNA, 260 bp, Homo sapiens
acttagaggatccccttcaaatgcgccagaagttatactctcaattttggcgggatgaggtgagtgtaacagctttatagagatatattcctgtaccatacgattcacttaaagtgtacaagtcagtggttcacagtttattcactaaattgtgcaactctcacctgataaattttagaactttctcttgccttcgaaaactcttttcttcaagaacaccctttgactgtcataccctgaatatatctgtgcccattgca

SEQ ID NO: 572669 - DNA, 182 bp, Homo sapiens
caagtgtgtctctggccaggaggagctgacgttctgcaggacattggtcctgcccgcggccagtccactccgcggggatttctctggatacggacctcctctacagtggtgcggtcacagccccttggagccctccctcttcccacccctcctgttcccgggtctcctttggcctgggatac

SEQ ID NO: 572670 - DNA, 363 bp, Homo sapiens
  misc_feature (44)..(44): n is a, c, g, or t
  misc_feature (104)..(105): n is a, c, g, or t
  misc_feature (179)..(179): n is a, c, g, or t
  misc_feature (262)..(262): n is a, c, g, or t
  misc_feature (319)..(319): n is a, c, g, or t
  misc_feature (341)..(341): n is a, c, g, or t
tgcagtgatgcaatttcggctcattgcaagctccgcctcccggnttcacgccgttctcctgcctcagcctcccgagtggctgggactacaggcgccctccaccnntcccggcccgtttacatcttaagacaagatctcactccttacaacaattctgaggcaggtacttcctacaggtnaagaaaccgagactgagacttggccaaggcaaccgagctaatcatagttcccccaagaaagggcgacctcggcaagcaagttnacctccgtattccgatcacctgggcacatagtagccgcccaaatggcaaccctgggnatttgaacccagggtagttggntcagcgggcaattcaccattcg

SEQ ID NO: 572671 - DNA, 411 bp, Homo sapiens
gcatagaaaataacaccccaattaggagggactggacaccaagaggaatcacccagataaatccccatagaagtcccactcctaaacacatccgtattactcgcctcaggagtctcaatcccctgagctcaccatagtctaatagaaaacaaccgaaaccaaataattcaagcactgcttattacaattttactgggtctctattataccctcctacaagcctcagagtacttcgagtctccctacaccatatccgaaggcatctgcggctccacatatatagtaaccacaggcttccacggacttcacgtcattctaggctccactttcctcactatctgcttcatccgccaactaatctttcactttacatccaaacatcactttggcttcgaagccgccgcctgatac

SEQ ID NO: 572672 - DNA, 613 bp, Homo sapiens
gcctgaggagtaagcggctggatgtggaccctgagagccactggcaggtaggtggggtcttccagttgtgaagacaccgtggccccggtgccctacgagacgctgaacaaacgctttcgccgccgctcagaagaacattgaccgggagaccagccacgtcaccatggtggtggccgagctggagaagacgttgagcggctgcccggcgtggactccggggtcagcctgctggacggcgtggatggagaagctcagcgtcctcaagaggaaggcggtggaaatccatccaggccgaggacgaggagcggccaggctggtgcacaagcgccggatcgagcacctcaaagaagcatagcagggaacagcccgcggcggcagcgtggtggaagaaggaatgcgcatggatcgcctgatggtggagcactgctgcggtgcaggatactacaacacggctggtcaaggctggctgcgcaaagcgggaatcgaggacctagtgaatattgagatgttcctgacgggcaacagacggtggatgagtccctggagaggcgttgagacgggcacctgccttggcctgggtgccatgacaacaagttcacggctccgagaaatc

SEQ ID NO: 572673 - DNA, 438 bp, Homo sapiens
tgagcatctcaggcatagctggatctgataacccttatgtccaaaaccatagatggtcaaatactgctttggttgttaggtgtaaataccagaaatttgttcttaccacttttcctattgctaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaagtatgtattgcatttttcttcctctcatctatttaatatattctttatcacacaaagatgtataaagaataatacggattttttgttgtaatatctcatacatttcactcatctgtatatgaaaatatacagcaatgaaaaggtaaaa

SEQ ID NO: 572674 - DNA, 387 bp, Homo sapiens
aggaggaggaggggggcgaggaggaggcgcgggaggagcccctcaagagctccaagaacgcagagcccgtgggcaacagaggagaaggagctggagcttagtgacttgtgatgacttctgacccgctggaagctagagcctgcctggctgttgcgagctgaatgcctgcccattccagctccctgtgactggctggtctaggagctgcagtccctcgcctgctgcctcgacggccgcggtcaagggaggccatcaggcagcagctcctgcgatgtctctggcacgcggcgtggcggcagctgctctggaacgaggacgctggagacgggcccaggacgctgtctccgcagctgcggcggccgggccggagccactgccgggcgcaga

SEQ ID NO: 572675 - DNA, 267 bp, Homo sapiens
ttatcgtgttgcactgccgtcgcagttacttgggaagctgagatgtgaggattgcttgagcctgggaggctgaggctgtggtgagccaagatcatgccactgcaccacagcctgggtgacagagggagaccctgtctcaaaaaagaaaaagaaagagagaagagaagagaacgtgtgtgtgtgtgtgtgtgtgtgtgtgtgtgtatgtgtgtgtgtgtgtgtgtaaggggcgggtatatatagatagagaaactcacttagaagtca

SEQ ID NO: 572676 - DNA, 143 bp, Homo sapiens
gaattacgggagggctttctctgtgccggtcacttgcacaggcatctcagtcatttacagcccataggaaaatataatcacctccgttttacggatgaggaactggaggtttaccgagcttaagtaacttgggccttatcgag

SEQ ID NO: 572677 - DNA, 267 bp, Homo sapiens
  misc_feature (170)..(170): n is a, c, g, or t
  misc_feature (247)..(247): n is a, c, g, or t
  misc_feature (253)..(253): n is a, c, g, or t
aaaaacagagttagtattcaaacatgggcatcagactccactagaaacattaaataacttgccagtgttaatacggctagtaaaaaacagagttagtattcaaacatgggcatcagactccactagaggcattaaataacttgccagtgttaatacggctagtgaaaaancagagttagtattcaaacatgggcatcagactccactagagacattaaataacttgccagtgttaatacagctagtnaaaaancagagttagtattc

SEQ ID NO: 572678 - DNA, 366 bp, Homo sapiens
cgctagtggtactcatgcgatagttttcttttagttttttgcttttggaatactaggaattctttctaagtagcctcatttgatagctgttaattttatacaattataaaatatttttttctagggccaggcatggtgactcatgcctgtaatcccaggacttggggaggccaaggctggtggcgtctcttgagcccaggagttccagaccagcctggggcaatatggagaaacctcattcctactaaaaatacagaaaatgggtgggggcatggtggtgcgcgcctgtagtcccagctactcagtaggctgaggtgggaggatcgcctgagcctgggacttagaggccgcaatgagtacagatta

SEQ ID NO: 572679 - DNA, 135 bp, Homo sapiens
actctagaggctcccaaagtattcggcctatcccccctcgaggatatcgcggtggattcagagagaggtcgtagagggccgggacgtatagcggataatgaatatagagaaaaccacagctctttggaccctaaa

SEQ ID NO: 572680 - DNA, 495 bp, Homo sapiens
  misc_feature (350)..(350): n is a, c, g, or t
ctcgaggccaagaattcgctgaccaacctgacattggcgcagctgtactacaagcgccgcgaatattcgcgtgccatgccgtttatcgagcgtgtgaatggccgcggcaatccgacggcagaaagcctatggctgggcgcgcgcatcgcacggcgcctcggcgacacttcgcagcagaacgcatggagcgcgcaattgcagcgccgcttccccaatgcgcccgaagaggcggcattcgaacgaggagcctgggatgactgaccgcgacgtggcaagcgctgccgatttttctcatggcgcggcgcctgtctcgaatccgcctgccgccccttcgtcggagcgcgacgatncgctgcgcgagattgccgaacgcctgcgtgccggccgtgagcgtcaacggctgactgtcgacgatctggccacgcgcctgaaggtggcgccgggcaagttgttggcggtggaatcggcggatgtcagtgcgttgcctgacatgac

SEQ ID NO: 572681 - DNA, 125 bp, Homo sapiens
  misc_feature (6)..(6): n is a, c, g, or t
catcancagttggcagtgttggggttgttggctacttaccccattgtccaacactttgcagtgtcaggtggcagccacgtcccagtgcctgcgcatgcaggcacatcgtgggcgtcctgctagtc

SEQ ID NO: 572682 - DNA, 265 bp, Homo sapiens
cacgattagtgttgtctgtagtagcaacctactactctactatagcacccacaacggtgctgtccaataagtgcaactcaatgtcagtgacagcaaagattacggtgcagattccaccttctcagtccacacctgtcaaaccagttcctgcaacaactgcagttcaaaatgttctgattaatccttcattgattgggcccaaaatattcttattaccaccaacatggtttcgtcacagaacacagccattgaggcaaacccactg

SEQ ID NO: 572683 - DNA, 969 bp, Homo sapiens
  misc_feature (196)..(196): n is a, c, g, or t
tggactcctcttccaggttccatgccgtgaactgtctggccccgtgatctgcgagcgatttatctgatgtgtccaaatcggggcatgatgtgcccgtgcttcctggaagctacgggagagtcgtctcactctatcagctacatcgctctgacaagcgtgcatggtaacatgtgagtgactcactgattgcgctganatgggacggcacttggccggctcgtgttgagccatttggtaagtgcgatcccggccctacttcacttgtagagatatttccatacgatctatcaagccagaccggattgagggaccctcttatgtacaattcatttcccggtgtgtacctgcactaactgataactcaacgtatggcgcacgccacctccacagtaaaccctcggttattcgcttatgaaacatgaactttgcgaagacgcgtttgacaagaacctcgagagggcgccctcccgtgaacctaggctatgggagagagtggaggaagctcatggcggtgtgagtgacttgggtgcacaaggtcgccccaaattcccgtattccaacgtgggcacctccctttgtaatctccccattacaatcgcaaggaaacttcgtggggtgccctttcataataattatacccggaaggatactttaggaggaacttcggacattttgtggaccttgcacttgcgccttgtggggttatgtgcgcaggcgattgttctttctgtggaccccaacctccttgcaggatatttagcatagttaactccacttacttttgactttttaacactttccttctcctagcgcagaattcccttgcaatagcaacatgctaactttttggtaggagggttattccgatccacccctttagagtactggcccacggtagaaagagcttatttattagcgccatatgaaacaactgagcaacacttaggaatttatataagggccctgtac

SEQ ID NO: 572684 - DNA, 695 bp, Homo sapiens
tgatgatggcattcctccaagatgcagagtctgagggctcagaagtacctggttagtcttgagtacttgcttctcaatggccagactggcatgcagtctgtccaagtctttttaactttgcctggcacttattttcagagcccagggcttgtagttagtatttgtctgattaacgatgaggttggttaagagttagaatggggagggtgggaagtaagtgatttaacttgaggcttgaacctggaagttcatctagaaatagacataaacattgcccagggaaagtatcaccaatgtggattttcgtatctttcaaggctactgagctgtcatgactttgtcattactcttttctggcccttttagaaatgtactgaggttgactgtttttttgcacatcttcctgttttgacatacccacggtatgcattctgccaggttcatctttatagcctctgaccctggcccagagccgcctagctaaccattcacgggcacatttcttggttcttgattacctctttccactaagtccaccacccattcatgtgcctataacttctaaggtggacccagctggattgtcatgcccaaccgcctctgctcggtctagacccttgcttacatatcttttctttcgaccccttggctccagccagcactcctatcctctctcttcctctctcacctattcc

SEQ ID NO: 572685 - DNA, 162 bp, Homo sapiens
ggagctgggggaaggggacagtaccgtgaaggcagataaaggggcagcagctccaggttttctgcccccccatcccccctgggttttttcccaagcccaaaagccctggcaaactttaccttttaaaaaagggagaaagggagaaaaaaagccactttaggg

SEQ ID NO: 572686 - DNA, 208 bp, Homo sapiens
gagtcttgatgttgccttctgccaggcgtgtcggacatcttctggtgggcactgtgcggaacacttgcaggatgaaatcagttgagctgcactgcactttaaccggcatggcctgtctcctcacattgagtgcaaggttccactcgaccacaagccctgattctgactcaattaactcactgtacatgccagggagtaccgagcctcg

SEQ ID NO: 572687 - DNA, 177 bp, Homo sapiens
cccagaatccccgaccccctatgtcaattctcctgctgatgcaccacctggctccttctctgcagcattcatcatggttttgtttatcctgatttgtgcaattacatgcacaagggttacctatccgtagggtaaccatacaattcatctttcaaatcagaacaattttgagagaga

SEQ ID NO: 572688 - DNA, 135 bp, Homo sapiens
  misc_feature (2)..(2): n is a, c, g, or t
  misc_feature (10)..(10): n is a, c, g, or t
tnagcatttncagcagcgacctctgttctacagccctatccctttctattcctctgaccctgcctcctttctaaatgcagcgactctgttcttcacccctatccctttctattcctctgaccccgcctcctttct

SEQ ID NO: 572689 - DNA, 612 bp, Homo sapiens
attcatatgtagtagggaatattagctgactgaaaccttttgaagttgttccaaaatcaaatgtgatagttccgttacagaaggttttactgaatagggtggaggtgctaattaattgaggcctgaagtaggagggaacagcttattacagatcttaatgtgtccacacagaggtattatttatgggtttcaacaatcctttctcaaggtgtagttagaaaaaataagttcactatatttaacacaaagatgatgttgcaaagtctctttcatgaggaagaagagcaagtggaaagctttatatgaaatcttcaaccataattagagaggtaataataaaattctcactgaatacataggaggagataccagttcaataataattacatagtgtgtcttagtaacactctacaatcactaattaaataatccaaatatctttcctatgaagtagggtgagtatagtcaatcttgtttggtcaatgagaaaataaaatgcagagtggttccatgacctgcccaaagtcatacaagtgagttatggcaaattgagattagaatccacagctctgattcttttattcctagaaatcattaatcttctctatccca

SEQ ID NO: 572690 - DNA, 314 bp, Homo sapiens
ccttcccagcagagggcagtacagtgtcttgtcccagcagaaaaggtccttcaggccacccctctaaacacaggagccaagggtgttgacagagggcaccttgcacccccagactctatgcttatagtgtctgatgaagagcggagcaggatgatcatgagtgctgctctagaggcgcaagcagcatcgagacctgtgcagccaggagcggaagttcatgttctgcagggcgcccagcccactgtgcccccagccgtcacttcttctgcacgtggccacagtcgtacttgccacgcacaacggtgactggacgc

SEQ ID NO: 572691 - DNA, 854 bp, Homo sapiens
ctagcgctgctgtgcgtggcctgcgcgctggcgctgggggcgcccaatacgaacgctacagtttccgagtttcccacgggacgagctgatgccgctcgatttggcctacctggcacgcggctggccctgtacagcggcggagcacttgggccgagagcgtgggctacctggagatcagcctgcgggttgcacctgttttgcttgcgccggacaggggaggggtccctttcttgcccacccgtgaattttgaggcggcccggttcccggatgccctggaagccccgtgtccgtgcctcgtgggcgttcgcacaaggtttattccccggaaggctttgccgcctttcttacggggggggcctttgatttgccagccgggtggccggccatgttggccgtctccaagtgcggcctaggcaacaaggcgagtgggcgcccttggccaagggctgttttttcccgagggcccggagggtttccccccagaggccctccagaagttgctcccgcggaggggatgtttcggctgtaggagcgcgagccgggaacctttttttccgcagcaagcggtgctgccccacaaggagatgaagagccccctagtctgaaacaagaggggttttcccgcctctgtagacaagagtaattacgcacggggagtattatacagacggttttttcaaccagaaggggtgggcgggccgagaatacattattataaaatgcttctgctttgccggcgccaacacgaaaaataatcgggcgccacataagatttccgacgcggcccaggtggatattggacctctacaagaacgacacgccgctatgattatattatcgacgcactaatacg

SEQ ID NO: 572692 - DNA, 101 bp, Homo sapiens
gctgcaggtatggttgaagaatagcacacaccatgctagattggattcactattattttatattatacttacttatagagacaaggtatatgctctgtcac

SEQ ID NO: 572693 - DNA, 1317 bp, Homo sapiens
ttactctttcaagtggttaccattgacttaacctattgagttacctggtcagacactgtgatcttatataattctctccaaaggacctgcgttggacaacaataacgaacaatttaacctatcatgcactgtacacatttcctgtatcataagtacggcgattatacataacccgcaaccaccagtgtccttgtgtatatgatgcagcagccactacaatgtaagcttatcatatcataagatactgggtcatttccagtcacattctggacacatacacgcgatatacatctccatggaggacaccacattactttaccatatctcgtgtgcccccaaacgattggcggctggtaagcacattatctagcaaaacatgtactcctatgacaaggtttcatcaagtaccttgaaatggaggtttgaattctgaccatcttaactaccctgtagccaccgactcttccacactaacacacatgcatagcacaccagacaagagtaagggcaaccccataggaggatcagggcaacaactccaagcaacacggccaggacgtaacccacaacacaagttgccacaaacaaaaacaccagcatcccgtggcacactcaacggtgcactagacacaaaacgtaataacacataacgcaataccatcagagccacgacagcgacagcacaatggacagctaacacaaaaaattctaacaaggacgttgtcactacacaccagtggctcactgcaggaagacacgaacgcagctctaacacacttatcacacaccagtgcactcttgtgaagaacgaacgatcggggcgcaacgtcataccttcgaatgcacatacccttggctacggacagtggactctggcctaggaagaggcccacccatcacaaatgtgtatcaattagacaacaccaccggacacacccagtgaacacgcataaacccccactgcgacacacccaacacaaacatgtggcaacaacacaggcaaaacagacaccacgaaacgaacgcacaagagggacaaacaagggcgagaggcatacgctcaactgggaaggcacaaacgaaccagaaccgtgacacaactagcgcaacacggacacgagaccaatagcaccgacaagatagataggacgcaaggaacagacacatacagacccagcaacacacaagacaacaactacaaaacgagcaggaaagcacaccacacaaagtagaaagtgaccgcaaccacagaggaggaacacaacacacaacgacgaggacgagacacacagaagagatcaaccgtacgctatgcac

SEQ ID NO: 572694 - DNA, 1726 bp, Homo sapiens
cgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaacatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagtcgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctct

SEQ ID NO: 572695 - DNA, 1223 bp, Homo sapiens
  misc_feature (43)..(43): n is a, c, g, or t
acgtggaggggaggcagccacagtcctggagaggcctgggccngaacaacatggcttcccccagcgtgagactcgcttgtcctcccaccgcctgctctctcctgatgaccaggttccaggagttatcaaagaacagcctctgagctgcgtggagaaagccatggagacagccagaagaaaacggcaggattagattaacctgtgattcctggctggccacgaggtcacccatggcatggagctgcccacaacgcccttctcagcatgaagcatcctgaaagatccagggccaggttccccaggattggggagttggaagctcattggcactgtcaaatttgaagaagaggcgtgctctgactgcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtgagtccccgccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacagagcggttgcctctctcattaattaattaattagttaataaaattaaccccatgtttacattctta

SEQ ID NO: 572696 - DNA, 500 bp, Homo sapiens
aagaaagagaactctctgcccccaggattggaggctgcagtaagccaaggtcgagccactgcactccagcctgggtgacagagtgagactttttctcaaaaaaaaaaaaaaggcaaaaaaacaaacctccattgccagtgtacaattaaaaaaataaaacaaagggaaccataaaccgctcctaagggaaaaaaaaaaggagtggaggagcgaacattgccgcttcctccagccaagcagacgtttccgtgtttcttctctctctctccttcccaaattcacccacaaacgccatcgacccccttctggttcccattacagaggccacagttcaggcccccctcgcttcactcgatttactgtcaaatgcctcccgcggggttccccgtggattctctcccaaagccagggggctcccctagttgcagcctgacattttttacaaaagcacaaaaacctcattgcccacctgaaataatttctttacatgatgctttacc

SEQ ID NO: 572697 - DNA, 1274 bp, Homo sapiens
  misc_feature (76)..(77): n is a, c, g, or t
  misc_feature (121)..(121): n is a, c, g, or t
gcacgatagatttgaatttgcatagaatttgaatttgtattatatttctgtcagcagtgccagtcaaaggtatgtnntagatgctgaatggatgacaagaccaagcctggaagagtggatntctctgtctcaattccagtgagggccaaaaaagaagtttccccaccactgtcagcctctgggaattctgtggtgactcattcattggcttttctcttccttccggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccagggactcctgccccagctgctgaagagacaatgaccaccagcccggggactcctgccccagctgctgaagagacaatgaccaccagcccggggactcctgccccagctgctgaagagacaatgaccaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggcagggggcagtcggctcctcaactgggtgacaagggtgaggatgagaagtggtcacgggatttattcagccttggtcagagcagaacacagagattttc

SEQ ID NO: 572698 - DNA, 631 bp, Homo sapiens
  misc_feature (27)..(27): n is a, c, g, or t
  misc_feature (138)..(138): n is a, c, g, or t
  misc_feature (145)..(145): n is a, c, g, or t
  misc_feature (244)..(244): n is a, c, g, or t
  misc_feature (253)..(253): n is a, c, g, or t
  misc_feature (327)..(327): n is a, c, g, or t
  misc_feature (334)..(334): n is a, c, g, or t
  misc_feature (339)..(339): n is a, c, g, or t
  misc_feature (348)..(348): n is a, c, g, or t
  misc_feature (364)..(364): n is a, c, g, or t
  misc_feature (409)..(409): n is a, c, g, or t
  misc_feature (411)..(411): n is a, c, g, or t
  misc_feature (433)..(433): n is a, c, g, or t
  misc_feature (564)..(564): n is a, c, g, or t
  misc_feature (573)..(573): n is a, c, g, or t
  misc_feature (627)..(627): n is a, c, g, or t
aaaccttaaaaactatcataatagtangaatgcatgttaagatttgataactttctttagctagagttttcaacccacagttaggagcaaagttgtaaagtgagtaggtgtgaagaagggacactcttttgagaaaanatattanctacttctaaaatgattcaattattttccctattttcattttccataatatttcctcctgttttatacctctaactaccctcctgatttctctgatgtnaaaaacagnatataagagcaggatcaaaaaaaagcagagacttatcactttagccttttagaaatactgttttgtagcagatnacctcanattanacttccgangtttcatcacccttgnagaatattgtgtttactgccctgtagcagtaattagtatgctttnangcatctctgtagctgattatantagtagtcataaatcagtcttccattttgcactactatactactctcagtgtcccagtcacgtctagtttctgtgtcatattagtgtgcagcagtatctgtacatctcatgctcacattactgtgctgagnctttcggtntgtgtgacgatgataataatactgactcactctgcgatctcacacacacacatngtga

SEQ ID NO: 572699 - DNA, 981 bp, Homo sapiens
  misc_feature (333)..(333): n is a, c, g, or t
gcatattacaaggggtgtgatacgtgcgatatttgtgtgtaacaaatgctctggttaagttgtaaatgcgtggcatgttgtagatacggcggcatacacaatcatcatataccgggggtgattacacccacttatgttggagtattaaatgcgacaaccgcggttttcccacacagcaccttgttggggggcgccccccctaaagaagtaggggcccgctattatgttgtcaaaaggaaattgctgcggggtccgatgcgtcccgacgtggtatgtttgcccgacacgcccttttgggggcctgcggcgcaatgtccaccacacattggtggngagcaccaacgccacgccgacataaattagctcggggagaaatggtggaccacccctgcgatttttgctcaagtacttaaagaagaacatggggccgcaaattttctgttagcagggaaaaaataaatgtggcaggcggtttacaactctggtatgactgtgtggagagacacacaccgtggtcgtgtgtttgtccggagcctcccgacggccctggttttttatataaagagggttggtcccccaagaaacacattttgcgcgcagaatggctggtccccccgcggcgatatgcgccgcaccataggtgttcgcgccgccgccgacgactctatcattaagaagggaccaccccccccggcggcacacacacacgggggagaaccccccgtttgcacccgaaaagaaaccccccacaaacaatttgtcccggcgacctctggggggggacacaccacccccgttgagccggcacagctcctgccggcgcgggtcagacgcaagaactaggaagtgcattgccccggtgaaaagacatcgggcgcgacgcggcacccagagtcagacactcccgctcgacctccccccccgtgctggcctcccagaggaaccccgtttccaacaaacaacataccaaacaaacatacg

SEQ ID NO: 572700 - DNA, 479 bp, Homo sapiens
  misc_feature (43)..(43): n is a, c, g, or t
  misc_feature (339)..(340): n is a, c, g, or t
acgtggaggggaggcagccacagtcctggagaggcctgggccngaacaacatggcttcccccagcgtgagactcgcttgtcctcccaccgcctgctctctcctgatgaccaggttccaggagttatcaaagaacagcctctgagctgcgtggagaaagccatggagacagccagaagaaaacggcaggattagattaacctgtgattcctggctggccacgaggtcacccatggcatggagctgcccacaacgcccttctcagcatgaagcatcctgaaagatccagggccaggttccccaggattggggagttgacgacacagcagtagaactgatcnnctatctttgcaacgagtgtgttgttaacatcaagcataagaagacagtaataggggtaaaatcctgaggtgatcagcccacattgaaatgtgaccctcagagtagaagcgtatgtgtggtggactgaggtgatagagga

SEQ ID NO: 572701 - DNA, 1987 bp, Homo sapiens
  misc_feature (43)..(43): n is a, c, g, or t
acgtggaggggaggcagccacagtcctggagaggcctgggccngaacaacatggcttcccccagcgtgagactcgcttgtcctcccaccgcctgctctctcctgatgaccaggttccaggagttatcaaagaacagcctctgagctgcgtggagaaagccatggagacagccagaagaaaacggcaggattagattaacctgtgattcctggctggccacgaggtcacccatggcatggagctgcccacaacgcccttctcagcatgaagcatcctgaaagatccagggccaggttccccaggattggggagttggaagctcattggcactgtcaaatttgaagaagaggcgtgctctgactgcctggacaggacccggaatcaaaccgcaggccctgggtcaccgctgccggaaagagccagttcctgtccgtccatgcacccaccaccaaaacccaggccttcctggaggtgctaggggaggccatgccccttttctgagtgcttggaagtgactgctgcaagtgacaagtgaccacgccttttcccccgcgggtataaattcagaggcgctgcgctccgattctggcagtgcagctgtgggaacctctccacgcgcacgaactcagccaacgatttctgatagatttttgggagtttgaccagagatgcaaggggtgaaggagcgcttcctaccgttagggaactctggggacagagcgccccggccgcctgatggccgaggcagggtgcgacccaggacccaggacggcgtcgggaaccataccatggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccagggactcctgccccagctgctgaagagacaatgaccaccagcccggggactcctgccccagctgctgaagagacaatgaccaccagcccggggactcctgccccagctgctgaagagacaatgaccaccagcccggggactcctgcctcttctcattacctctcatgcaccatcgtagggatcatagttctaattgtgcttctgattgtgtttgtttgaaagacttcactgtggaagaaattccttccttacctgaaaggttcaggtaggcgctggctgagggcggggggcgctggacactctctgccctgcctccctctgctgtgttcccacagacagaaacgcctgcccctgccccaagtcctggtgtctccagcctggctctatcttcctccttgtgatcgtcccatccccacatcccgtgcaccccccaggaccctggtctcatcagtccctctcctggagctgggggtccacacatctcccagccaagtccaagagggcagggccagttcctcccatcttcaggcccagccaggcagggggcagtcggctcctcaactgggtgacaagggtgaggatgagaagtggtcacgggatttattcagccttggtcagagcagaacacagagattttc

SEQ ID NO: 572702 - DNA, 104 bp, Homo sapiens
tcaagcttctaacgatgtacggggacatggagacttattgttctaatatttctacttttgtatgtgtttgaaatttcaataataaaatgtttaaaatcaaaaaa

SEQ ID NO: 572703 - DNA, 244 bp, Homo sapiens
tcagtcggtaccagtgctactccacaaacagacatacacagacacacacacagaacacaatcacacacatcctccccgccacagagacacaccattacatacacagacacacacacacacacaatcacacacacaccccccgccactagagacacaccgttacatacacagacatacacacacacacagacatacacagacacacacattccactggctatacactgtttgtggatgtagcact

SEQ ID NO: 572704 - DNA, 192 bp, Homo sapiens
gcctatgtttaccttcacttccactctttattcttcccactccgtcctaaccctactccgtaatcacataacctatgtcctccaagacattctcatttcacaatatatactccaacgaacaatgttctactcggtatctactatctgattcaacgcctattttacactaatccctgttcggttgagcgtaga

SEQ ID NO: 572705 - DNA, 428 bp, Homo sapiens
  misc_feature (61)..(61): n is a, c, g, or t
  misc_feature (117)..(117): n is a, c, g, or t
aacgcgctgatacctcattagacatgaaagaactgaaacttagagtagttagcgacttgtntaggtcacactgtttattaaaaaggtgaagccagcacatggtaacagcactggggnccacgcagaccccaagacaccccaggcagctgggatttcaaacagactgtcccattgtcaaacatttggtttgaaataaaaggactcttagtataactctgggccagaggggaagaaggggtgagggcagctagcgtggcaccctgggtccaactccaaccccttctgttgccagcaatgtgaccaaatacttacacctcccagcaagtttctgtttctttaatgtaaatgtaagccctaccccatgggacagagagttcagtcctcacgggtagggcttacatttacattaaagaaacagaaacttgctg

SEQ ID NO: 572706 - DNA, 268 bp, Homo sapiens
ggatcttagttctacaccacccccaccaggactggataatcagaatgacagacggtgacactgtgggcaaggcatgtggagaaattggggccctcgaacacaggctggcaggacggtgacgtagggaccagcttgctctagcaacgaacagctatggcagcctcctgggaaactgtcacacaataaattcacaacttgcaccccagccaattaccactacctgcggtaatctgcccaacgagcaaatgaacaacatccaatccagcac

SEQ ID NO: 572707 - DNA, 399 bp, Homo sapiens
gaccagcctggccaacatggtgaaacaccatctctactaaaaatacaaaaattagctgggtatggtgataggtgcctgtaatcccagctacttgggaggctgaggcaggagaatcacttgaacctgggaggcagaggttgcagtgagctgagatcaggtcattgcactccagcctgggtaacaagagtgagactccatctaaaacaaacaaacaaacaaacaaacaaaaaacaaaaaaaaatacctgcctgagatttgatagatttgtttataaggatttaatgaaattagctttaggattaataatatactgatgcaaaagtaaaatttggttttctcttttgaataagatttttaagtatttttaagaaacagtaaaaaaaaggtcaccttttaagt

SEQ ID NO: 572708 - DNA, 430 bp, Homo sapiens
  misc_feature (5)..(5): n is a, c, g, or t
  misc_feature (9)..(9): n is a, c, g, or t
caatntaanagattttataatgggacacccgtatagggcccttaccatgaatggagtttgcaggactggaagttgctctgagtgagtcagtgagtgaatgtgaagacctaggacattattgtacgctactgtagaccttgtacacactggacgcttaggcgacattaaatctacaaaagaatatttttctttcccttggcttactatatcttttttattactattttataaactttttgactcttatgtattaacacttagcttacaacacaaacacattgtacagctatacaaaaatattttctttcttggcaaggcatggtggctcacacctgtgatcccagcactttgagaggcagaggcgggaggatcatttgaggtcaggagttcaagaccagcctgaccaacatggtgaaatcccatgtccact

SEQ ID NO: 572709 - DNA, 904 bp, Homo sapiens
ctcgtggattatgctcagccactctcaaagagctgggtaatgttctgtttactgattcgtagcttgcagcgtgcaagtatcggagtgtggtggtggagtatcagagtgcgagtcagaaattgggtacaatcacggcggctctttaaggagatgaccaagattaacgacgtgatcgtagctgtaccatggcttgtagtgtgatagattgtgtgctctcggatgagcttaagtaccaactaataattggtgggctatagggaaattagagtggtgcacactagatatggcggtatccccagatgtaggcgattcccacgagttccagtgatatctagtaatatttgagcttcctaactcacacatacgatttactaccttctcctagcatcatcaataagtagaagcgggagcaggaacaggatgaacagtctagccatctcatagccggaaatctagccgcaagtgcaggtagctatcagtagaccctaactaattttctcccttcatttagcgtggagtgtcgatctatcttctaggtgcaattgtgaattttagttaccacttattatcgaagcgatgaaacgccccagccagtaagcagagtatcaaaggtccactatttgtgtctgatccgtacttattatcctgccgtactgctcctattatcactacacagtgctaagccgcaggcggttactatactacctaacagagcggcaaactaaaacacaaagttttctttgatacccggcctggacggagggggacccaagttcttctaccagcatctgtcgtgattcttggggcacccaggaaagtttatatttccttatccctcccaggatttggcacttcttggcggtggaagttagcggtactaatccgggaagagagaaccttcgga

SEQ ID NO: 572710 - DNA, 401 bp, Homo sapiens
gccataccaatggacaacacacaccacctgtccaaagaaggcctacagatacgggataatcctatatattacctcagaagtaatatctacgcaggattacctgagccttattaccactccagcctagcccctaccccccaataaggagggcactggcccacaagaggcatcaccccgctaaatcccctagaagtcacactcctaaacacatccgtattactcgcatcaggagtatcaaacacctgagctcaccatagtctactagaataataaccgaaaccaaatcatccaagcactgcatataacaatattacggggtctctatataaccctcctaaaagccttagagtaattcgagtctcccttcaacatttccgacggaatctacggatcaacatatt

SEQ ID NO: 572711 - DNA, 403 bp, Homo sapiens
  misc_feature (261)..(261): n is a, c, g, or t
  misc_feature (335)..(335): n is a, c, g, or t
ggaactgtgtctccctgagaaagctgcatgcacacgacaggccatcggtgatagtcatcttgtgctcttatcctcacagctgatacatactgagcactcatctcttattttgagaaaaattcacataaaatttactgttttaaccatttaaagtgcacatttcagccagatgcggtagttcacaccttgtaatcccagcacttggggaggccaaggcaggcggatcacctgaggtagggagttcgagaccagcctgaccanaaatgcagaaactccgtctctacttaaaaatacaaaattagccaggcgtggtggcgcatgccttgtaatcccangccactcaggaggctgagactacaggcacgcaccaccacccccggctaattttggtattttcgagtag

SEQ ID NO: 572712 - DNA, 314 bp, Homo sapiens
agtgttcccagtaaacatagtttggtttcaaacttctggctcaaaccaccctcccacctcagcctcctgagtagctgggaatacaagtgcaagccacagtgcctggctaatttttaaatctttttgtagagatggggtctcgctctgtcacccaggctagagtgcagtggcacaattatagctcaccgcaggcttgaactcccagcctcaagcaattctcccggcccagcctcctgagtagctggaactacagctgtgtgccaccacacccggctaatttttttggctgtctaagctggtctcagattcctgac

SEQ ID NO: 572713 - DNA, 343 bp, Homo sapiens
  misc_feature (70)..(70): n is a, c, g, or t
gatgagtttgctgaattctataatagactcaagcaaataaaggaatttcacccgaagcacccaaatgagntctgttgttgccaatgtcagtggcatttgaggactcctgaaggctcgagagaatccaagtgaagagggcacaaaactttgtgggagttcacagatgaggaggggatatcgtcgttatctcgatctccatgactgttacctcaagtacattaacctggagggcatctgagaaggctggattatatcacatacctctccatctttgaccacttatttgacattcctcaagagagggagagtgcagagtataagagatacctagagatgctgcttg

SEQ ID NO: 572714 - DNA, 315 bp, Homo sapiens
ttgactaaagaatatatgaatcaagacaatgaaggcacagcattaaaccgaagtgttaatgccttgctatgcacaggccctgggacagctgcatgggttgcacatttatgaagctattgctgccgtgtaattcctgaaacaatcccccaaattgatttcccaaagcacagctttttaataatgatgtttcagtatctaagaatcttatcaaaagaaacatttctggaatgaggttccagctaggtgtagtcttctgttactggtccgtcttttacatcctgcaagtcaaagcttaaccccaaagtactatagatt

SEQ ID NO: 572715 - DNA, 494 bp, Homo sapiens
ctagagcatccggtgaagtagatcctctctctaaaataaagaccctttttcctctgattgaagccaagaaaaaggatcaaggtgactgctcagtgaaatcgaccatagaacaagcatgaggatggacctacacgcctaaataaataaaagactgagcaagggggagcccacttcagcgtctccagtctggctgaaggcagtgtcacctctgttggaagcgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaat

SEQ ID NO: 572716 - DNA, 719 bp, Homo sapiens
  misc_feature (321)..(321): n is a, c, g, or t
tgtccctgcgggagacaggcgacgtcggttgttctggagaagacgtgacccgtctactaatcgtagcagctctgtgctccctcctattattataggagtagatgaagaaaggtcaaaggcgtgctcccgtcttcactccccaatctctaagaggtggatgggtgtgcctagatctgtatcatatccctgacctctagtgcacggcagagagagatacaactactgtggcgctaaagatgatttcatctcgctcatctatggggtacgtgagatataccaccgtatgtcaagaactgcaaccacttgattcgagcacacgcntccgcacatcctccatgacctggaccacactatcaccttgtgaacgaccagatatcgcgccccactcgcacctcaggcacatatatatctcctcgatgtaaatcgaccatgcgacatcttcctccttgatgggatcaacaagacacgctggggggacagagagtctcatgaggacaaagtagacaaagtgttggagggaccaggagcccatatgcccctgtggtgaggacctaccagacaaagcccgcccattacacagtgacgcataggagatcgtggagtgacttgagtcatcttccctgctgtgtctatcacagacaccttatagcgagtaggtgagacagacagccttccaacaactacctccttggtgctggacactccagcgggtgttgcgc

SEQ ID NO: 572717 - DNA, 606 bp, Homo sapiens
tgttccacgccccgatgcggcccccgtggttttttctccgcggcccgtgttttttacgcccctgggtcccggagggttcaccccgccgcagaagatttcttttttctcttccccttgcatgagagccttttttattgggccctccggaaacacattggtgggaaccccctcttcttgtccacatatgaggaggaaccgcccatttatccatctggcgctgaagccaaaaaaattctccacatagcctggggggggacatcatgtaagctgcccccaaaggggcagccggggttctgtgggcgcccagaaacgatacaacccatacccccagaggagaataatcccgcaagagtctttggccacgaggtgggaaggaagaccctggcgcttaatcaaaagccgccccataaatatgggccacggaatgggccaagaacaccccgaccaactgcggcagctctggccgccgccggaggaaatactgagacggtccccttccaccatcgctccccgagagatactggccgtgagccccccggccgggaaaccaaaccgggggagggaccccaaggggtttttaaaaaaaatttaaggggcccaaaaaaa

SEQ ID NO: 572718 - DNA, 587 bp, Homo sapiens
  misc_feature (259)..(259): n is a, c, g, or t
  misc_feature (308)..(308): n is a, c, g, or t
atcttagcactttgggacaccgaggtgatggagtgcttgaggtcaggagttcgagaccagccgggtccaaacatggtgctactaaaaatacaaaaattagccaggcgtggtggcacacacctgtaatccaagctactcaggaggctgaggctaggaggctcccttgaaccccgaaggcagaggttgcacgtgatgcagagactgctagtcactgtcgactccaggcctgggcggacagatgtgacgtaagagtccatcntcaaagaataaataaactaaggccaggctacggtgtgctcatgccagtnaatcccagcactttggaaggcctgaggacgggtggacttcctaaggtcaggagttcgagaccagtctgacaacatggtgaagaccccgtttctactagatataccacagaatcaattagccgggggaggtggcaggatcctggtgggaggctgaggccaggcagaatcgcctgaaaccaggcaggcggaggttgtggtgagccgagatcgcgccattgcactccagcctggctgacagagcaagactctgattcacagcctgactgaactacatgaata

SEQ ID NO: 572719 - DNA, 760 bp, Homo sapiens
gggacgcggtgggagaagggcaaccgtgctagctggaaagtgaagaactgaagtatcctcatcaggtgtttgtaaggatttccaacgtgcggcgggctgaaccaagatggagctgcgaaaagcagcacgaagatgtgagtgtggtccagtcgcactgaggtttaactgtgcgtcaggcatcgggtggcgcctgacagaggaagatggacgagctgggaattgctgaattagaactgcagaggttcctctacgagcgaaggtgtaataagtctgatgacacaggaggaacatcttctggagttgggctggtttaccatgaacaagctcctccccaatgctgtctataaaggtagtactggtgggcccagagctcctgcagtctgggcgatagctagatctccgcactcttcagcaaagttcgggccccgtgttgggggtagtctcgtgttaaggaagcattatgaggtaaatgtggtgcctctcacccatccaggtgagcacatccagttcttccacacgaatgatgggctttttctttcctggtcgaatgtgtggcagatgatgaagatggtgatgaaagaggataagtccagaaagtggtgactacttggaattaccaggtggtgaagactcgggagtgtggatttgggacagatgatgcggtaacacgtgggtcctgggaaaggtgtggggcacagggtggactcggagtcctggggtcacgaagagtcttgttgcaatcggagaaaacctgtggttc

SEQ ID NO: 572720 - DNA, 112 bp, Homo sapiens
gaacaaaatcgcgtgcctgaagttttggcggcgctcgctattgaactgaatcgtcgcggcttcaaggagatacctatgactggaaacataagtgagtttgtcctgttacagc

SEQ ID NO: 572721 - DNA, 1012 bp, Homo sapiens
taaagggggtggccctttaattcaagtgggttctcaagtcagggtacaggtaagcccgggtgggtttccacccatctccccggggaaaccaaaagcccttcataaatttctcaatgtggggggacaacaaaagggggaagggggggcaacaaaggtctcatcatttcaaaataaaaaccaaattaaaaaaaggttattaaagggcgggaacgaattaacacaaaatatttgcggcgatttacaataattcaaccacagaaaagcaatggcgttatcactctccccccggtggtggagcctcggggagaagaggagatctggggccatacctcctcttgagagaagaaagtgggggtggcgctttatacgagatggggcagggagatctatctctgggtgaaaccaacgggctatctcccatatatttggggaaatgcgagtttattaacaacgacaaccacacgacaatatgggttggccaaatccaaaaatgtcctttcggggcccacttatttgggtgcgaacacctctgtggggaggagatgcgatcgagggtccaaaaacccggaaagtggcgtgggtccacctttcacccggtgcccccaagttctttcaaaaaactcccttgggggtgctccaaagcgcaccaatacagaaaaaacacatgaaaaacacaacaccccctgacaacgacatacagacacaaacgaaagagaaagaacacactaccatatataagcgcgccatgttgtggcccaaacactcatctaataatatcatgttgtgtggaacacctcgtcgcgccgcgccaaagtttcacgggaggactctgtgcggcgccacccaaaacacggtggtgggtctaaccccgcgcacacaataagaaggacatctaaagtatcgcgcgcgcgcgctaacaaaaacaagcctacattcgtcgagcggggggggcgccgcaaccacctatgtgcgagcgggggcccacgaggaaacatctgtaaccaacaacccc

SEQ ID NO: 572722 - DNA, 143 bp, Homo sapiens
gaatccggtgatggtgcggtatattgtctgctccgggcaagtacccccacgtctggtaggcgcagcgcttgattggaaaacaaattcagcctgggcgcgcgtcagcacatcagtacccattgaatggccttcgccaaagggac

SEQ ID NO: 572723 - DNA, 292 bp, Homo sapiens
  misc_feature (261)..(261): n is a, c, g, or t
  misc_feature (287)..(287): n is a, c, g, or t
ccgtctctactaaaaatacaaaaattagctgggcgtggtcgtgggtgcctgtaatcccagctacttgggaggctgaggcaggagaatcgcttgaacctgggaggcagaagttgcagtgagccaagatcgtgccactgcacttccagcctgggcaacagagcaagactccctctcaaaaaagaagcttgcctgaggccacgcagctgggtaagtaggaaagttacctgggctccagagaccttcaactgttgaagcaggaantaagttcaggaaggttcagagctggntgaga

SEQ ID NO: 572724 - DNA, 89 bp, Homo sapiens
ggatttgctggtgcagtacaactaggcttaatagggactcgaattcgaggcctgggcaacaaagcaagacttcgtctcaaaaaaaaaaa

SEQ ID NO: 572725 - DNA, 112 bp, Homo sapiens
ccggaccgtatggacctcgggtgtgcagtctggatcttcggcgtgtgcagcgagagtcatgcacacgccgagactccacaccgccgcgaatgcgttgtcgccgatcttcacg

SEQ ID NO: 572726 - DNA, 429 bp, Homo sapiens
  misc_feature (84)..(84): n is a, c, g, or t
ttgttttgaggcacaatgaaactttagccaaactctgcaagagggtcccatctcctgccatggccaggtgtgagagaccaaacngagaaaacagcatactctccatcctagccttgggtagaatgggaattctttaccctgggtaaacgttttaacaaaaaaatggaacttaacttcggtttggactgtggtagaatgtagacaggagtggggttgccctcttggggctgaatctccaggcctcacgaggtcccctgtggggatgctgctatttctaagatgcaggccttcttgaaacacatcctaagcgtctgagttttgcataagggaggggaacacggacaaattgcttgtacaatttgaaatgggcctcaatggtacttcaaaccttttgattattcctaaataaaaacataaataaattaaaaa

SEQ ID NO: 572727 - DNA, 196 bp, Homo sapiens
tctttgcccagtaattggccaccacagattctagcagcatttcctgagcatctaatctgggccagccctcctatggcgtgccatgacacacacatgacaaggaccagccccagaccaggccctagcagcttcatagcctgatacgctggctctcagccagggcctgattttgatccccagccaatatttaacatgg

SEQ ID NO: 572728 - DNA, 441 bp, Homo sapiens
accgcacagggccctgagcttgggaaggccctgcattcggaagggccccaagctcgttttaattcacaccatcgtcaccaccttgtaattctcaggcattttcaaaccagggggccacattttcttcttaccctgggccctgcaaactctatagccgatcctggcgaggaaccctgggcctccggacaccttgacttttctctccagtttcctgaatgccgcagccagctttctgggggtacggaaacaagtgccagaaggtggtgaggtaagcgatgcaaagttgacatgagatgtaggagagttcctgagctgcccagaagcaggtgatgtgcgagaggccagcagccacgggcccctggagcagcagccgctgatactgagtgcctgccgtgtgctggcggagtgatcgatgttcacagcgattgtcaccgttctccc

SEQ ID NO: 572729 - DNA, 135 bp, Homo sapiens
tcgtccttaaacaatagtgttgtcaagacactatactcacttatcccaggtgaaccacggaatttcatcacaacactgatcgaaattaaaccccctgccataacccaataccaaacgccccttctgtcgtcttct

SEQ ID NO: 572730 - DNA, 688 bp, Homo sapiens
gggatatcgtcgaccgcgccgtcgccatctccacaaaaacgagtttagttgaatgctcaaggcgttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaacaggctatttaaaaacgtgaagaatgtttcctcttctggctcaggttccctaaataagcgggggggatgggatacttacaactcttcacatccctccaactttcggacagaattggtctcaaacttacctgggtaatggcacttcctactgaactgaccaactttcgcagctctttttgaccacggatggtggcacacttcgggaaaatatccttatactatacatccaattccaagaggactttaatacttaaaagccattcaggtcctcactaaacttatctcccggttcccataaaatg

SEQ ID NO: 572731 - DNA, 253 bp, Homo sapiens
tgacgtagcactgtgtgctcgctaccgtgcacccttctactacagcacggaacgcaccgccttatgtgccactgctgtggtgatccccagtgcagtgactggcacacgccgggcatcgtcctttgactacacgcttgtaccacctggcaactttttgcccctgcttttgacccacagcaacatgcctgcacatgcgatcccacccacgcactggacctgcacatgctgtgcccatgcattatcaggaatttgg

SEQ ID NO: 572732 - DNA, 723 bp, Homo sapiens
ggttaacttgaggatagaaatgtgcccccgcagaggcacacacgtcatgctagcctcacgggaactggataagcccttcggcaaagaaattgtccctgaagcttgtatctgatatcagcactggattgtagaactgtgttgctgattttgaccttgtattgaagtttactggtccccctggtatttggttaataccccggacctatctttgagtgtcaacccctctagtacgtgtggctatggtcaccttcagtggctaacggtatagaacgtgcttgtggaaagacccacgtctgtggcttggtgaggtctctgtggggcccggcagcctctgatctgtgccacgggtattcacctgtcacgggctgagtgttctgggatttctctaagaggctggcacagagacccgttgttttgtcattgcgggtctgtcagggttggaaagtcccagccgtaggaccccgtttcctgttctttaactgatgtctttggcccaggacaccctgggctgattacctctgctttgaggttgggagcggtcttgcatttacccccctgtggagtgtattcattcttaatttatcgtaaggttttattttgtaagacaattctcgattctttgaagagatgaccaccaattttggttttctactgttacgtgagacattaggccccagccacacctcattgggtaaggaaaaattaaactggtgccgtaaccca

SEQ ID NO: 572733 - DNA, 503 bp, Homo sapiens
  misc_feature (71)..(71): n is a, c, g, or t
  misc_feature (162)..(162): n is a, c, g, or t
  misc_feature (178)..(179): n is a, c, g, or t
  misc_feature (208)..(209): n is a, c, g, or t
  misc_feature (225)..(225): n is a, c, g, or t
  misc_feature (239)..(239): n is a, c, g, or t
  misc_feature (242)..(242): n is a, c, g, or t
  misc_feature (244)..(244): n is a, c, g, or t
  misc_feature (248)..(248): n is a, c, g, or t
  misc_feature (264)..(264): n is a, c, g, or t
tgtggttccgggtcgtgtgcggctcggggtaatagggctgctgctcggccggccgcgcggcgagcacaggnggcatgagggctaaccgggaagcgcactgagcggccggcgagagcgccggtccccgtggatcccgagagtgcagagctcagtgggcagggngcccgggaacggctgnnggggaagcacgggcccgtccccctcaagnngaacgtgtcccagggngccggaccacgcgnatnangatngatggagagcaagctntcgaggctaaaggtgaggccctcggtgaaacagatagtgagagaacggacgaaaataggcctctttagaggaagatttggcccaacacgagaaggagttggcgcttctgtgggacaaattcaaactagtcgattctaggctcaatattcgacaggtcacattgtgagccagtgatgacacgggaatgtgtgagatggttctcattgatcatgatgttgacctagagaagattcatcctc

SEQ ID NO: 572734 - DNA, 113 bp, Homo sapiens
ttgttggtgatctacaggatcttatcgaggtaccaacatgctacaacacttatgaccgtgaaaacactgttaagtgtaaagatagggtttaggttggtgttttcttaatgtga

SEQ ID NO: 572735 - DNA, 905 bp, Homo sapiens
cacctggttgcccaccctgatcgaacaccgctgcagctacgaagagcgcggcggcttcgtgcgccgcctgcacgaaggcacctggcccggccacatcctggaacacgtcaccctggaactgcagaacctggccgggctgcccggcggcttcggcaaggcgcgcgagaccaacgtgcgcggcgtctacaaggtggtggtgcgtgcccgccatgaaacggtcacgcgcgcagcgctctttgccgcacgcgacctggtgatggccgccatggaaaaccagccctacgatctcgacaccaccctgcgcaagctgcgccgcatggtggaccggctgtgcctgggccccagcaccgcttgcatcgtggacgccgccgacgagcgccgcatcccgaccatccgcctgtccgaaggcaacctggtgcagctgggccacggctgcaagtcgcgccgcatctggacggccgaatccgaccagaccggcgcgattgccgagggcatctcgcgtgacaaggatctcaccaagtcgctgctggaaacctgtggcgtgccggtgcccgaaggccgtctggtggacagccccgcagacgcctgggatgccgccaggacatcggccttgccggtggtggtcaaggccctgcgatgccaatcatgggccggggcgtttcatcgacctgaacacccgggaaagaaatcgagaccgctacaaggtcgcgctggaagaaggcaggcggcgtgctggtcgaccgcttcgtgcgggctggaacaccgctgctgatcgtcggcggaagctggcgtgcgccgtggtgaccgtcttatcgtcggcgaggcatcccggccggctgtgcgagccatccgaccggcggcgtgaaaaactgtgcccgttgtggccgacggcggtgatggccacg

SEQ ID NO: 572736 - DNA, 638 bp, Homo sapiens
gggggggcacatgttctcagggcctcgagagggctgtatcacaggctgtggttactcgtatttggctcacaataaatctcttcaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacattgtggcccccttggcccaaaccaatttaaaactggaccaagtttttcaatggggcccaaattggggcaacttggccaaattcccctttaggggggcggtttaaaaatcaatggcccgggttttaaaaacttgggaatgggaaaaacctggggtttcccaaattaaatcctttggaaaaaaatccccttttccccaattgggaaaaaacaaaaaaggccccaccaaatggcttttccaaaaattggccaaccctaaaggcaaatgggaaatggaaagggtaaaaatttggtaaaaaacccggtaaaattttgggaaacacaccctatttttaaacaaatgggccaaattggcaaaatccctttataaaccaaaaaaattcccccgaaaggggtcgggttttcccatttgggccctcg

SEQ ID NO: 572737 - DNA, 753 bp, Homo sapiens
tagtctcgagtatttttttttatttcttgatggtgtaaaagggcttaatttcgcgggggaccaggaattaaaccaaaaaggccaaaccccatgtcatcatctgactctatcaaacccctccttcttctcaatctttcttctcctctgctcgcagcagggcgcagacaccacgcagcagggcgctcgcagacgcctgggggcagcatgagcctggctacacgcccccaccagcagtgtcacactgggcaatgcttgccatctcccctggggcaatgactgtctccaattgtattttccctattcagctcactgattaccccttgttgtgacccggtcgttcgctccgccttcgatcccccacgctgctccaagaatctctctggatgcctccttggcgctgggggaggaagttgccccccttagggcaccccagcaggtaggaggcgacgtagcgcatcgcgggcggcgatctggcgcgcggaaaaatgtctcacgcgtgcccctcagtcccagaaatctcggcacagagggctccatatacggcaggtccatgggacttcattctcggctacgcggaaatggcctctagctgccccctgtgttggttggacatacttctctgggcccacagcccgtaatgtttgcccaagcacttctctcaaagggcagtgacggaccccccccgaacgttcatgtaaggcccctcttcccgtgtctccacagcactggaagtcatcctgaagggtacaccct

SEQ ID NO: 572738 - DNA, 378 bp, Homo sapiens
  misc_feature (83)..(83): n is a, c, g, or t
  misc_feature (189)..(189): n is a, c, g, or t
  misc_feature (365)..(365): n is a, c, g, or t
acaagatgcagatctctggtatgacagctcccatgatgaggcaatcttgtgagtttcatgtctctagacttgcacagatattnagaaaaacaagtttatggccggtcacagtgactgacgcctgtaatcccagcacttcgggaggccgaggtgggcggatcacaaggtcaggagatcgagaccatctgntaacgcggtgaaaccccgtctctactacaaatacaaaaaattagctgggtgtggtggcgggtgcctgtagtcccagctactcaggagactgaggcaggagaatggcgtgaacctgggaggcggagcttgcagtgagccgagatcgcgccactgcactccagcctaggcgacagagncaagctccgtctc

SEQ ID NO: 572739 - DNA, 395 bp, Homo sapiens
ccggtcccagggaacagcaaaagacctctctggagtgtagacacctaaggagaaggggtaggaggtggccatggtgacctgtggcatggtgtgtggatatcagtgggggcaagagacttggcagaaaatgagaaaaatgtaatttgttatttaaaagatgattctttttactgaaaactacataacagagaatgagagctattcttaaaatgtctcagtgtgctgctcagtgttataaatgcatatatgaagtatgtctgcatatctgaataaccacagtattttttagaataaccttgacttttggtagcctgtggttaccaaacatttaacttttaaaaattccgcaagaacatttgtaaacatttttattatatcagttgctggttccgctg

SEQ ID NO: 572740 - DNA, 117 bp, Homo sapiens
tgaggatccgccccgactagcccgacgggggatacacgttcgcgagagaaggatagcacattgaagaagtgcggaagaacaaagaatccaaagaccctgctgtcgggctagtcgggg

SEQ ID NO: 572741 - DNA, 120 bp, Homo sapiens
ggattggagggtttcacaccaataccctgtgtatacaagaatcagatttataaaacttccccttttttgttaggtatgaacactataaaccaaattattttgaaaactggtgcaaaaaaa

SEQ ID NO: 572742 - DNA, 843 bp, Homo sapiens
tagttcagcctgaggcgcacactcgcagctctcagagcacatcccagttcccgtcgaacatgtctatgtagcactaaatcactgtgcaaggcatcacctctgaggatgatcatcagagaccccaagtgctatgttctgtcaaagacgtatagtatgctttgcatgcgtgagcgtgcatgcattagaaacgagtcgaacattatgctcggatcaaagcatccaaagggtgtgggagtgagcgctcagcctaattggtccaaactatgtttgacgcaacgccgctaggcgaattgctacgatgagacgagcggtactagttgcgccttttgcccatacccatgagatacggtaccaaacccacatgcgaactttgtagtctgcacatgtaccaagtcagcctttatctgggccacacgaggaaatggcagatatgtgtcggcctgtagtagcaagaggacctgcctcaagtatgacgcttgcttgagcgtatcaacgccttgccatgaaaggggctgggaaccgagccgaaggacgtcctctccaattgagaatcatcatgcatacgaggaaaccgaagcccagaggatgcttgcagtgatgattgtagacgagatgtcatacaaagggagaatgtaccaaggacttgagtctggacgaatggacatttaatttcggacagagttggtgcagtttcccaggaaagcgtggatggatagcgccatggcaaaggggtaagaaagagacaaaggcataagctcgtggtcaatttggatatatggaggtggcttgagcaagtatgctacggggacatggtccaatgagggctggaagtgataggaagga

SEQ ID NO: 572743 - DNA, 902 bp, Homo sapiens
taaacacccttaattcacttaatttttcttgtataaaaaccctattttgtacccacatctggaccctgatccgtgcacggaaactctggtgtgggtcttgacaaggtggtcagtgaactcctgatagggaaacttggtgaatacagtctccttccaaaggtcggcgtgtcacggaagctggtaggttctaaaaaatgggcatcaaatggtgggccttgggagaatgttgcccagggtcggcatgtcgaacgccccgaggctagagtgtttgtacacagtccatcagataccacgcgatcatcgacgcacgtcttcctataggcacagtgttgcagcgaagacagatagccatgtcgccctatgagtgtcgcacgagagaatagataggcgagatccccaagacaaacaaaaacgccagcaatgagagaagactatgatcaaccttgtgcaagggagaacatgttagtggtgcgtgccatcagcacgaaaatccatgtgatctcccccccaaaaataagccctttaagtgcaagacaactgagggagaccagatgttgagaagacatctttgtgcgcccagcgagattagaattggccccccaacagataatatggcagtggcggcccacccactcctgtgggggagcaactatttaaaacccacacagaaccagactgtgctccacttgtgatatctcgcccggaataggcaaaccaatacgtgccttagaccccgtggtagagcaggcccaggaaaccggggacatgacacatcagcccgcagggagcaatacaatcttctaaaaaacgccacaactcatgaaaaagaaggcccccccaggaaaaaaaacatcaacggacctacggtaatcccataaaaaagggacgggaaacaagaccgc

SEQ ID NO: 572744 - DNA, 832 bp, Homo sapiens
acatcaaagctacagcctatagctgtgaccatattctaccatgatatttgcaaaggtgaagattagctattgagattatctacaaagaacaagcttacagtaaagtaccaaccaaaaagtgggggtggaaggacaaaaggcaaaggcgccgtttctgagcatcaaaaggaccaggtattaatgtgccggggtagggttattcttaacctggggcgacattgttgtgtgtactcagagtgtatatacttagtgtagaacagaagtgtacacattatagcagctcgccatagtgttgcatttgttatacgaagtacactgtgttaacttggtatacagcaagaaatgtcatatctcttgagtttggtaatggaagaaccaggcacagaaacagacagaaatgatactgtatgtgtgtgtatttatgtctgaagaaagtccccttgaattctgatatctctttgaatctaagagatcctgatagcttcatgtaaaagagcattgacaggtggggccacctctgaggggagtccatggtttctcatgcatcatttgccatatactattattcaaagttgcttgcttagatcagacctatgacgggggaccaggataatctgtaagggccagagattagatgatttcacgtgaataatttggagcactaactaagaaacattcattattaattaataaacaacgtaggtaattagccttataactggttctggactttttaacagcccgggttatgagcagtgggcccttggattatccccataaaaaaagagaacgccttcaatcaaattgggaccagtgaagcgaaccctttcga

SEQ ID NO: 572745 - DNA, 215 bp, Homo sapiens
  misc_feature (61)..(61): n is a, c, g, or t
  misc_feature (68)..(68): n is a, c, g, or t
  misc_feature (79)..(79): n is a, c, g, or t
gcgttctagaggatcaccggagtgtgaatatcgatgtagtgaaggtatagctgccaggaanttaagantgtcagtcagntgcatatgcgcctccaactccaagccctgggagcgcacagttcctaccgcgcgatagaagttgtcctgtggcagtttggtcgccaggtcttcctgatcgatacggaacagcgaaggggtgaacaggttgtcggtag

SEQ ID NO: 572746 - DNA, 539 bp, Homo sapiens
tggaaacggagtctggcccggtccccaggcgggagtgcaggggcgcgaatctcggttcactacaacctcgtgcctcccgggttgcgaggcgattctccggggcctcggccttccgcgagtaacggggctctacaggcccggtgctaccacgcccagcataattttggtctttttagtagagacggggtttaaccatgttggcccaggatgggtctccatctctggacctcgtgatccggcccgcctcggcctcccaaacttctggggattacagggcgtgagccaccggacccagccaccatttaatctctctaaagtctgggtcccagtattaaacctattcttgagtaacctcatattacgggttctaacatggaagaaattatttataactcgggtacttctagaactcaaaattcgtttatcaagagatagtctcaagagaggtagtcacaagtccgggttaaacggccctttttcactttcccgagggcttcctcggatatcttcccttacttcattatacacggtggatatca

SEQ ID NO: 572747 - DNA, 314 bp, Homo sapiens
gggcccagggaaggggcccccaggggggtggcccccccccttgttatttccaaaaactttttttttaaaaggggtggtttttttttcaaaactttaataaatacctttttttttttaaggggaaggtttcctcccagggtttttttttcaggaacccagtgggtgaggtttttaaaactcaaaagggttttttttaacaaaccctgggggggtttacccctggaactggcctacggaaaaagggatttccttttggaccggtttccggcccaattttttttttaaagtgaataaaaggccccccccccccccca

SEQ ID NO: 572748 - DNA, 596 bp, Homo sapiens
tcttaacttggcttatggtagggggggtgaagataaggcctggggttgagaaactcatggtcataaagttataaacggggaaatggggtcagaaggcttagaaacaattgtcatcgccacatccgtccctttctggggatgacggcgggacaaggccggccccctggttggggcccggggacggcgagggctctcagagctgggagaaggtgacggtttacagttcctgtgtctcagtcgtggccgggaccgacttcacgaggtctggggtctgcagcaggcccaggtcccaggacgccacgtaggtgaggctctgcggccaccgaagtggtcgcgggaatacgagcaggtggacctgggggctcggcaagcgccagggggccctggggggaaatctgggcgccaggcaaaggcaagcatccagagtgaccctactggtcggagaaacacccgggttggacaggccaagggccaggggcccccggcaaagccatacatctggggggcgccggaaaagcgcaagctcggaggaccaagcgccggggccccggaatgaccctgggcagggcctgcagggtcccaaactgggggagcaa

SEQ ID NO: 572749 - DNA, 120 bp, Homo sapiens
gccgcgcgaatgagtggcacattctagaaggggtacactctcactcctgtaccgtctgtcccatctgtgtacaagaaaagctctgcgtcaaagaactaagtaaataaaaaaacatccttc

SEQ ID NO: 572750 - DNA, 116 bp, Homo sapiens
ggtgatcttcgctgtgaaacagcttgaaattgacgcaccctgttacttcgatatccagaagagtccagtctgtacctgtgctccgttttacaggtgggattcagatcttcgtgaag

SEQ ID NO: 572751 - DNA, 150 bp, Homo sapiens
gccgcccacgatatagcgtacttctggatgcagtaaaaaccaacaataagatgaaatgtatagctactaacgcatacattaaggaagaagaaagatctcaaataataacctaacttcacgtcttaagaaactgaagaaaagagtgcttgg

SEQ ID NO: 572752 - DNA, 875 bp, Homo sapiens
agcggggcccggcgtgtcggcccgtgctgcggtgcgggcgttcgctgtgctgcccctgtgtgagcttgcatgtggtgcccctgggcgtgctgtgctgatggcctggaagtgggtgtgctgtgcgcccgtgtgacacctggtcacccctggctgcacctcgtgatgcctaaatggctgctgctgtgctgttgacactggctggtgtgccctcgctgctgcctggagactgattgccaaaatgctgcagtggacttctgagttctggatgcctgcactcctgcgaggtggccctgccactgtcgttgtgccccatgtgtgtgaccaggagccgagcttggccttgtgacgggcctgctgatgccgggcgctcacgtgggctaccatgctctgcctacactggcccattgcttgcagtgccccaggatctctatgtccggctgagcgcccaagcatacccgggacaggacagaacccctttgtaacttgagcgcaggtgttgccccctgaggcaccaggaccccctccagtccgtggcagatatcttgttcgccagattggatccccgggcacgacgtggttcaggctctccatggccggtgctctcattccattgaggcctacacgggacatttacgtctggtggaacaggcccactttggcaccccttgcacacatctggagtgcgcttggccccaactaggtatctggacttcaggccccaacagcaagaacggttccactcaatagggacgccccctctctgcctggccagagacacgaatgttgtgctcgacccccttggctccccccgcagcactttggattctttagctttgggccactactcgaagaacaccctcctccttgttaccctg

SEQ ID NO: 572753 - DNA, 320 bp, Homo sapiens
ggctgacttagaggaccccgcattgctcccatcaggtttgtcaagatcagatagctgtagatatgtggtgttatttctgagacttctgttctgtaccattggtctatatatctagttttggtaccagtaccatgctgttattggttactgtagcctcgtagtatagtttgaagtcaggcagcgtgatgcctccagctttgttctttttgcttaggattgtcttggcaatgtgagcttttttttggttccatatgaactttaaagtagttttttccaattctgtgaaggaagtcattggtagcctgatgggagaagatgcg

SEQ ID NO: 572754 - DNA, 169 bp, Homo sapiens
cgaatcgagctcggtaccttcgttgtctgccagatcccttcacacatgcagtgccctggaccccgcacccccaaaacactacatgcatggtagctgccagatgcctacagcctcgttttccagagacttgccctctacgtgaagtcacttgccttcaaatggacacgaa

SEQ ID NO: 572755 - DNA, 458 bp, Homo sapiens
taagtctctgagattagtttcattcagaaatgatcactgtaatcgcacaccccttcctctgatctcacccacattttagggcagaggggaggatatgaaaaggccaccatgttcaggcctcccaacagcagaagagcaagcatggcagatagaggacctctcccttaacacttttgcctactcgtgtggcctctagatttccagaaaataaagtgaataaaattaaataaggagagaacaatgttcattataagtatatggtagtttaaaaaagtgtcagctctaatgcatttccatcagctggaggcttagagggagaatgatggtacgtacaatgctgcaggaattgtacattatctgggttttgcctttgaatatatttgtaacaaactctaaaatgtctgagtagtacctataggagggtatgtccttgagtgacagtctctagtatgtcataa

SEQ ID NO: 572756 - DNA, 350 bp, Homo sapiens
aatgctggactcacagaaggctatgagaagtaaataacagatggagttttacttttgatgcccaggctggagtacgatggtgcgatctcagctcactgcaacctccgcatcctggattcaagcgattctcctgctacagccttcccaagtagttgggggctgggctaatatatatatatattttttagtagaaacggggtttctccatgttggtcagggtggtctcaaactatgacctcaggtgatccacccgcctaggcctcccaaagtgctgggattacaggcatgagccaccacagccggcccaaatattacatttaaaagcaaaaataaaaacaaacccacgagtg

SEQ ID NO: 572757 - DNA, 427 bp, Homo sapiens
agggcatgagaaggccattcagacgacgacaaggatgtccaagttatcagaagcagtataagtctggggaagaagatgtgaacgagaatctcacctggagaaaaatgtagataatatacaatgaatatacttttcttctatgtaacaggcagagaaggtaccaggcacacaaggtgagttggatgttgagtttagtgaaataggcaccggcagccattgttggtagggtacaacctgggacagctgttctgtgtccgtcctggtatttgagacagcctcattctgtcgccaaggctggagtgcagtggcagtatcttggctcaaggcgagctcagtctcccaggttcaagctatcgtctgggcttagccaccctgagtagctgggatcacaggtgcccgaccaacagaactggcagatttctgtgcc

SEQ ID NO: 572758 - DNA, 479 bp, Homo sapiens
atgtgctgtgtgtagtaagttacgtcgttcgcttgctaccatgtatctgccggcgaaattctgactgcgtgaatcgccgcctcgactatagttaatagtaatagaagctacttaggactatcatgcgaaggtgaaagcgccgaggatttagtcttgtgcgtgcacgtgcggccgcccgactaagagagctctgaggcggacaagcgaggcataggaagctagcaagaaagtaaaggacaaagaacggaggacaggcgagaccatcccccgttgtcttcgcgtgtgtctgagtccaacccctcatcgtctccatctcctgggtgtactcggggatcacgtcctctgcccggccaattctcatcatttgcgtaatatgctcctcacaagtccgcgcccattactgaacttggggtgtgtgggcccctccgtgattatttctttgtggctccatttttgggtgacatgaggggtgagggttt

SEQ ID NO: 572759 - DNA, 484 bp, Homo sapiens
cacgccctggggctatttttaaacatagaggtcacacgtttgcccaaaaaggccggttttttcccaccaagccccgagtccccttacacgccattgaaacagcgggtgttctacatggagggactacccttccccgtaagacgggcgaggagattttttgggcaccatcggcatgcggcccaacgcccaagaacaacccgggcttggatttcccccatcgaccggacttcaagggccagctgtgggagttgtcctgctcccccgaataccggatgggttaaggcccggttttccccccctgcacaagcccagggggtgagggttcctagggggttttgggggtccccctctcctttccctccctcccccaaaagggggttttaggggcctgggctggggggatggggagggcccatcgtgactgtgtttttcaaaacttatgtttttaaatgggggcatttacgccaataaatcctcagctgga

SEQ ID NO: 572760 - DNA, 436 bp, Homo sapiens
  misc_feature (385)..(385): n is a, c, g, or t
  misc_feature (391)..(391): n is a, c, g, or t
  misc_feature (411)..(412): n is a, c, g, or t
  misc_feature (426)..(427): n is a, c, g, or t
  misc_feature (434)..(434): n is a, c, g, or t
aaaaaaacccccccccccccggggaaaaaaaaaatctttccggggcgggggggggaaaacaaaaacgcgggggggttttttaggagggggggggaaaaaaatttttttataaaaaaaccgcccgggggggggaacatttttttgacaaacaagggaggcccccccctttaaaacggcgccgtggggggaggttttttatttttttggggggttttcttttttggggtgtcggggtccccccttaaggggggggagggtgttttcctttggaaaaccccccgggcttggggaaaaaccccccctttttttgggcccccccccggcctttggggcccccaaaacccccctaaaacgggaagggcccattaaaaccatgccaggattnaagcanccccgcctgccatgggctgnnttccctcgtccganntccgcanga

SEQ ID NO: 572761 - DNA, 1159 bp, Homo sapiens
  misc_feature (73)..(73): n is a, c, g, or t
  misc_feature (784)..(784): n is a, c, g, or t
  misc_feature (805)..(805): n is a, c, g, or t
  misc_feature (857)..(857): n is a, c, g, or t
  misc_feature (973)..(973): n is a, c, g, or t
  misc_feature (1080)..(1080): n is a, c, g, or t
tcctccaacaacctacttatctcttttctttcgaggatgtagctattgctggaggacacattcacacagttgnaacagatgacactaggagcaatgaaacccagaatcctaataaaccatcacctagcatgctgtcaacaggttgcatcttgcttgatgctcgtctagggataataggcatttgatgatgctctatttttatagaagctactcgaagatgctagaattagctcgaagcatgcagcagaacacgacttctccacgttataacattagaagatggatcgaaaatttcttgatgacactaacttatatgaagtacttaccaagtagtagactagattacatctcatgacacaccttcttagtacatactacaacctatatagtttacgccctcgaatgtcgtcgttgaagacttctgcatataatattaatacatgtctatactcttgtctccatcatccaaccacatacgttctctatgtcactttttagctgcttcctaagtgcaatccgcattatctccacattatttagcacctccgactatcttgaatatttacaagtattcttagctctgatctgtccgcgatactactatatgactatctcaagacttacagagcacctttctctgtgctcctctctcatgcccacgtgtgtctatctcatgtctccgcatcctattcttaccctctactactcgtacgcggtctcccactctccaacgcacaccgttcatccttcatcctggagtattatgttctcttcctctaccgtntaacgtccaggactcaccganccattgcacgcacatctaacctatacactccacaagtgttgtatttataatntggctcctccttctcctgtaattctctcgttcattgctttcacttgtatcgatcactgttcgtctgcgcatgtaatatctccctctccccgctcctacccatcctacgtattatangtctcatcctactgatactatgctcatgtatctccgcacgcacgccaacctcgacatcttcacctaactctatacattactatgatgctctcttcctccacgtccantcacgcccatctctatctcctcatcctagcgatctatactacgatgtcactcatgatgttaatagcatgtagtgtatat

SEQ ID NO: 572762 - DNA, 122 bp, Homo sapiens
cagacatacaacaattagctgggtgtggtggtgcactgcctatagtaccagactacttagtggaggctgagtgtagtgagaattgcttgcaggcagaggctggggagcagcacggaacgaca

SEQ ID NO: 572763 - DNA, 154 bp, Homo sapiens
ctagagcacgagatcctttttgaggttgactaggtgagagatgattagagagagagagaggctctgagcgtggacaagatcatgtactgcacactgggatatgatgttgatcgcagagagatcgttccgatcatgcttgtactgtcggattatg

SEQ ID NO: 572764 - DNA, 989 bp, Homo sapiens
aactgatacaaaaaatagatattttgtgctttcaatcaacagtcacatcatgcagacagtaataatgcacattctatacaattgtcccatattctaatagttatgcattaatgctttaagacttgtatacttgtgctttcttacatagtattttagcttatcttcagaagtataacataatctattagtttataattcacttgacacactactagttacacatccatctattacacactacttcactcccacttcactatcgctccacaacccatgtgcgaccttatactcttacgacaacaacttactactgcatctaacaaggtatacctcctttacactacgcagttctacaaggttacaactttaggagacatctggacgtattacattcgtagccattacttccgaacttctacttggggaccttaaagattcacttaatcgcgaattatttccccaagatcattcttctaaaacattctcacagtttggccaaagggttcccacactttcacccagcacactccatggtccacgctcatttccaagggtttccttcgttttacaagcgaacatttttaacaaccaacactccaccctgtctccggaagccagggctcccaacgcccctaacaccgcacacgggaacacacccaaccggaaccaagaaacaacatttcacttctcacacacaccgggggctaccaattcgtacacaacattacaacagacacttatataggattccgattaaccgcgttaaaaaaccaccccaaattcacgaaaaaggcgaaacacctttaccaacatcttattgatttaaaaagcagccaagcaacgagattcattacggcctacacacacacgcaacttttagtacacaaactattaaacaagggcttatactttcacacaaggccctccgcgggtaacaggccccactgaggcatagggcaacctccccaatatacaaccagtggcttaat

SEQ ID NO: 572765 - DNA, 278 bp, Homo sapiens
atagccggaccatcattgcggtgagcatcatcatgccactgcacttcagctgggtgacaaagcaaggctctgtctctaaataaataaataaaactatcacatctccaaggcaaaatgagaatcaggaactttaataacgagagtgatgcgtagaggggaagtgcattagagttaaatttattcaagatgagacttcactggacaacaccattttgatacttccatgaaagttaactagctgattgatttttctttggttaaaatgtccaactgcgccc

SEQ ID NO: 572766 - DNA, 472 bp, Homo sapiens
attaaacaggtgactatcagtaagaacagtggcctttgtgggttgtagctttccctggttcaaccctgccctccagctcagtggtaatcttggaaataagaacctacattcctagttactgtgggagcaaaatgccctcattcgcacagaacctccgttattgaacgtgtctgatggctgcctagaagactcctaccacattggctcagggcttgcccagtgccagctgcctgaggtgatggataacagttgccacaaacaatagactaaacaaaaagctaaaaaggaagagcaagggaatgagatgtccacaggcgctttgaaaagcccaaaacatttttgggaatacaggtcatatacacacggaggactatggatatatactcaggagagacctgaaaaagccctaaactctcacctctggctgaccttgaggctctatacaaagggaagtctgaggaagagaaattta

SEQ ID NO: 572767 - DNA, 190 bp, Homo sapiens
gccgtcatctactctaccatctttgcaggcacactcatcacagcgctaagctccgcactgattttttacctgggtgggcctggaattaaacatgctagcttttatttccagttcttaaccaaaaaaataaaccttcggttccacagagggtgccatcaaggtattttcctcaggcaggcaaccgcaatcc

SEQ ID NO: 572768 - DNA, 159 bp, Homo sapiens
cggccctagctattgtttggctgaatccttgatttatatatggcttttcatgggcctgctcacaacaccaacgactgtgtgatggtatggtagtcagctgcgaataattcataaaccgctactcgttccatcaactccaagtgctacttggctctcgta

SEQ ID NO: 572769 - DNA, 1620 bp, Homo sapiens
  misc_feature (1620)..(1620): n is a, c, g, or t
gggaacatcgtgcacatccatgctgctcagtgtggcaaacagatcggtgcctaggttctggagagagtgatcagtgatgaacatggcaatcgacacccaccgatcaccgtaccacgggagacaagcgacctgcaggctcgtaccagaatcctctagtgtactacaatagaaagccacatggttggcaaaatatgcttccttcgtgccaatcctctggatgcgatactacgaaacctgcgcgaacaatggacattgtgtatacgactctagagtcacgttctaaaggccgagaatcattaataaactcagaactgaacttctagatatttgtgtccagaacgtggagagcaaggttaaccaacagtggattccacaagggccacatacacatgcatagagctccgatcatggattagaatagccgttggttccatcggaaacctgttcggattaactgtggagaattgcaggggcaacaatcacgccctagttgggacgtcgacgcctcggcctgaggtcatataccgattcctggtaacgcgcaacttcaactagtgttacaggggtggccaaccagtggcatcttggaagtttgggagcaacctgcctccttataataccaagcgaaaggaagttccgcaaagatcttaacttatccaacatagtatcccgtcccttcggttgaacgttaacacgtgtcccagattggatggagctgtaccttgggcaactaccatatacaggggatactgtgcaggccaactctgattgacactggagaaaaggacctcggatatattacattggccgctacacaccgttcatgctctggtttcacatatcccacgagacagggcacaagaacgccaaattgacatcgaaggtggaaggaacgccttcataggcacaattaggaacacaacagaagggacacccagccgtaagggaagcaatcataggaatatacaagggaaaccacatagaacaaggagtgaccacaacaaagccaaaaacacataacagagcgacaatcatgaaacgccgcccccatagagacgatcgagcgccaaaacaaaggcagagggagacgtcaaacaaaactaggaaagacacggagagccccatgggtcagaacgcacaaatcgggatcacccgcgagcaaaagtgtagggaggtcacaaagcaaagagtgtacccaatgagagaaggaattacacaacttaagtaagataagcacataggagagatgagcaccctatcaacacaagaagaggtaacacacgcaaatataacaattaaaaaaagtagaagaaacaaaccgaacacaagactacaacataacacacaacaatagtaaataaattattataccacacaaatatctaacaatacaacatatgataaataacaaaaaacagtaacaaatcaatataatatcatataatactaaactgacaacacaacataaagtaaaaagcacatactaaaaagaatgagaactacaaatactaaaacaataatatcaacacaatctactaaaacacacacatacaaacacagaaagaaacaaatacaaacgcaatactaaatacgagtaacagcaatcaacaagcaaactan

SEQ ID NO: 572770 - DNA, 393 bp, Homo sapiens
  misc_feature (12)..(12): n is a, c, g, or t
  misc_feature (16)..(16): n is a, c, g, or t
  misc_feature (19)..(19): n is a, c, g, or t
  misc_feature (265)..(265): n is a, c, g, or t
  misc_feature (285)..(285): n is a, c, g, or t
  misc_feature (292)..(292): n is a, c, g, or t
  misc_feature (309)..(309): n is a, c, g, or t
  misc_feature (335)..(335): n is a, c, g, or t
  misc_feature (363)..(363): n is a, c, g, or t
ctggccgcgcgnctgncancgcgtgaagccgctgatcgacgcgatcagcgctggttgcgacatcgctcgcgcactgacgcacgcgtcgcctcaaatgctgaactccgccgcgacctcggcacggtttcaagaaacgcaccgagtaccgccgacgtatcgtccgcacggtagcgcgcctgcagcgacacttccagcgccggcgcaacaacggcacgaacgtgacgccgcccgtcgaaatctgccgtgacgacgcaggcagcagcgnaacccccagccctttcacgnaccagcnacagagcgtatgggacnttgacgacttcattgcggcgattttngggcgttgaagcgggcatttcggacggnaatttttgttggcagggaaaacgtggccat

SEQ ID NO: 572771 - DNA, 519 bp, Homo sapiens
  misc_feature (519)..(519): n is a, c, g, or t
acatacattgcctgatgacagagttttgtttcttttttctttttgagacagagtctcattctgtcgcccaggctggaatgcagtggtacaatcacagctcagtggcaacctctgcttcaggggctcaaacgaccctcccacctcagcctcccaagtagctgggactacaggcatgtgccaccacgcccagctaatttttgtgtttcttgtagaggtagggtgttgccatttgcctaagctggtctcaaattaaagagctcaagtggtccacctgcctgccttcacctcccaatgtgctgggattataggcatgagccacactgtgcctggccccttgagcatttcttgtaaggccagtctaagagtgattagaattcccttagtttttgcttatctatgaaatattttatttctccttcttttctgaaagatagcttttctgggtatagtatttttgactgttaagttttttatctttcagtactttgagtatgtcatcagacaatgtatgggtaccgn

SEQ ID NO: 572772 - DNA, 169 bp, Homo sapiens
aagtagagatggggtttcaccatattggccaggctggtcttgaactcctgacctcaagtgatccacccacctcagccttacaaagtgctagggttacaggtgtgagccactgcgcctggccccttccctcttctttaacaccaccttccatcccttctgttgtcttctc

SEQ ID NO: 572773 - DNA, 312 bp, Homo sapiens
atgtagatacaggtgagccatcatttccctttaatcagcttttaaggcagtagtatccatttatagctctgatgatctttttcagtgttcatggccacccctataaattttggtggaatttgcatttgaaaaatcagtgcacgtatgggactacagatttaatcataatgtatagaaaaacagtaaaagcagtgttgggtgtgcggctaggtagaaattttccagttgtattttgaaaatgtcttgattttttcatattttattaattaggcaatacaatcagatcttttgatcaatgtaatataccacagc

SEQ ID NO: 572774 - DNA, 199 bp, Homo sapiens
caaaaaagggccaaaggaacggcgttgcccgggaccaaggcaccgggtccgcgggaaccccggcccacaaccgccctcctcctgaagccccgtttgggggccctatagccccaggggccggcacatccctccatctcgcgccgtaatttgcaccccctcctaaaggacgcggcttggaccccccgccccctcccccgca

SEQ ID NO: 572775 - DNA, 247 bp, Homo sapiens
gctctctaggtctgtcttcgtcccatcagtcaggtctcacccaatcctgggccacgcgttcagattttgaacgaaatcttcccagtttcatcatcatcaaagagctgaaagctttcaggatttcttctttagatatctttctcagacattttctgggtcatcacagttaaaaagtcaccaaagttcatgtgtcctgtcccttccttatcaatttcacttatcattttcctgatgggagcaagatgcg

SEQ ID NO: 572776 - DNA, 325 bp, Homo sapiens
aaaaccctaacagatctgtcctagtgattttacctttgttctagaaggcgctcctttcagggttgtggtattcttaggttagcggcttttttcctcttttccccacccatcttccccaatattgcccattattaattaacccctttctttggttggaccctggaagttcttctccctccaaggatctcccccccatttaaggtccttaacggggcacttctccttttccaaaggctcaatttaggggtggccgagtcttctttaagagaaacccatccaataaatcgacaagccattaaaaaaaaaaaacctcggggtcttttgg

SEQ ID NO: 572777 - DNA, 224 bp, Homo sapiens
gggggggggcccccccaaaaaaacgggttttttctcaaaaaaggcctttttgcttttaaaaggggtttaaaaaggaacagggaaccccccttttaaaaaaccccccaaaaaacccccccctttttgggtgggcccctaacccgttttaccccccttaaattttttttggttaaccccaaagttcccggggggaactggttttccttaaaaaattttttttccca

SEQ ID NO: 572778 - DNA, 257 bp, Homo sapiens
tgcgtgccgggccctccaaatcaccacaggactattcctagccatgccctactcaccagcacgcctcaacctgccttttccatccaatctgccccacatcactcgagacgtcaacattcatggcttgcaatccatccgctcaccttccacgcccacatggcggcctccaatcattcttccatcttgccatcttccttcaccaccatctgtggctgcaggcccttatcattcacgggcatccatttcctctcactcca

SEQ ID NO: 572779 - DNA, 139 bp, Homo sapiens
tgcatggcgtattcactcgccatggttcttctattcatcattcctcatcccttagaactctgaactatctgaccatcaactttttcaggaagctttttgttctattttctcattataaggggtgggagtgaaattacgg

SEQ ID NO: 572780 - DNA, 259 bp, Homo sapiens
ctgcctcagcctcccgagtagctaggactacaggagtgcactaccacgcccagctaattaatttttctttttttttgagatagcatcttgctctgtcaccaaggctggaatgcagtggtgctctctcaggtcactgcaacctctgcctcctgggttcaagcaatcttccctccttggcctcttgagtagctgggattacaagcattcaccacaacacaacacctggctaatttttttttcttcaattgagtacaacctg

SEQ ID NO: 572781 - DNA, 528 bp, Homo sapiens
gccggttgggcctgatgcatcggttgacaaacagctggaatgttgcggatagatggatggtaattacgccccgaccctgaaaaaaaacaaaaacaaaaaaaaaacaaaaaaaaaacgacgagaacgttgcgaccagaaaagaacgacgaagcacggaagacgcgcgaggggaacggagagcacgaagcggagagagcgacgcgagagagcaaaagagacaaccacaggagaaacagaaaagagagagagaacgaacacgagcagaacacagagagaagaaggagacaagcaaataaagcgaaaagcaagcaagacaaaggcgccggaggagagaacgtgaagaaacagagaaaagcgagaagaagcgaagagagaaagatagagaaaagagaacgagcaccagcgaggcgcagactacaatgaagaggaggagacaaagaaagtggacaaggagagcaggagggagaagtagcagaagaggacgaggacgggccccggaggaaaagacgaagaagcccggaaggaagt

SEQ ID NO: 572782 - DNA, 432 bp, Homo sapiens
cgaccacgtgtgatggagggagtttacaggaagtcagacagggccaacgtcgaagccgtaattcctgtgtctgcggcaccaacgtccaaaggggccacatcgatgataggcaggcggaagagtcttggtgtttaggtattcgatcactgtcttgatccatgctccggtgatgactcgtgcacccgtctgcacgagtgatcgctgttgtgtccagtcggcgtgtagccctcgtgcgcggatctctcatctcggttgctgccctggaagtaacatagccttcttgaagttgcctgtctgctgttccctgtcggccaggctgtttcttgcagggctaggtcatgtcctgggcggcctcggtcgacatcaggcccgggagggtcagctggatggcctcatcggtcagtgtcggatccctggccgacttactcgaac

SEQ ID NO: 572783 - DNA, 928 bp, Homo sapiens
gcggagactctggtgtccctgagggtccacactgtggatgacatccagcagatcgcattgctgcgctggcccagtgcatggggcccagcagggagctcgtatgccgctcgtgcctgaagcatgacgctgtcatcagagctggaggccatgatgcgcatcctgcaggaccagagaccaaccgtcgtgggctaccgtgacagcgccaccgctcgatcggagaaagctatcctcaacatcacaggagacctcatccacctggccagctcagacgtgcgggcaaccgacaagactgctcagagctgggagccggagtcaccatctgcggatggtggcgtccaggctacaacctgacctctgccctcacgcccatcctcacgcgctcccgcgtgctcaaggaggagcccctgactgctggcgggccgttacctgtcttgatggaacgccagagcccctaccctggcagtctaactggaactcggagccccggcccaatgagcgcaaacttgctcagggtagcaggaggatccggccagagtccctccagggtgacagaccaccgggcctacacacttcgttcatttccccggggaccagagaccgagtggggagataaacgtctgaacctctccagacagttccgctggtcggagctggagtgtgtcccggtggggctttggtacaccgttccctgtgccagtacttaatgcgaggaggacttgggtgtcgcggacagaagggggcaggggcccctggaaggagccttgcacggccaggggcgtttggcataaacggcacctaacaggcttagggacaaactatttgaggcccaagaatgtccgtatgtgtcctgaacaaagcggatgtagacatagatgaaattggttgcagagacaaatgaagcagaacaggaaatgaaaatgaacacagg

SEQ ID NO: 572784 - DNA, 81 bp, Homo sapiens
  misc_feature (25)..(25): n is a, c, g, or t
  misc_feature (32)..(32): n is a, c, g, or t
aatatgcaggtggatggacatgggnatttggncctttttgattaaattccgctcccctgcaaataaagcctttttacacgt

SEQ ID NO: 572785 - DNA, 248 bp, Homo sapiens
agggtgcgagtggatgtgggtctgactcagcttctcccaaggctgctgccggatcatcttccttatactcactatacacattctcatcttcctcctcttccgtgttctctcctggccgatacacccaggcgcttcaaggaagcacttgcagggtggtgtggaagcagaagtctcagcttctctcatcatcctcggcagatggggtatcactgtccctcatctacctcctcctcttgtgtcctctcctg

SEQ ID NO: 572786 - DNA, 993 bp, Homo sapiens
ggtgggttggttgtgggtgtgtgttttctgtttattctctgtgctgtgttgtggtgtgtggtggtgctgccgcgcgcggcgacggtactttcaccgtggccatgacggcgcggtccaacgcgtgtgcgcgcgttttccgcttgagtcgggcctggtgcgatcgcccgggggagtgccgctctcctgcatactgttcggggcacgcgcccccccgcttggccggagcatcactgcaagctgggaaccgagagtttccctgcgcccatatcatgccgggcagttgacgggctgttttctgcgggcggactccagagcaaccctgtgtcctacatcgcccactcgagtgtgctgacacacgtgacacctattcgacgaccgccttttctgctgtcgctcaggctccaactgctgataccccggccgttagctgatgctgtcacctacccagctccgggttcccccagccttggactggatgagcctcccctgggcccaccccagccagcccgcctcgtttaaaggagatgtgttaccgatgtacccgggaagaccctgatggccgggaatctcatccatctgccaggcgtgggaccctccaagaaggagggccaagtgtacatccagtgcctatggggggtatgatggtaagcgccagtccctttgcccacttggaggctcccgggagctccctacaatcttatggctatgttgatgctacctaccgggaaggccatgacccaggaagagtgtcttgccaattctactgcccatgctctctgctttggccctggagcgggatggctccccatggaggagtgatccccctggccagcccttgccagagatccggggtagagccggccagatacttttgggagacccagatacccccattcgcccttgcccctttaccccccccctgaatcccgggattttagtatgccataagagatgcccctgtactgatgccaaatttaataaagtttgtccccg

SEQ ID NO: 572787 - DNA, 359 bp, Homo sapiens
atcaagacgcggggaccggtagtggtcccagagggctaggcccactgatatttattgcatacaagacaagggggcagggtaaggagggtgaatcttctcagtgattgacaaggtgaagtaagtcatgtgattacaggatagggggcccttcccttttaggtagccgaagcagagacggaaggcagcaaacgtcagcattttcttctctgcacttataagaaagatcaaagactttaagactttcactatttgttttaccgctatctgctacgaacttcaaagaggaaccaggagtacaggaggagtatgaaatgcaacaaagagtaatattaaaagctaatgattaataatgtttataa

SEQ ID NO: 572788 - DNA, 401 bp, Homo sapiens
  misc_feature (133)..(133): n is a, c, g, or t
  misc_feature (262)..(262): n is a, c, g, or t
  misc_feature (323)..(323): n is a, c, g, or t
gcgacagtccggatcgcgtgttgtcgtagcgtggtgtgaaacgatgcgtggcgttggaatgcgggctgcagccgttggctctgaaagcgggcatgagcgctctggcggtcatgctgatggccggacttcctcngtctgccgctgaagacacgccggcagcttcagccgaggcaaaggccgacgcgccgcgcaggccgactattatacgcgccgcgccaagtcgatcctggaagccgagaagagcagtatcgagaaaccgcantcctggccgcgtcctatccgggcatggacgttgtggtatgcgaagccgggtgcacgaccantcgcaagcctgaggtcgtctgagcaaagcgccatgccgaggccgccaagacggtgacgcaaggtttgctcgttcccac

SEQ ID NO: 572789 - DNA, 775 bp, Homo sapiens
  misc_feature (134)..(134): n is a, c, g, or t
agaatagggtcttgctctgggggggagggtggtctcggacttctgggcttctccagtcctccctccttagcctcccaaaatgctcgggattacagtgtgtgagccactagtgcctggcccacatttattttagnggaatttttttttttgagatggagtctcgctgtgtcacccaggctagaggggaggggcatgatcttggcttattgcaacctatgcctcctgggttcaagcaattcttccacctcaccctactgagtacctgggattactggcacccgccaccacgcccagctaatttttgtattttttggtagacacaggattttaccatgttggccaagctggtcttgaactcctgatagcaaatgatctacctgccttacccttccaaagtgctgggattataggcatgaaccattgcacctggcctgaattaaggaatttttaaagagtctcttgtgaccaatcaggggatttattagtacagttgaccctttaacaaatgggtgttagagatgccaattccctaagtacttgatatccacatataacttattgatgtcctaaaaacctaactactagtagcctagtggggaccagaaaccttaccataccagttgcttaacacgaatgtccgattttatgcttattatgaatataaccggatttttacaataaggtatggtgaaaaagaatatttcttcacaatcatgttgaaattccaacttttggaagctgaaggggggggctaccagacaacttggcctatggg

SEQ ID NO: 572790 - DNA, 615 bp, Homo sapiens
cggtgcctgactgaatcccaatcaagaaaacagcgacatattggtacttgatgatctattcgaaaataagctacctgaaaactacgacccgcatatcgttcaagtctatcgtttcatgaatcctgaaatgtatgacacctgtattgatcttgtagctgtaggtgatagaacagaaagcagttttcgaagtctccatagccgtgataatccatttgaaaattcaccgcatgactacaccaaaagttatagcatatcgacagatttcttcgccacaaaagaaacagcaatgcagtttgttcagcaaggaatgaatctgctgaatgcgaaagatttgagtgacgtttcgcaagctaagagcggcattgagcgctggtatacattggctaagaaagaagaaatttcaaaatgaattccatagacgacatcaaacagcaactcattatgtcatcagactggagtgcactgaatgcgtatgagatgacaaagcgagcctgtgccgaattaaccaagcatgggcaccgtgtcccttcatggaacgtgatacgcgacatcatcggcaaaggtagtgccggggatatcaaccgtggtaaggatgattttcgtaaagagcacggt

SEQ ID NO: 572791 - DNA, 599 bp, Homo sapiens
  misc_feature (34)..(34): n is a, c, g, or t
  misc_feature (66)..(66): n is a, c, g, or t
  misc_feature (68)..(68): n is a, c, g, or t
  misc_feature (73)..(74): n is a, c, g, or t
  misc_feature (76)..(76): n is a, c, g, or t
  misc_feature (80)..(80): n is a, c, g, or t
  misc_feature (117)..(117): n is a, c, g, or t
  misc_feature (124)..(124): n is a, c, g, or t
  misc_feature (127)..(127): n is a, c, g, or t
  misc_feature (159)..(159): n is a, c, g, or t
  misc_feature (173)..(173): n is a, c, g, or t
  misc_feature (193)..(193): n is a, c, g, or t
  misc_feature (236)..(236): n is a, c, g, or t
  misc_feature (280)..(280): n is a, c, g, or t
  misc_feature (340)..(340): n is a, c, g, or t
  misc_feature (343)..(343): n is a, c, g, or t
  misc_feature (499)..(499): n is a, c, g, or t
  misc_feature (563)..(563): n is a, c, g, or t
  misc_feature (596)..(596): n is a, c, g, or t
aaatcaatatggggcagtacaaaaaaagtttggnccatgaaaaaaacaattcagttaataaaaacngntaggnngngggnggggggggggggggggggcttccttctcatggttccngccaggnggnggccagggctcagttgccccaaggttgtccantgtcaacctttcangggagggaaaatggcagggnggggaagacggggagaaaattctgctgtccccagtgtagaacngggagggatttgggggtgggggtgtgctcgcaggagcctggggngggggtggggaagcaggggctttgtcagttctgtgggtttagagcccatgctgaacgganttncccctttgcccagctgtctcccacccttgctgtgttgagtctgcgagcctgggatatgctaactcgggggtgatacaacctggaagaagaatgtgaggctctcctggaaagatgcaaaaaccatctcagatccaaggggccaagatcacaaggtcnttttgctacctggggggtctgaagctttgggggcaggggctggggagtcacaatcctgtgaggnggggggagggaagagtcacaaacccaattcagngct

SEQ ID NO: 572792 - DNA, 384 bp, Homo sapiens
catcattccaaatatgtggacgaccttcttcttagcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactcccc

SEQ ID NO: 572793 - DNA, 1470 bp, Homo sapiens
tataaggtgggggccaaagcacttaactgcaggggcagggggggaggaaaaaacttataaattattcatcttaaataaaaaggagggaggggcatgtgggagggggaaaccccattccacaccagccgtgttccccttctgttcacatgggctcccttcgagcgtttccctcgggtgggggcataccacaggcatgtgggcattcttcattgtgtacctcgttcacaaccccctctccgcgcgctctcataacaaaacacgcgggcctcgtgccctcgttatagaacatctcacaaacaattttacactcttctcttcggggcggggaaaaatataggggtggaacacccaccacccagtgcgcggagcgcgcgcaccgtgagagaggagatataagagagaagagacagggcgagacaagcgcgcacgcgcgacggagaccggcgtgtgcgagacacaatatgacacgggccacacacacaccaggggggcacacagcgccacacacacaccgccgtgacacgcgccccgcgcgagacacacacgcgagtgccacctccccgcgagcgcggcgctcccccagacacactatcaactacgcacgcgactacacgcagacacacactccgcgcgcggtgcgaggactcaggcgcgccgcgccaaatgagaccccccgccacacacgtgccacgccgcggccacccaaataaacacaccgtgagaacctccacgcgactcacacagcgagaacgaggcaaacacccactccacgcgtctcccacggcgacacaccactctaccaccaaaaaacgcacaacaccgagcaccacgggcgggcacacaccccccgcccgcgcgaacgaccacgacccacactcgccaccgcgaagacaaaaagcagcgtgatcagcgagcacgcagacgcggggccccagccaaccaagcagcaccacgcacgcgcacacaacagaccccaccgacgacgccaacacagcccacccgcgcaggctacaaagccgccgcgcagacggcagcgcacacacctccggaggaagcaaagccaccagcaggacacacacccacgactaggccgacggcagctaaggacaccaccacgaacagcgggcagtatgcaccacaaaccgaacagccactctacgtcgccacacgcaacatcgaaacccagcaacgaaaacccgagcggcaccacaactcggcaccgccacgacttcaggcaagcccaacgagacaccacccaacgatcccgcacaacacacaacgccggcgcggccccgcgcgccagcaccgcgacaacacacaagcggcgcgccgcgcgcccccactcaaacacaaggagggcagccaccaacagatacggcagcgcccgcccaccatagcgaccgcccccccaacgtgcagcaccctcgccaggcagagccaccccgcgccgacgccgacccgcgccggacg

SEQ ID NO: 572794 - DNA, 832 bp, Homo sapiens
cctcatcctgctgctctcgggagccctggcctgatcgagacctgggctgctcccactccatgcaggtatttctacaccgccgctgtcccggcccggccgcggagagccccgcttcatcgcagtgggctacgtggacgacacgcagttcgtgcggttcgacagcagacgcctgcgagtccaaatgaggtggacgcctgtctgggctgcctgtggagtggatgcagtgatggtggcctggaggtatttgtggacctgtggagacacagaagtacaagcgccaggcaacaggctgactcggagtgagcctgcggaacctgctgcggctactaccaaccagatgcgatggcctgtgggtctcacaccctccagtgtgatgtatggctgcgacctggtggcccgacgggcgcctcctccgcggtgtatgaccagtccgcctacgactggcaaggattacgatcggccctgatagcgaggacctgcgctcctggactgcctgcggacactggctggctcatgatcacccagctgcaacgtgggaggctggcccgtgaggcggtagcagtggagagcctacctggagggcacgtgcgtggagtgcgatccagcagaatacccgcgacgaacgggaaaggatgaccgctgcagcgcgcggaacaccacaaaaggacaagactgtgaccaacatcccgtctctgacagtgaaggcaacctggaggtgctgggcctggggttataccctgcggaatatcaaaactgacctggcaggggaatgggaagaacaaactcaaggacagcgaagctgtggagaccaggcagaggagatgaaccgtca

SEQ ID NO: 572795 - DNA, 1012 bp, Homo sapiens
  misc_feature (35)..(36): n is a, c, g, or t
  misc_feature (38)..(38): n is a, c, g, or t
  misc_feature (64)..(64): n is a, c, g, or t
  misc_feature (69)..(69): n is a, c, g, or t
  misc_feature (95)..(95): n is a, c, g, or t
  misc_feature (108)..(108): n is a, c, g, or t
  misc_feature (123)..(123): n is a, c, g, or t
  misc_feature (729)..(729): n is a, c, g, or t
  misc_feature (966)..(966): n is a, c, g, or t
  misc_feature (972)..(972): n is a, c, g, or t
gggggggcgccctggccgcagagttggtattaaanngnttttcgaggcctggctcttgttatgntcaanattaccgtctatccctgtttgtttgngatacaccagtgnacgtccactttctanaagacaaagttatattacttaaacaaccaaagagatgaataagtggtctgaagagatgaataagtggtctgaagagattaagtgccttgcccgaggatacaatactactctatgaaggagctagaatttaaatcaccttgccttcttttaaataactgtgataagcgtgtatattttaatcagaaaaaacagttattggctgggcctggtagctcacacctgtgatcccagcactctgggaggctggagtaggtagatccttgaacccagcagctggagaccaggctgggggatgtgggggaaacttgtgtgtggcggctgtgccccctcagtccacgttgcggcggcgtgagtctcctcctcccccggcccgtccggggtcggccccgcgttgccctttcgccgccggggtcctttggcgcgcttccttcgccccgccgtctcgttttccccgcggggcgccgacccgctccccgcgtgccgtttggcagcctgcgcctccgttgcggagccagcgcgccggtcccgcctccccccgacgggcctgaaactcgtgggcatcttgcccgcccctccccctgtcttgatcacgccgcgttcgccccncacccgaaattcgcccgctttatccccaccttccgcctctccgcttctctgtttttttgcactccacatctcgcctcgccttattgtgttgcccgccgctctctcatatctacggttcgcctcctcgtcgtgctccccgacctcaggtacccatcttgcttcgcggcgcgctcattgcgcgttcaccagcgcccgcccacccatccactacgttcaccccccccgcttcgtgatttntgtcgngcgctttgccgcacgcccccgcgcaccctatcgtattcaa

SEQ ID NO: 572796 - DNA, 131 bp, Homo sapiens
gctcacatttagcactgccgagtgctgctttccacagtgccacccattcctggcctagctcttccaggatcagccaggctgtgtgcaatggcacctgattaaggcacagcatgtgcaatacaatgcatcaa

SEQ ID NO: 572797 - DNA, 101 bp, Homo sapiens
cgtcctttgaccactgtcttgtttcttaccctacttctcttatctttgatcgtatatgtctcataatgtgaaatatgatgagagtacttaggggcagcatg

SEQ ID NO: 572798 - DNA, 623 bp, Homo sapiens
  misc_feature (72)..(72): n is a, c, g, or t
agcgggagcgagcgcggggtgtttgggatgcggcacggcgagggggagcaggctggctcgggcgtagggaantggttttttgttttagctatccaggttgtgactggtttacataattacacgattaagccatcattgtaggaaaggcttgcaggagaaaaatgtcttaactggaggtctttgagacagaaaaaccctgcctcagcccttgggtcctgagagtcgcgtttcttctccccttcgcttaaatatgtaaaccagaatcattatgtttggttcatggaacggaggaaaaaaatccgtgtgcagggtcgagactgtcgtggcggaagccgcagcacccgggaggcaggaaaaggaaacctggacacaggcacgtatgagggaagacaatgtggagaggcaaggagaagatggccacctgcaagccaaggagagaggcctggaacacactcttacttcatggccctcagaaggaggccaccctgtcaacaccttgagctcagacttcagcctccagagctgtgaaaaaagaaatttttgttgtttaagcccctcagtttggggtaatttcttatggtggccctagccaatgaatacaggtcccaaataactcttcaaaa

SEQ ID NO: 572799 - DNA, 381 bp, Homo sapiens
  misc_feature (53)..(53): n is a, c, g, or t
  misc_feature (240)..(240): n is a, c, g, or t
  misc_feature (356)..(356): n is a, c, g, or t
  misc_feature (368)..(368): n is a, c, g, or t
ttcttttttgagatagggtcttgctctgttgcccaggctagagtgcaatggcngttctcagctcactgcagtcctcgcacctcaacctcctgagtagcacaggtgtctccaccacaccaggctaatttttgtatttttagtagagacagggatttgccatgtttcccaggctggtctccaactcctggggctgacgcaatccacccgctgtggcctcccaaagtgctgggattacaggtntgagccaccacctgggcccattgggtaagttttaatgtctccagggagcccttatagagccacttcattcttgaactttccccacagctgggtgaaataaattcaaagggagtganggggacagaggnctgtcaagaaggt

SEQ ID NO: 572800 - DNA, 847 bp, Homo sapiens
  misc_feature (72)..(72): n is a, c, g, or t
  misc_feature (533)..(533): n is a, c, g, or t
  misc_feature (656)..(656): n is a, c, g, or t
  misc_feature (699)..(699): n is a, c, g, or t
agcgggagcgagcgcggggtgtttgggatgcggcacggcgagggggagcaggctggctcgggcgtagggaantggttttttgttttagctatccaggttgtgactggtttacataattacacgattaagccatcattgtaggaaaggcttgcaggagaaaaatgtcttaactggaggtctttgagacagaaaaaccctgcctcagcccttgggtcctgagagtcgcgtttcttctccccttcgcttaaatatgtaaaccagaatcattatgtttggttcatggaacggaggaaaaaaatccgtgtgcagggtcgagactgtcgtggcggaagccgcagcacccgggaggcaggtggggagaaaaaacgggacctgctgccggggacccctcccgctttctggcagttttctattcagcgtcctcggctgtgagaaaacatcccagatgctgaaaccaatagtcttagcccagaatctcaaacgccgtggcaaagagggagtgacgacggcctgtggaaaaacctgaggagttntgggcttagcgccttcatgtagaggggacgtggaggcggggagggcgttctagggtcggctgcgtaattatacgaggcactggaaagtgatgggttagtgtccttggagtagacccctgggtnttattgaactgatctgaaaggctgggccctgagccacacaggngacctgtcaaacagctcaagcggaagatggggctcacgggactggacttctctctgcagccagctgtaattaacacaaaagcagaagagttgggtagatcatagaatgccagttttgaacatctttgggggacaaggcactcctggga

SEQ ID NO: 572801 - DNA, 324 bp, Homo sapiens
atgaaaacctaggatcatcttatgatgattacccaacagggcatccacgtcgaactccttcaaatccattttctccacaatccagtctgtcccggagaaggcatcctccttgactgttgttggcgggactgaccaacccatccacagccagacattcggaagagcccgacatcgccttgtcgctggagaacccatgaggtttgacgtgcttggacacctccaggtaaatcatctacgagacctaagctctcttcaggccccaaaaccgccgggtcgaacggggacatcaagtccccccccaacccctcgatgctccggacgctc

SEQ ID NO: 572802 - DNA, 209 bp, Homo sapiens
  misc_feature (27)..(27): n is a, c, g, or t
  misc_feature (33)..(33): n is a, c, g, or t
  misc_feature (35)..(35): n is a, c, g, or t
  misc_feature (115)..(115): n is a, c, g, or t
gacacggcagtcggcccgtccccggcngccgtngngatcgccccatcccagagcgcgtgcagctcgccgctcttgccgtaccagatcgagtttcccccctcgtcgcccttggganactggtcgttgacgagcaccgcgcaatgcagcggctgatgcagatcacccacgagatgcaggacgaaggcgagcccctcgaggcgctcgatcgc

SEQ ID NO: 572803 - DNA, 400 bp, Homo sapiens
gggaacagatgcagcagcaagataagacaccgtgatacgccgaggatcaaagctggcaacatagcctgggatgcaacgctggttcaacatacgcaaataaatcatgtaatccagcatataaacagaaccaaagacaaaaaccacatgattatctcactagatgcagaaaaggccttctacaaaattcaacagcccttcattctaacgaagtctcaataaattaggtatacatgggaagtatctaaaaataataagagctatttatgacaaacccacagccaacatcatactgaataggcaaaaactggaagcattccctttgaaaacgggcacaagacagggatgctctctctcaccactcctattcaacacagtgttggaatttctgtgcccatttcaa

SEQ ID NO: 572804 - DNA, 819 bp, Homo sapiens
aagctcgtcgactgattttttagcctgagtaggcctagaaagtgaactaatgctagcttttattccagttctaaccaaagaaaataaaccgctcgttccacagaagctgccagttcaagtattatcctcatgcaagcaaccgcatccataatccttctaatagctatcctcttcaacaatatactctccggaccaatgaaccatagaccaatactaccaatgcaatactcatcattaataatcataatggctatagcaataaaaataggaatagccccctttgcactttctgagtgcccagtagtgttagcccaaggcgaaccctctgacatccggcctgcttcttctcactaatgacgaaaaactaggacccccatctcaatcatatagccaagagtcttctccgctcagcataaagcgtaagccttcgtcctcacgtctcgtcaatcttatccagtcatagtgaggcagttgaggtggattaaacgcaaacccagtctacgcaaaatcttagcatactcctcaattaccgcacataggatgaataatagcagttctaccgtacaatgcctaagataagacagttcttaagtttaactatttatattatcgcgtaaggtactaccgattcctactacgtcaactttaaactccagcacacgagccgtactactatctcgcacctgaaacaagctaacatgactaacaccttaattcatacacctcctctcctaggagggctgccccgtaacgtttttgccaatgggcatttcgagaattcccaaaaaaatagctctgatcccccaattaaacatactc

SEQ ID NO: 572805 - DNA, 178 bp, Homo sapiens
tcttggacatcagcttactcagctaagtaaagtcatttaccatcatcacagtctacctgactgcatgaactctacctaactgcagtcctgcgccttcttctggattggaaaaccctgggggactgaatagtatccgctgtttcaagattgatcagccttctacaggagacgcttccgg

SEQ ID NO: 572806 - DNA, 400 bp, Homo sapiens
gagacagtggctctaagaccaatgtgcttcctgttcccaccacctcccacctcaactgagagatgcagagcccatcagcaggactgagcttctaccttggtcatccctctgaattccctcctttccacccacctccctttcctccagttgttaaattctgtccccaggatttctcacaagacaagcatgcctcatccacttgctttcatccccaattccagctcttcatctgtctcatgtctgagtactcttgtctccacgccatgagaatgcaggctttactttgcaattttataaaaagttcttgcatctatgactctgttcacagtcctgggctggctggcagccgggacactcagagaatctaaatgtgacttattacctctttcccaggcttctc

SEQ ID NO: 572807 - DNA, 258 bp, Homo sapiens
gagaggaggatctggcttgtgagcgtgagatcggatcagtcgcggttgtaaatgtccccacatagcagatattccagggtggcctgagttatgtaaatcaagtgagcaacacagcttttaatttcatggaggaatcaaagctgcacactggtattaaaactacttgatttgcgcacacagttgcatgcatggcaagctgtaacctctgggtggcattctcataggattgtcaccacctttcacctaggcaatattcga

SEQ ID NO: 572808 - DNA, 128 bp, Homo sapiens
ctgttctagaggatctcatcagtttacacaagtgtaatattattcaacgattaaaaagaagtgagctatcaagccatgaaaagacatgggggggcagggcatggtggctcatccctgtaatccgagca

SEQ ID NO: 572809 - DNA, 940 bp, Homo sapiens
gcggtggcgttcagctgcttcaagatgaagctgaacatctccttcccagtgcactggctgccatatgctcattgaagtgaacgatgaacgcctactacgtactttctatgagaactcgtatgggcacagaagttgctggtgacgctctgtgtgaagaatgggaacgggttactgtagctccgaatcagatgctgggaacgacccatcgaaggtcgccccatgtccgcagggtgtcattcgagccactgcgacgggttcggctcgcctacggagctaagcgggcattcctgctgacacgaccgaacggatgaactgcgagcaatcgataatgagaatgatcagcttagtggttgcgatggtatataccgatctcgagcgtcttcaaattgtctattgccatgaaaagatagagagggattatacgccgagatgtgatctgacttgtccatgtgacctctccagccatggagtacacccaacagcacgtcatcaatagatcttgtaacactattatccatactcaacgcaggaagattaccttgcggacacgatgtccgttggagagctgttgagatagaagaaaggctataaaaacctagcgactcaaaggcaggcgcaggattacagacgtggcgtgtcactccacgtgtattgagtcgagaaacctgtgcaggctttagctgctacttgtaccataggaaagtatgcccccgaaaatctcatgtaaggaggctctcaaaattgtctggtactttgttggagcagagagtactcgtaggggatcgaaagggaggaaaagtcgcaagcaggaaattccgggcaaagaccatgcagagtttccttcctccaaaaaaacgtttaagatctaaggttctggaaccaccggactctattgcgacattcggagttctaggcagaaatagaaccagccgtgaaactg

SEQ ID NO: 572810 - DNA, 197 bp, Homo sapiens
ctaggcacagtagatgtaagatctgaaggtggcgactgagttgccctgggctttgaatccaagaaagacagatattacgaccatgataagtgaaatagataaggaagggacaggaaaaatgaactttggtgacttgttaactgtgatgacccagaaattgtctgagacagatactaaagaagacatccgtgacagct

SEQ ID NO: 572811 - DNA, 134 bp, Homo sapiens
  misc_feature (24)..(24): n is a, c, g, or t
  misc_feature (111)..(111): n is a, c, g, or t
gaatgcttgggatcatccaggtgnctctatttataggcacctgtgttcaccagcagtctctctattagaatgcttggtgtgccaatgtttcttgaattagaagcctggggncacctaggtgtttctattataaa

SEQ ID NO: 572812 - DNA, 503 bp, Homo sapiens
  misc_feature (52)..(52): n is a, c, g, or t
  misc_feature (128)..(128): n is a, c, g, or t
gagggggaggaaaccgggttggtgtttgggatcccgacatgggtttttatanaaagaccaccacgggttatgcaggtggtttgggctgggcctttgggggcctcacaagccccggcctaaaatacagnttgggttccaattttggttttggggggggttccagttccttaaaccgccccagttcctccagggccggggttgtgaaaaagatcaaaacccgtgatgggaagggggggtttgggtcttttgaggtccggcccaagtgaaaagttgggggagcccctcccagcctacccctcttggggtgccccaaagcttgggaagggggcccttttgcagggtagccttgggaacaggaaaccccctttgggtttagcccttgcccctcaccccccctggggggttttttactgggggcccccccttgcccaggcccccaggtacaaaacaattcaattgttttttttttttggtccaaaataaacccccgggtggttttgcca

SEQ ID NO: 572813 - DNA, 383 bp, Homo sapiens
gcaggcagtccagacctgatgtggagacacatgggattttggaaatcagattttggaggaatgcatgtgacaagcgggactttcttcagagagtggtgcaccgccagacattttgcacatatgggaccaaacagaccaagactgtcgagactctggccgcccgaaggagactgctttggtactatggaacttttcttatgggacacgttctcctttcacagattctaaagtgtccagtgcattgggatgggttttcaagcaagggactcggccaatacgcatattagacctcttaaggagcagtcttccatcatgctgaattttgtctttcaagagctgtccctattgggcggggccgcaaggccaggcttttttctctaacc

SEQ ID NO: 572814 - DNA, 191 bp, Homo sapiens
ggtttccaggttttttcccaggtgacgctgttagcccctcagctggcggtgacaaccggcccagggtggcgcccccacaccccgcaaagctgtccaggcacagctccgtccccagcgctcatggtgttgaaactgtttgtcatgccccccggggtttgtgtccccccagtaataaacggtttcctgtcccc

SEQ ID NO: 572815 - DNA, 112 bp, Homo sapiens
atcctgagttaccacggtgaaacatcatctctactaaaagtacaaaaaaaacaaaaattagccgggccttggtgggcaggcccctggtagtcccaggcaactctggagaggc

SEQ ID NO: 572816 - DNA, 823 bp, Homo sapiens
cccccgcgagcgccgagatcaatgtatgcggcggcacccgggggggacgcttaaaagactacccccttctaggcttcctgcgaccctcacccctaccttccactttgggctttgcctcagccagccgctcctggaatttcttcttgaagaagagggcttgcagtcgctgctggtagtggtcaatcctgtagacaaggaggtcaatgtcactcttctctgggatgaacttgaggagctgctaagagcaggcgcaagtcacacaagcaactgggttccctttgatccaaagggctgagagggaacagattgggggaagaggtcacttttcctcatctgactttgccttggaatcccatgggacaatgactcctgaagaacacttaggcttttccagctgtccccacgaagggccgcgccaaggagggttctataacccttctccctacagaacgatatcatttggccgctctgccctcatcgggggtagcttctcaggcggttaatttgggtcgcggtagattcataatcccgacgccctgcctccggtcgcccgtcccgcggttccgatgagcgggtccagctcactctcgtgccgcggcattgggagcgcttaggcggccgatcgccccggggcacctttgaacccgcgcgccattgtccatgcataccccttgttgtcgcagtggtgggcggcagtttcacgctccgctcggcgggctgtaatgaccgaagctcgttgtgtctcgcggttgacggccgcctcccgatattagtgtgcccacttcaccccggtcacacgcccctctggtatgagcgcgcccgg

SEQ ID NO: 572817 - DNA, 168 bp, Homo sapiens
ttgtcgatgcccatccaaaggtggggtggcgaaagcggtatacgcagcggacttaaaaatccgcggagggtaaatccctcgtacgggttcgagtcccgtccccagcacacaaggtaggcattgtcgccaaggagcaatgatgtctaacctgccaagtactgagcgatt

SEQ ID NO: 572818 - DNA, 177 bp, Homo sapiens
  misc_feature (148)..(148): n is a, c, g, or t
tcttaaatccggttcgagcctacgcagcaagcattggtagcattacgttttcagagataatgcttaaagcagtatttgtaatagatacgtttacttattcagattctatttttcataaatctttatagaggaaccttaaataatttgncaaagaatttgttttcaagcctaggataa

SEQ ID NO: 572819 - DNA, 168 bp, Homo sapiens
ggctctgaaaaatcaggtgccctccctgtatggctctaaggacgtagctccatgagggcattgtgggggccagaaatgtgcacgatctgagctttctaccgtggagcattgatgctatgagttttggaaacgttcgctcttctgagcagacccctttaccagagcctt

SEQ ID NO: 572820 - DNA, 212 bp, Homo sapiens
  misc_feature (34)..(34): n is a, c, g, or t
cgtctggggaggctggttggcagggcagcccctncgggaccgtggctgggcgggggccgagcaagcgctcagagaagggctgctggggacaccagagacacggggccgtcacggcaggcttgggtgggggcagagcaagggacccgagaggggccgggacttgctcaaggtgatcctgcccgtcctggcagacccgtaagacataaccgcgg

SEQ ID NO: 572821 - DNA, 170 bp, Homo sapiens
  misc_feature (100)..(100): n is a, c, g, or t
tcgcaggagaaggaacctatacaccctttatagagctttaaatcgactgtagagttttgtggtcttccagtcccaaatgtttaattttccatttgcattntgaaatcacataactcatgtctgaaaagtccacctgacaagcatacctgctaccatatgcccttaaaaat

SEQ ID NO: 572822 - DNA, 263 bp, Homo sapiens
tccctgaacgcagcctgctgaggaccgccattgcgggcacgggtgtgaggtggctgtttaaattagctttgctgtactgggattgaagtgccatgaaacatcagctagagatgggcagctagtcgtgacaggcattttagtataggggtttggggctagaggcttcaaggaggctgttgctgcagacagccatataaataggggttggatgaggtcccttagagagtgtgtgaagtttcagatgacagccccagacagaccct

SEQ ID NO: 572823 - DNA, 133 bp, Homo sapiens
catggtcagatttgaactcttcatatcatcttgcacacatagcttgttaagatagttaagcgtgcatagttaacttccaatttacatactactgcttagaatttgggggaaaatatagaaatataattgacag

SEQ ID NO: 572824 - DNA, 147 bp, Homo sapiens
ccggaacagatagataatagtggtgagggtggtggtggtggtgatgacaatagttgtggttgtggtagcaatgatggtggtggtagtgataatggtgatggtgattatagtagtgatggtgatgctgatgctgtggtgatggtgatg

SEQ ID NO: 572825 - DNA, 1090 bp, Homo sapiens
agcgggagtgcgccgagcatggggctgagcctggtgtggtggagtgggtatctgcaggaggccggacgtgaactcccagcttagccgcgggcgcggggtacggggggctccgctgcgtgtggatcgtgcagcatgttgagcgcgtgtgcgcgtctcctggcggggcgtcctgctgcatggccccctcatgccccgatgggagtcgagtactctggctcttcagtgggccgtgaccatgggatgcgtgtggagggctaccatcacgtctcgcgcctaggtcccttcgctggggtgacgtggcttgctctggtcgtgcatgtgcacactcgtgacgtagtcccttgggcccagagacgcccgaagaatggacatggatatctgcgttgaaggttatcaagggcattgatggcttgttggagcttctcacgctcacgtgaaagcgcatgctgggggggttccaaatcgtaggcacctttgccacgcgtccaggaacgagggcgctttgatgagcgccgcgtgcaattgctggacttgtctgggatgcacacttacccaaggaaaccctttttacttttgtccctcgtaaagggaattgcatcccaacgttgtagagcaaaagcacaggattgcttggatcttctccaattctcgtggaaaccggaagtggcagaacgtgcacgtccctatcgggaagcgaattgccacgcacgtgcgaaaggtccccgctcagcaaggggggccgccttggtcccgaaggtacgacgatgggcattcgtcgcacggtcttttgtgcgaccacacaggtcttgggacgtcgttgcgttgccctgggaggctccagctcggcttccaagcatcgccatgctcgtaccgaaaacctttggttgcggggcttcaagggtagaataccttgtccttcaatggtgcttccctggaagttagcaatgtgtgacttgtcgtggaccaggacttcggaacatattgcctggggagggtgtgcaaggtcttggcatcccaagggtgggaagtacaggtgggtgggcattggggggagtcaatgtagggtgaatcctcctggaggttccagttg

SEQ ID NO: 572826 - DNA, 221 bp, Homo sapiens
gcgcgagcggacgcggcagcgcctctggtctcgcttttcttatttttcccccctttccccttctttttttctttctttctcccctcacctaaaatccaatagatgggtcccggaaagggagacgatacgagttaaaggagcatttgaaatcggtgtggtggtggtggttgtagtgtgtgtgggtggttctttgtgttgtgtgttggtgtgttgttgggtgt

SEQ ID NO: 572827 - DNA, 146 bp, Homo sapiens
  misc_feature (21)..(21): n is a, c, g, or t
gcaaaaggtgatctagagatnaacacctgttcatctaggcgtggcataggggacagaacgtagctgaatatctttattttattttatttcctttcagattcagttaaaacttatttccattcccttcctgtcgagtttattttccc

SEQ ID NO: 572828 - DNA, 132 bp, Homo sapiens
tcgctctagaggatcctgatgttatcccaacacccaacacatgaggtctgcacacacagctgcctggttgcctcggtgcactcgagctccagttacaaggaatccaagttctcaggatcttgaagactctgg

SEQ ID NO: 572829 - DNA, 142 bp, Homo sapiens
attcgcggccgcgtcgactacaattcatttataataactaacaagcatgaaacactttatggaggatacgacagaatatatagaactagaatgctgaaaactacaaaatgctatacaaaagaagtcaaagaagacctaaata

SEQ ID NO: 572830 - DNA, 1229 bp, Homo sapiens
ctcttcttttgtcggtcgccagccgagccacatcgtcgtcagacaccactggaggaatggtagaatggtcggagatcaacggactttggtcgtattgggcgcctggctcaccaggggctgcttttaacatctggctaaagctggatattgcttgccatctgaatgtacccccttcattgacctcaacgtacatggattctacatgttccagatactgattcgcacccgatgggcaaagttccagtggcaccgctctacaaggctagagaacagggaagcttagtcgatcaaataggcacaatccctatcaccgatctatcctaggggatccgacgatcccttccaacaaatcgaaggtaggggctgattgcgtcggcggcgtcgcatgttacagtcgtgtgagtcccacgtggcgctcttccaccaaccagatggaagcataggcgtgtgggctctcattgtgctgagcggtgggcacgccgagagacagcggtcgatctcatcgtctttgccccactcgtgcttgtgatgccctcgctatgttgcgtgctatggcgtgttgaactcatgaagaatgtatagagaagcgaggcctcataggactccatcgagcaattggcctccgtggagccagcctaactgtcgtatagcacccgctgcgccacaggtcgatccagtgcacaatctttcggtagtcgtcggaagggaactccattgaccacatgtcctatgccatctactgtgcacccagatagactgtgtgatggcccctccgggaaactgtggcgtgatggccgctggggctctccagaacatcatccctgccttctactggcgctgcaaggttgtgggcaagtcatccctgagctgaacgggaagctcactggcattggccttccgtgtcccactgcaacgtgtcagtggtggacctgaactggccgtttagaaaaacctgcccaattttgatgactccagaaacggggttgaaaccagccgtttgagggccccccagggcctccgggccttaattgagcccccagggggtgtccccgtagtttacaggggaacccatctctccctttagcacgggcgcgatggcccccaaaccttgtgacgcctcctggctccacacttgttgtcgacaccggggtgtctgcgtcagtgcccggtgtgactggtctcgccccacacgaaagaagtcctgtggttgcctcccactcactcttgtg

SEQ ID NO: 572831 - DNA, 358 bp, Homo sapiens
gatcgaaagaacagtgagtgggctagctttttagatttcaggtaccctcactaaggcacgaaggcttaagtagacaacatggagccttcctgtggcaggagagacaacagagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccaacttttcccctagcttt

SEQ ID NO: 572832 - DNA, 81 bp, Homo sapiens
accgaggacacagccgtttattattgtgccacagggagtgacattgttggagccgatgcttttgatatctggggccaaggg

SEQ ID NO: 572833 - DNA, 1410 bp, Homo sapiens
  misc_feature (107)..(107): n is a, c, g, or t
  misc_feature (337)..(337): n is a, c, g, or t
gaaagcggctgcctttccgccaggctttaggcagttctcggagattaacaaataacacgagcggcgacgacttaagtgttcatcgtcgtgtggtaaacgaggcagcnagcctggtaagggcaagaaagttgtgcatggtcacatgcaatagacaatctttaggagaagaagatgagcggctcttcggctgcatgatagggcttccgccgaacagcctggtgtcccgagagaccacttgactaacctaggcggagtagtatggatggtaaaccacacgtaggacccctaatgtgagtgaacgacggtcgctctatattgactgaatgcgtacgatgantagaatttgcattcttatacgttcaatcaagatcacgactttcgtcgccacatgattcctcgatcacagacatctagaatatagacgcgtcatggaggacgatacacagtgatctgatcttctcgtgagaaacatgacttctcacaccacgttgataaccgaagagtctcttacattgtcttattaagcgacgaaagaacgtgagctgaggactctggaaacataaatgtattttccgacgagatgggctatcgcgataggaaggattttcacccagaagccatgtatgctgtctatctagatcgcacagagtcggtatagagacgcccgaaaatggtaccttatctttggtacgtccacattgtcgcaatatcggacccattactggcatcattctttcaatcagaatgaagtcagtgttccgtcgtgtcgggtaagagacaacttacagacagacggcaaaggtgaccctcaacagagacaagcattaccctgagccataagtcccgtgaagtacattctttacgaacagcggctggggtcatttccatatggaccgtatggtagcaatctctcgtgttccgtgataatccctccaattgtatcggaaggacagtggtgccacagttccacaatcaaggggatgttcttattcgttcagaattcgccagaattctattccgggagtgaaaccaaacgtgcgacaattgcagggcaccctgtgggcccccggtttttccccttaacaaatctagggggctctttcgaaagggagccatggacaatttcacaatggggggagacatgacaagggggcccccaacacccccgcggaaacagggtaacgggcgagaaaacgaccgcctcatacacagcgcctcggcaacaacacctggagagtcgcgagagacacaccacgcatagaagagggagagaaaatatgttagcgacaaacccatccacgacgagcaggtagccacaccacccgcgcggcggaccacacccgcagcccgaggtcgtcgtactaacaaaacagccagtggctagtataaacacaaaaacagaaatcgcgg

SEQ ID NO: 572834 - DNA, 876 bp, Homo sapiens
  misc_feature (2)..(2): n is a, c, g, or t
  misc_feature (72)..(72): n is a, c, g, or t
  misc_feature (102)..(102): n is a, c, g, or t
  misc_feature (115)..(115): n is a, c, g, or t
  misc_feature (169)..(169): n is a, c, g, or t
  misc_feature (184)..(184): n is a, c, g, or t
  misc_feature (190)..(191): n is a, c, g, or t
  misc_feature (195)..(195): n is a, c, g, or t
  misc_feature (215)..(215): n is a, c, g, or t
  misc_feature (228)..(228): n is a, c, g, or t
  misc_feature (236)..(236): n is a, c, g, or t
  misc_feature (246)..(246): n is a, c, g, or t
  misc_feature (259)..(259): n is a, c, g, or t
  misc_feature (263)..(263): n is a, c, g, or t
  misc_feature (726)..(726): n is a, c, g, or t
angtgtatttcccattcagaaaaattcaaagcatagaattgtttagcatatttgaagtgttttcccccaganttgagaatcaagtgactttcatcttgcagntggcttcaatgangtggagatgaagatcccttcctttccaaaataagatgcacattatttggataanttagggagggctcangaaggnnttangacttggaggtcttgttcantaatttggatgantttcaaangatgattcangagagcattcaangccntggccttaatgaagtaaaaagaagaaaaaaaattttttttaagtagaatttgcaatttttattttttcttccagagaagtttttcttctagtccttaacaacttccgctccttatatgggctttggtggaggtcatggggcagcacctgcaggtctacgttggggtggaggtgttcggtccttgcctgcttcatgagctcaattcctcaccactgtgctgtgaatggcacaactcacatggtaatgtagcttcacatccagcctgggaagtacacaggcgtcaaggatgctcatttcagaaacatcgctgactgctgcggcctctacgtttcaaatgatgaatttcttagtagccttgtcattgggcacacaacaaccacagttcatacagcaaatgggctgcagtgaacagtgcacacctggttgtggacctctttggcacgaccattgctgcttctttgtnatcttggaggtgcaggcccaagaaagatgaagtaaaaatcttaatttgagggtgactaaatgaatccttcaagaccacttaccccaaatccacattctgcagacagttcaagaagaaaggcaaggtagccatctatctcaaggggctatg

SEQ ID NO: 572835 - DNA, 120 bp, Homo sapiens
agtcagggctgcctgggtggccaggcctcgcaagaggctgtccttgacttgcgtgctggcttcctgtcagcggctctgctttaaccacttgtgccctccgtagttatgcaaaaaacaccc

SEQ ID NO: 572836 - DNA, 326 bp, Homo sapiens
gtaaattttttataaatgaatttcaaaatgttataatggggctgtagggtgtttttctacatcttcattatttgggcctaaaaccagtttttaataaaaaagtttatctttcctctttctgaaattatggctccagaaaaagaaaaaaaaaatcccagtcatggaatcacccatttggtaaaaaatgctgccaaaaatgtggcagtagctgtcctgacaaactccaactgtttttactatttgaaaaatcctaggctccccatgaaaggcaaaaatggatcagttttattcttttctaaaaatggttatctgtagtttggtagcca

SEQ ID NO: 572837 - DNA, 1865 bp, Homo sapiens
  misc_feature (52)..(52): n is a, c, g, or t
cggtgtgttctccccgggtggtgtgctgctgtgtttgttggtgctggctgancgcttgtggatgcgagcatgtcgttcgtgtgattgacctcctcgctggtggagttgttggtagttctgctttcggttatcatgacggtgtgtctgattcttatggtcctgcctgtgctttcttcagtctgctggattttgttttgggggttatgtctggcgtggactcttagatgggcccgaccttgttggtttgtgagggatggtgtagccctgcgtttgtgctgcgctccgcgtgatttgtggttcgtcatgcggtggctatgcagtgggggagctctccctgcttggcctgacttgtaccttgtttgatatgtgtagatgtgtgggcgtgggagttttactttggtcgtattgtctcttgtctagctatgggtcctgcgtttgtccgctcagggtgagatgcgtctgttcccctccttgtggggatgttgtttttttttttctgttcgtctgttgatctgtgttgttgatcgccgtcactggctgtgtggtacaccacctgctgtttgttgtgataatggcacctgtctggtgtctgtcggcccctctgtgtgttggtgggcggcactatcgtcttgtgggggggagcccgcgtttgtggttgttgtggacgactgcttgttgtttggtctctttgtgttgaatatggtggtgcctttcgtttgtctcccgcggttgtttgagtgtttgtggatcgttgtgtgaacgtggtggggtgtcctgcggtcacctcgtcgtggtgtccgctttttattagaagtctcgccgccttgtgccccccttctccgcgaaagaggaggtggtgacactatgtcactactagtgtgatgtcccccacaatgaggcgcgacaccaaaagaagtgtggtgtggttgggagaggagacaacgagattggtgtgtgatgtggcaccaggagagttgtggtgttgtgaaatatattgtccgctcccacgagagaagtgcttcaccaatagtagaggggccgccttctgttcggagagcacctctctaccgccaagagagaagagagtggcgcacttcgtcggaacaacagagatttgtcgtctgattaaaagatgagaggataacccctcccgcgtgtgaggtatataaacgtcttttgagagataattttctattgtggtgtgtgatatagtcttgtgattatacgcgctactgtatagtgtccctacaattgggccctacattgcgcgcgcccgcgagtacacacacacatttgtgtgtgtgcgcgcacagggctccacacgcgagatcttctccacacgtcgtcgcgcggggtgggagatatataggccacacgcgttgctgtttcctccgcacgcgctcggcgctgcttatgcacacagtgcgccacatagtgctctcgatttgagagataatgtcgccgccgcgcggcgtgtgcgcacaagcggcactatatatatagcgctctgtgtgttgtagaggtgtaatagataaataggatatatatatatagagcttgtcgctcgtgtgtgtgtgtggtgtctttttatatatatctctctagataagagatagctctctctgggtggtgagatatatataggccacgaccagcgttaccccagagatacccacgcccccctgtgataagaaagccctgccagtagtatagaaaaccctactcaccagtaggtaaaatatatatatcccatgcgtgcgcatatatacatgtgtttaatttgattagttcccttaaaggtctcatatccttttggaccacacgtttttttgtattaataccctgattataccggcccgtggaga

SEQ ID NO: 572838 - DNA, 879 bp, Homo sapiens
gcgtggtgtgctgtgtgtactcctaaactccctgctgcccctgttagggatgctgaggtgtttatgcagcagtgtgtctggtggtgtttgctgaatcctggtgtagagaccgatggatgatggtaggcagagctggaggttggggagggacttgtgtttgcttgaacaggtcagagagtcaaagctgatttgagctggcttgtgaattgtcatctatttgcttaatcgtctcgtttggcaacgacagtagatccttgctgtgagtgcagattgcccctacgttgggttttgtgtgcattatggtacccagtgttcaggcgaagagtaagtttgtggaggtggcgtagtgagagaagatagagagcggtctggtggtttatgggttgtggaaggatggtttcagagcgttgtcgtggtagtagagatgttgacgctacgttggcagttgctattttgcttttagttggtgaggtgtggaagttgccacaggtacactctttctggcttttacatgcccgccggtgttcccaatagcaccgcgcaatttgccacgcggccggtcgccagcacttcacccttaggcgcagccgcctggccaacggcggagaatagcacaggcccggtcgccccacccgcgccatccgtcacctggcacaccatctcgcgcctctcagcgctcgcatgtttagattcgaatcggccgcatggcgggtcgtggcttcatctggtgcgagtcgcgataacattcctggtcagtcagagagaggtcacaggcgattaggccgcctgcatgggcggagacattggtggtttgacgcgcctgaacctcgcgcgtgcgcgccgctatcgagagactgggcagacatttgcttttgcggc

SEQ ID NO: 572839 - DNA, 576 bp, Homo sapiens
acagagacccaccctcccaggcactgactcccttccctgtagtcccccagtctcctaattgcctactactcaggcagaccctatggccccctagaactccctcacccaagtgctgcccattccagtaggaaatcccctcacaagcccatgcccccagatccctcagatgtctaacggttcagagtctaagccccactccctttttccccaagccctgtaccccagcagtgcagagcctttgcctggccatggctgtccaggacctcagtccacaacacggctacgcaccggacaacgactactgcgcgcgcccacgcgacaccctgggcccaccgacgcgcacctcggcgggccccataccactgcgcgttggcccctcgacacactgaactattacccagatgcataccctgtatcactcccatagcaagcacttgcccaactactaccactgacacgcaccattcacgccgatgcaccccaaggctcataccgacaaaggtccctggcattccatagcccccaagcaacaaaaggctcatggaaccctccagaccaccaccgagcgccctccaa

SEQ ID NO: 572840 - DNA, 295 bp, Homo sapiens
cagctatccgggcatacagatgtacagaactgaaattcgaatggcgaggatggcaaccaaagcgcatacttctatgtacctgcagaacccaaattggcgtaagtcatcagaatcagcaggtatcaattacagtgagcccaaaggtacgaaaggtgtagcagcttcttcgacttcgtcaaatcttcaaaggaacctatgtgcagctcacacaggctacgcattaacgatgctgaggcatagtagattcatatattgcatgggggtacccacactgcaagtcagtaaatgcaactaa

SEQ ID NO: 572841 - DNA, 280 bp, Homo sapiens
actatgcaaaactattagtacacaaatgaatatacaccaaggtacatacaccaaaacatacacaaggatgttagccataatattaatagccctaaaatgaaaataccacctgtaatcctagcactttgagacggcgaggcagtaggactgcttgaggccaagagtttaagaccagcctgggcaatacagcaagaccctgtctccacaaaaaaatgtaataattcgccaggccatgggagtgcatacctgtaagtctcagcttctcgggcggatgaggcag

SEQ ID NO: 572842 - DNA, 715 bp, Homo sapiens
gaggaacgatatggtggttctctgaaggctgagtgccgtattgcagtgccctaggcaggcctagctctgttgcttctacactccattggtcaaacctgctcatatctcaccatttactatcagagaccgaactatcccctagaatggttgtgtgtagtgcagttcacggatacacttgtcatccgagccaacctattctggctccgagcgtctgcatctctctccatctggactatgctcagaagggttgtcacgatgttttgctcctggagtctgcttccgtgctgtcttatttgaatccttgctctgcgtatggtactattccctgtggtgcagccttcattcttcatgttcacggggaccttggatcgaagcttgttgactagatctatgttcatggcgtgatgccgtatgctggacatagctgcctagatgccagggcatttaaggcctagcattatcagactttatacctttgctgggctttgctatatcaactatcacgaatgtggagcagtctgacaaaccactgtttgcgcatgtcctgttgtgaagcgctgtaccttgttatgactttcagtagctttgaagcaacttgatgtctgcctctatatgtcctctgcatttagtctatgccatttaagctgcacaataaaggaagaaaataaccagataaagtccattggtgggacaggccttctactgcttgaactca

SEQ ID NO: 572843 - DNA, 87 bp, Homo sapiens
gatggggtgtcccctcccccccccggtgtcacccccgtcttttattttgtagagtgggggcggcagtggttaaaaatgttctttcgg

SEQ ID NO: 572844 - DNA, 524 bp, Homo sapiens
  misc_feature (485)..(485): n is a, c, g, or t
ccagacctgtctcacactaaagcatgtaagaagtgcctttgcctcctgccatgattctgaggcctcctcagccatgtggaactagctgtgtaatattccacaacccagaggagcagcttgaagccagctaaactgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttgtaagcttggggctcctcagccatgactgaaacgtactatgagcacggcatctaccgggctgttccacatcctccctgtgggactaggggccagggcaatgggnatcagtgcagaaataaagctcatgctgtttgctctgaaa

SEQ ID NO: 572845 - DNA, 141 bp, Homo sapiens
caagataagggctttagtatgttgctcggactggtctgaattcctgggctcaagccatctgctgcctgcactcccaaagtgatgggattacaggcctgggccactgtgcctagggccgaacatctccactttctgatctca

SEQ ID NO: 572846 - DNA, 414 bp, Homo sapiens
  misc_feature (145)..(145): n is a, c, g, or t
  misc_feature (353)..(353): n is a, c, g, or t
  misc_feature (369)..(369): n is a, c, g, or t
catgcctgtaatcccagcactttgaggggctgaggcgggtggttcacttgaggtcgggagttggggaccggcctggctagcatggtgaagccccgtctctactaaaagtgcaaaaattggctgggagtggtggcgggtgcctgtnattccagctgcttgggaggctgaggtaggagagtcgcttgggcccgggaggtggtggttgcggtgagccgagattgtgccactgcactccagcctgggtaacagagtgagactctgtctcaggaaaaaaaaggttagagcccagaaacctgtattttttacaagcgtctcagttcagaagttcattgttactaaaacaacttgtgagnaccattggggcatggnccaattaaagttgagtttgatccattttttcagttccctattttt

SEQ ID NO: 572847 - DNA, 380 bp, Homo sapiens
agtcccttccctcttactaagagtctgtgaacccaggagcccctcgctctggcaagatgctatgactaagacgtgacaaggcacagtggctcatgcctataattccagcaccgtgggaggccgaggtgggaggatcacttgagcctaggagttcaagaccagcctggacaacatggcaaaacccatctctactaaatatacagaaaaattagccgggcatggtgttgcatgcctgtagttcccgctacttgaaaggctgaggcaggaggatcccttgagcagggtgagactacagtgaaccatgattgcaccactgcactccagcctgaatgacagtgaaaccctgtctcaaacacacacacacacacacaaccagtccc

SEQ ID NO: 572848 - DNA, 165 bp, Homo sapiens
  misc_feature (20)..(20): n is a, c, g, or t
  misc_feature (25)..(25): n is a, c, g, or t
agcagaaactgagagtagantgcanttgaacgggcctgaagcgcgtacacaccgccgtcacctcctcagtatacttcaaggacatttaactaaaaccctacgcatttatatagaggagacaagtcgtaactggtaagtgtactggaaagtgccacttggacgaac

SEQ ID NO: 572849 - DNA, 359 bp, Homo sapiens
  misc_feature (8)..(8): n is a, c, g, or t
  misc_feature (11)..(11): n is a, c, g, or t
  misc_feature (85)..(85): n is a, c, g, or t
  misc_feature (94)..(94): n is a, c, g, or t
  misc_feature (129)..(129): n is a, c, g, or t
  misc_feature (242)..(242): n is a, c, g, or t
  misc_feature (355)..(355): n is a, c, g, or t
agaccagnaanaatcctttacagctgctaggcttccttcaatccaatcaagttgacacttaatattaaccatcacaagcctcttngggaactcnaggggctcatggctttgtgattgaaatagcatcantcaaagcctgacactgtggaaagatacaaacgtgtgtggacctggttatctctggaccactggtggtttgctgggggctctcgggcccctggccacaggctaaaggccgcacngtcggcctccttgcctccgaggcttccggacccggaccgagccactactggcctctttcctccccagcccgcagatgggtcatcatgggactttgccctgtgatcgtggggtngtaa

SEQ ID NO: 572850 - DNA, 238 bp, Homo sapiens
cctaagttgaatgctccggaaactcgttggcgcgattggacctgcatgaactctacaagtacatcaacaagtactactgaccagatcatcactgccctggaggaggatggcactggaccatgtagatgcagctgggctatctggctccatgctgattgcagcatgttgtggaaaacaatggtcacaggactctactaggaacccagtgaatgccactggccttgcttgtatgctttca

SEQ ID NO: 572851 - DNA, 325 bp, Homo sapiens
ttttttttctttttggcggggggacgagtctcgctcgctctgtcgcctagctggagtgcagtgacataatctcggctcacggcaacctccgcttcccgggttaagcgattctcctggctcagcctcccaagtagctgggactacaggcatgcgcaccacgcccggctaattttgtatttttagtagagtactgggtttgaacgtgttggccaggctggtctcggactcctgatctcaggtggtcacccgccccgcatcccaaatgctgggattacaggcttatacaccctgcccgccaagatcatgtttttatttaagttattaa

SEQ ID NO: 572852 - DNA, 160 bp, Homo sapiens
gtcgtattagaggatccccccgactagccgacagcaggcgagcagagtacagccccaccccaggaggcagcaggacggggctcgtctggatccccatgacggagcgcttttcctccaccacctgacaagccgacagatccccctgtcgggctagtcgggg

SEQ ID NO: 572853 - DNA, 471 bp, Homo sapiens
  misc_feature (389)..(389): n is a, c, g, or t
  misc_feature (411)..(411): n is a, c, g, or t
  misc_feature (438)..(438): n is a, c, g, or t
  misc_feature (457)..(457): n is a, c, g, or t
taaagaactgtcaaaactcaacagctaaaaaattctaattagaaaatggagcacatgaacagacatttcactgcagaggatataaaaatggcaaataagcgcatgaaaagacatgaaaagacagtcaacagcactagtcactaggggaactgcaaactaatactacaatgagatatcactacatagctaccaaaattgctaaaataaaaaataatgataacaccaaacgctgacaaggatgcagataaaccgggtcagtcatacactagtggtgggaatagaaaatgggaacagccactccgcaaaaccatttgccagtttctcataaaactaaacatacaactgccatactgaccctcaattgctcctgggctttattacaagaggantgaaaggggttcacacaaaaantgtggctggatgtttcttttcgttttnttccttatgtttcaaaaantgggggaattcggt

SEQ ID NO: 572854 - DNA, 108 bp, Homo sapiens
ggattacaggcgtgagcccccgcgcctggccagggactatactctttttaaaatagacatttgtggggctcacccaatatatgaaatagtaccctctaaaaaaaaaaa

SEQ ID NO: 572855 - DNA, 161 bp, Homo sapiens
tatcgagcaatacattgacatgatcagatgggtgagtacagccccaatttcaagagccactgcaatcctcttactatagtcacacaaagatccggaagtagtgccaccacatccacgtaaactcctccccactgtactccactgtgtgtgtagtaagagca

SEQ ID NO: 572856 - DNA, 254 bp, Homo sapiens
  misc_feature (83)..(83): n is a, c, g, or t
tttataaaatagaaaaaaaattaaagtatattgagtgtgctttacacattttgagtgggctgggtgggtgaatttaatattanttcaaataaacattgttatttaaaaaatgctgagtacacgattaagctgaattttgttttccatcagaaaaagaacttcaggagtatataatgggctacaggggcttcccatccaaaacactgggggttcatcttttgggtcttagaccactcaggggcttcttttttagt

SEQ ID NO: 572857 - DNA, 952 bp, Homo sapiens
tctctctccctgttaagatagaagagagagagcagcacagatagacaagagagaaccagagaccaagttggcggtcactggtgacaacctgatgtgaccagaggattggcgccggggtcgtacacccgcgcaaaagttttgccgcagtccattagggtcgcgggccccccaagggggccgtctctctggccgaggatgatggtccccaaaccataccgccatggtcgggcaatccccgggccaacatagggttcccagcccggcaaattccaagtacgtccctgcaatacgcgggtgaacccccaccccctcggtttggaaagggacatacataggaattcccagggttcgcaaccccacagggaggaaacagcaggtctgccccccacgatccgagggcaggatttaatggggaacatggacaaatcacaacatgcgagcagattgagccgactgcgaaacgcggccccggcggtcgttcccccggcgagtggaaacaaccaacaattgggagaccgcgccagagacaacagggataatccggaggcgaaccacaaaaaatagggggctgaaagaaaccctgctgacagtgcccgcagatgcacagcagatcccccctggggcttattggaccaaaagcagtcgcgcagtcgcaggatacacccacgtcctgagaactttatcacgcgaggttgatacgccgctcgaccactaggcaaaagggacaacacgcgcctcagcagagaataaaaattgtctcggaaactctcccacgtagtccgcccaacaccggggggcaatgaccggcgggcttcaacgcaccaccaccataaagcacaggagagaggtccgccctcctgccaagaacatacggcacaacaaatccccgccggggaaacccaaaggacctgcaagaccctctcggaggtccttggccggacaaacaataaca

SEQ ID NO: 572858 - DNA, 112 bp, Homo sapiens
  misc_feature (78)..(78): n is a, c, g, or t
  misc_feature (83)..(83): n is a, c, g, or t
ttcaatgtgccaacaccagtggggagcccgcagccttatgtggcagcgtcaccacaggagttgtgggcctaggagagnctttngacctgggagccacacctaggagcaaagt

SEQ ID NO: 572859 - DNA, 413 bp, Homo sapiens
tcatgagacccacaacaaatagcccttttaaacggtaatccaagcctcacccccctattaggcctcctcctaacagcagcaggcaaatcagcccaattaggtttccacccctgactcccctcagccatagaaggccccaccccagtttcagccctactccactcaagccctatagttgtagcaggaatttttttacttatccgcttcccccccctagcagaaaatagccccctaatccaaactttaaccctatggttaggggctatccccactttgtttgcagcagtttgggcccttacccaaaatgacatcaaaaaaattgtagccttttccccttcaagtcaactaggactcataaaagttacaatgggcatcaaccaaccccacccccccaaaaacagggtttgttaaga

SEQ ID NO: 572860 - DNA, 367 bp, Homo sapiens
ctctctctctctctctctgtctctctctgtctctctctctctctatggctgaggatctcattgtcacgaggagcctgtcggtcatgctctcgatgctgagcgcctgcctggccgtgagcgctagacctgtgccaacgacagacgacaacattcaagtacaggccacctgcgcctgactgaacaatatcatggacaggatgacagataacacgctggtgctgggagagggcgctacagaggcggagatcagcatgaccagcactcgttggcggaaaggagtgtgtaaggcgtctggaacttatgataccacagatactgacggtaagtctcactatcccagatcctcatggaacatatcctggtcctt

SEQ ID NO: 572861 - DNA, 321 bp, Homo sapiens
gggaaatccttggggtattttaaaaggtgacatcccacctaagtttaatcattggtctctaaaaagtaaatttcaaatttttggggttaatcacttcaaatttggatagcaaaaaatgggggcttgcttacttttaaaaactggggttaagatataggtagtgtttgaacggccctccttaaagtaagttccaaatgtaaaaccctccttaagttccaaatgttttccgctaatagtttgtcctaaagcctttgccattcctaataatcgttttgtaataattgctgtatttctgtgtaataaaatttaaaaataaattta

SEQ ID NO: 572862 - DNA, 408 bp, Homo sapiens
  misc_feature (403)..(403): n is a, c, g, or t
ctaatgtagatagtctgaaattctagcctgaactttgtcttgaatttcttttgtaaaatttctaaaagtaataataaagccctttccttcatttgttccttcctttgttctttccttccttcattcattcgttcattccttccttccttccttcattctttccttcctttctcctttcgtttcatttgttcactattcttgtgctggtcacagtgctgtaagatttcatttttattgcttcatattctctttttttttttttccttttctttttttattatactttaggttttagggtacatgtgcacattgtgagggttagttacatatgtatacatgtgccatgctggtgcgctgcaccactaactcgtcatctagcattaggtatatctcccaatgctangcctg

SEQ ID NO: 572863 - DNA, 283 bp, Homo sapiens
ggataaagaaagctctataacaggtgtaggctgtatgccacttggaacataggatctagcagatccagtggtgcttgcaggttcagtgacagataggaatgcatttggagacatttgcagctggcatagatgaactgcagcacagacctttaggattttggagcacagctctgccatcatctgcagataagtactctccttttgagagacagctctttgactgctactgggagttaggagaagccaaacacttgaccatgggctatcaagttaccacacaacc

SEQ ID NO: 572864 - DNA, 157 bp, Homo sapiens
ttttctggacaaattaaagaaattcacctttgggcacgtccacttctatatttggacattttcatgtggtttctggggacttctctcttcttcattcctcttgggttttttcctgggttatttttacattagtggggcaattttaaaaggtcctgag

SEQ ID NO: 572865 - DNA, 508 bp, Homo sapiens
  misc_feature (11)..(11): n is a, c, g, or t
  misc_feature (207)..(207): n is a, c, g, or t
cctcaccctcngcggtagtggttctcctgcttcagctccttcagttctggactgccattcatgaccacccaatgcagtaatttggtctatttttttggtacagacgggggttctccgtgtgttcaggctgatcttcgagctcctgacctcgagtgatccggacccctccgcctccctgggtgctgggattgcaggcgtgagccaccngcggccccggtcaatttagtaaccaggaaggaatacatctgcctggcgtggtgcctccccccttgtgatcccaggactttggaaggccgagtgtggcagatcgcttgagcctaggagttccagaccgcctgggcaacatggtgaaacccggtctctgttttgagacggagtttcacccttgttgtccaggctggagtgcaatggtgcgatctttgcccaccgcaacctcggcctcccggatttaggtgattctcctgcctgggcctccctagtagctggggtcgacgcggccgcgaattta

SEQ ID NO: 572866 - DNA, 984 bp, Homo sapiens
  misc_feature (807)..(807): n is a, c, g, or t
  misc_feature (836)..(836): n is a, c, g, or t
  misc_feature (840)..(840): n is a, c, g, or t
  misc_feature (845)..(846): n is a, c, g, or t
  misc_feature (866)..(866): n is a, c, g, or t
ggggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttcctggaggatgcccatcccagaactggatctgtcggagctggaaggcctgggtctgtcagattaccaggccacctacaaaggtcaaaagacagcagcgttgggcaaacatgatcgggcaagcaactgcagcagaccaggagaaaaaccctgaaggtgatggcctccttgagtacagcaccttcaacttctggagagctcccatgtgccagcatccactccttcgaactggacttgctctaaggccaagacttctctctcccatcaccttgccctcatggtcttccctctcaagccccttcctttccactcctttcccattttaaatctgtgttctctcccctaatgtgttggttggtgctgatgaatctgccagagtgaggtccatgtattcattaatctatctggctactccatttctctcaaaaagcctcaagtcacaaagtaaatggtcaagcaatggagtactgggtcacagggattcctcttttcccccaaatttaatcagaaataggctgtgggacctgggagttgtctggtgtgcacanggcacaccggttggcgcataaaaaggcanaagnctacnncaatctggccgggacacaantcttaagggggagcccaggatggcgtcgcacacagttacagaagaatcactgtgcccatttcaaccaggggcagcaatacacagaaattcactcatcgtggtggtcacatacttatga

SEQ ID NO: 572867 - DNA, 1040 bp, Homo sapiens
  misc_feature (767)..(768): n is a, c, g, or t
  misc_feature (779)..(779): n is a, c, g, or t
  misc_feature (801)..(801): n is a, c, g, or t
  misc_feature (810)..(810): n is a, c, g, or t
  misc_feature (845)..(846): n is a, c, g, or t
  misc_feature (877)..(877): n is a, c, g, or t
  misc_feature (923)..(923): n is a, c, g, or t
  misc_feature (928)..(928): n is a, c, g, or t
  misc_feature (943)..(943): n is a, c, g, or t
  misc_feature (947)..(947): n is a, c, g, or t
  misc_feature (974)..(974): n is a, c, g, or t
  misc_feature (976)..(976): n is a, c, g, or t
  misc_feature (1003)..(1003): n is a, c, g, or t
  misc_feature (1019)..(1019): n is a, c, g, or t
  misc_feature (1032)..(1032): n is a, c, g, or t
  misc_feature (1035)..(1036): n is a, c, g, or t
ggggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttcctggaggatgcccatcccagaactggatctgtcggagctggaaggcctgggtctgtcagattaccaggccacctacaaaggtcaaaagacagcagcgttgggcaaacatgatcgggcaagcaactgcagcagaccaggagaaaaaccctgaaggtgatggcctccttgagtacagcaccttcaacttctggagagctcccatgtgccagcatccactccttcgaactggacttgctctaaggccaagacttctctctcccatcaccttgccctcatggtcttccctctcaagccccttcctttccactcctttcccattttaaatctgtgttctctcccctaatgtgttggttggtgctgatgaatctgccagagtgaggtccatgtattcattaatctatctggctactccatttctctcaaaaagcctcaagtcacaaagtaaatggtcaagcaatggagtactgggtcacagggattcctcttttcccccaaaatcttacanngcaactagtcntacttggtcacctagagcactnacactcaangagactattttactcatatacactcatcatcttanntctattctctcagcagtacacaatatctcanggtatcaactgtagttaattagtactctcaacagtatctaagctantatantcttcttttttactncttnatcttttactagtatagagtgtagttnangagtaattagcaataatgtaatattanattgagtctatctttnaacgttcctttanctnnctta

SEQ ID NO: 572868 - DNA, 434 bp, Homo sapiens
tcctcaccattcagagcgggggatgcacctgtgtgccgatgtctgcgccatcgcgcgtgataggagcctgggccacccagaacgctggcctcacccttacccaagtttcagtatacccattctggaataggacaaatctgcagacaaaagcaaggatgggaataaaggagctgaataatgcaaagcacacactccatttaattatgtgcagagagaggacttatctatttaagtccatgaaatattcgcacaaaaaatcatgtattgtgccacacaatagtcacacaaattgccagatgtgacacatgattcgattacacatcaaatacaatcctagggctacaaactgtagcaacaccgttgatgggctatgagcttgcgctaccgtgagacccatttcggccagcttttacattattactatgcgcagacgc

SEQ ID NO: 572869 - DNA, 483 bp, Homo sapiens
  misc_feature (414)..(414): n is a, c, g, or t
  misc_feature (452)..(452): n is a, c, g, or t
ctgctccgcccctctctggaccccatgtgatgggaggatgtgctctcctgtgtgaattaaggaaaggactcgatggtgtgtggggatggcaagaaaccgagatggtacaaagagcactgtcctgagttggcagtccttgctgccactcccagctgcccttcacccagctctgctggctttgggccataatgtcccatctttggaaatcagagccagattgaatgattcctgggggccttccagtttttctagtttatgaatctgtgaagtagagcccacatagagaagggaaggtttcaccctagttaccaagcagttttgacttagccctgaagggccacgggaatgggagattttggggttgaggaatacctgcttatacttttaggcagaggaaggacagagcagagaggnggaatttgaagatgcaaaagagacggtaactggcaggngcaccatggcgggtagaaagccaagggttag

SEQ ID NO: 572870 - DNA, 230 bp, Homo sapiens
ggtcgacaagtgactaaaattttgaatttcttatagagaaatatctgtgaggcagggtgtggtggctcatccctgtaatccttgctacttgggaggctgaggcaggaggcttgcttgagcccaggtgtttgaggttacagtgagctatgatcatgccactgcactctccagcctgggcagcagaaagagaccctgtctcttaacaaaaacaaaaaaaaaagtcgacgcgg

SEQ ID NO: 572871 - DNA, 204 bp, Homo sapiens
agagatatatgcaatctggtagtccattaaatgagagttacacttaaaatattttagttcttttaaagaaaaagtctccatgtgctatttgggaaaaccttcattgcctaaagacccacttgcataattaaggcagatgatgatgatctttatatatgcgcacacacacacacacacgacacgacgacacacacacacactcta

SEQ ID NO: 572872 - DNA, 537 bp, Homo sapiens
  misc_feature (2)..(2): n is a, c, g, or t
  misc_feature (88)..(88): n is a, c, g, or t
  misc_feature (93)..(93): n is a, c, g, or t
  misc_feature (96)..(96): n is a, c, g, or t
  misc_feature (141)..(141): n is a, c, g, or t
  misc_feature (148)..(148): n is a, c, g, or t
  misc_feature (156)..(156): n is a, c, g, or t
  misc_feature (179)..(179): n is a, c, g, or t
  misc_feature (187)..(187): n is a, c, g, or t
  misc_feature (215)..(215): n is a, c, g, or t
  misc_feature (253)..(253): n is a, c, g, or t
  misc_feature (280)..(280): n is a, c, g, or t
  misc_feature (295)..(295): n is a, c, g, or t
  misc_feature (301)..(301): n is a, c, g, or t
  misc_feature (310)..(310): n is a, c, g, or t
  misc_feature (316)..(316): n is a, c, g, or t
  misc_feature (321)..(321): n is a, c, g, or t
  misc_feature (327)..(327): n is a, c, g, or t
  misc_feature (370)..(370): n is a, c, g, or t
  misc_feature (402)..(402): n is a, c, g, or t
  misc_feature (436)..(436): n is a, c, g, or t
  misc_feature (440)..(440): n is a, c, g, or t
  misc_feature (453)..(453): n is a, c, g, or t
  misc_feature (468)..(468): n is a, c, g, or t
  misc_feature (470)..(470): n is a, c, g, or t
  misc_feature (476)..(476): n is a, c, g, or t
  misc_feature (518)..(518): n is a, c, g, or t
tnttttttggggaagttcaaccttaacagaggtgacaattttaaaggttggtttaagaaaatagaacctgaggggaattgagacggangggtncantgcaagaagggttttgtgtgtgtggtttttttgtgttttgttaanttaaaantgtctttntcgcgcgtgctcctttacacganttcaaaanctaaccgaaaactcggaggaaaggtgcntgttaaactgctgggaaaacgggtttgttggtttcgcncttttatgtattttcccactacgccgnacaattgcggtgtcncgggcnaactcgaantggcgngactncgaacnacgttttgtttttcttttgtttttggggggggtagtggtattngtgcgcggccttcttttttctttttattgctntttatttggttggtctggttgggtcttcggtggntttnatccaagaagttntccagttgttctatnanaattcnttttttaaaccttgatgcttctttaatgacattttgtaaaantattagtcttgtttgtaaa

SEQ ID NO: 572873 - DNA, 107 bp, Homo sapiens
cctccagggacgatgtgtctctccaggtctgcacccaccttgggacgccctaaagtagcaaggcgggagccgcttccccagctcagagcccctgccccaccccgcct

SEQ ID NO: 572874 - DNA, 200 bp, Homo sapiens
tttggcgtgccgaacccagaaaaggtgggctgtaggaactgaggacggaacttagggagaaacagctaggggggaggtagggcctgggggagcgccccttgccccaatgagaaggagccagaacccctggatctgcatgcaaggcttgctccaaatgcctcgttcacagcaggcccatcccacagcccgcccctggtgcg

SEQ ID NO: 572875 - DNA, 967 bp, Homo sapiens
ggagagaactagtctcgagttttttatattttttttgggaagccccggcacacgggccaaatctgcagggcccggagcagggcgccttcgtccacgaatccctccaggggcacagttcaccacacgcacccccttcttgcacggggcaaaggtgttgtcattcagcaagcctgtcgtggagggcaggaaaggcgtgtgcacaggtgatgaaatcacagagaggccagatctcctccaggggcagcgtgattgaacacccaaaggaggccgaaacctctgtggggacacgtgagtggggctcaatacccttattagtctttcatcccaagaggaacgtgcatccgggatagcataccgtcttcttcccaatcacgtggcccgaggccagagaaattcccgagggctcgttgaccagttcagactcgtgttcccagtgaaccttcttgcgcgctacccattgtgccgcgatccttcaccgaaagaccgtcgaccgtggggaaactcgtcgcctgtgcccaagggccccattgaactcatttccacaaaaggtgacgtccatgacggacacatgaaggcatagtaccccatggggggagtgtcacataacccaaagatgcccattcctttgaatagcgggacctccaagtattcccaacaatgttggggtcccaacaaccccgtggggttgcacaaagcccctgtggcccccacacacaccgtggggagtactaacatacagcacgtgcggatgcagactggacccattacaagaggggcgacaccccctatggggtgggccaccaaacggcgaacacacatataaagggcgcgctctgaacaaacggtcctgtggcacgatctccaggcctaatcgagggccaccaccgcatatggccaaaaagcggtacaccggcttatatgcccaacacaaccctgcggaagcccctcacaatctgtggagaagaga

SEQ ID NO: 572876 - DNA, 180 bp, Homo sapiens
ggggttgtcggggatgctgtggagacggtgaccagtgatgccctggccagacttggaagaactcggcggcactaccatcaaaggtgatcccaacggctcccagttctacgagatcctgaccgacccctcggacgacaccaagggcttctttgaccctattactatccatcctcatcctag

SEQ ID NO: 572877 - DNA, 1112 bp, Homo sapiens
  misc_feature (172)..(172): n is a, c, g, or t
agcggaggacgtcttcaacacggtgggcgccgacatcatccagcatgccttctaaagtcgtctgtagttgggaacgcaggagcagcggaaagagctccgttgctagcaaagtccttggtgtgggagggacctgcttcccagaggtactggaattgtcacccggaggaccatntcagttctgcaactggtccatgtttcacaagaatgatatagacggtaataacatgtaggacgaagaaaatggagtggaagcagaagaatggggtacatttcttcacaccaaaaataagctttacacggatttcgatgaagttcgacacagaacattgaagaactgaagacaggaagagaacttctctaggaatagtaagtaacgggacgtaagccctgaaccagattcatcttaagattttttcagccaacgtagtcaattggacacttgtggatgtgccaggaatgaccaaggtgcctgtaggtgatcaagctacggctattgagcttcgaatcagagagctcattcttcggttcatcagtgatcctaattccattatccgtcgctgtcactgctgctaatacagatatggcaagcatcagaggcacttaaactttcaagagaggtagatccagatggtcgcagaaccctagcttgtaatcactagagttgatctcatggcatgcggggtacctgattgccatggctgtttttcgaagggaacggggtaatcccaggtgcaatttgcgatattcgggagacgtacaggagagcccataacatttacaccagcaacaagggcaggagaacccccgagaaaaatactcttctcaaaaattttccggtgggccaagaaagcggcacagcgtcgcgggagatctccgagggcgtgagcccacacacgcagtttctcacaagtgacgacaaatacgagtagcgaggtacaaactcaaataacgacgcaccagtaaaactaccccaactacacaaatacaagaaacaacgtgcactcaacaagaagacgagaacatatctgaacaagacacccaaacatcgaactcctttgcttcttgttttctcttgtcttctcctcgccacttacacaacagcagaacaaaag

SEQ ID NO: 572878 - DNA, 105 bp, Homo sapiens
tccacacaggagagaagcatacaagtgtgaggcgtgtgggaaatgctttacccgtattacagatctgcatattcatttcagagttcacactggcttaagttagca

SEQ ID NO: 572879 - DNA, 2408 bp, Homo sapiens
atcatgtaatttcacatatttcgcagaataatcttgggaaatattattttcatccgttttctgtaagtaacaggacccagcaagagaccagggtccgtgagggccttgtgcagggagggcccttgaaatcagggcccccagcagctgcccacgctggagcctctcttgtgttctgggtgcacgccatgacggtgctgataggacacacaggtggcccagagcctcttactacgtcaagacagcgggagatgcatgcagtagcaagtgcacagaaagtgggcactgggtggaaagtgttgctttataaatagccagatctcaatcatgactaagaagaatgtagaaaaatgataaaattaccagcctcaaaaccttggtgcgtcaccgggttccccacttcagctggctgccctagctgcactgtacagctcattactggaacgtcgtccaggcctgtcatatgcagagcccttgggactcacaagacgctcaaatacttaccatcctcagtctgattctttcatataaacttgcagtcgtttttgtgaaaagaaaaaatgtgtctgaaatatgagaccaaaaataagcttaaatgatgagtgatggcaaattggggaggcagtcagttgactcaccatgcagtggaacgacttgctctctcactgctgcaggtgggcacactacgagaattgctcttctgtgtcacctggttattgtgttttttgcattaactgaggacagaaagggaggaaaaatctctttttgtgcacatactcctttgaattgtatgtttggctttttttgttttgtcaaaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgat

SEQ ID NO: 572880 - DNA, 210 bp, Homo sapiens
tggccatttggtccaataagggagagacgggagtttgggagccccatccccatcccctccttcctgggtttccctaatagggcacagccctctggccaggagctggggtttatgctggggtagcctctcagtcaccatggccatttcatttgctgtgtggttagacttccaggaggctgtttagctctaatgaagatgatttggtgctta

SEQ ID NO: 572881 - DNA, 1768 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgaaaacaacaaaaaaaaaa

SEQ ID NO: 572882 - DNA, 401 bp, Homo sapiens
  misc_feature (11)..(11): n is a, c, g, or t
  misc_feature (26)..(26): n is a, c, g, or t
  misc_feature (45)..(45): n is a, c, g, or t
  misc_feature (58)..(58): n is a, c, g, or t
  misc_feature (87)..(87): n is a, c, g, or t
  misc_feature (101)..(101): n is a, c, g, or t
  misc_feature (127)..(127): n is a, c, g, or t
  misc_feature (175)..(175): n is a, c, g, or t
  misc_feature (184)..(184): n is a, c, g, or t
ccccacccttnttattataaaatagntgatgtgtttaattctagnaacccattttatntttggtcacaaaacaacactgcccaaaanaatcgcatttaagnatttagaaaattggcccatatgcggntactgacgcctgtaatattagcactttgggaggccaaggaggttggantgcttgagnctcaggagttctagaccagcctggacatcatggtgaaatcccatctctacaaaaaatacaaaaagaaaattagttgggcatggtggtgtgcggtgtattcctgtggtcccagctgctcaggatgctgaggtgggagaatcacctaagcccgggaagtcaaggcttctgtgagccgtgattggccactgcactctaacctgggtgacagagcaagact

SEQ ID NO: 572883 - DNA, 822 bp, Homo sapiens
  misc_feature (6)..(6): n is a, c, g, or t
  misc_feature (34)..(34): n is a, c, g, or t
gggctntggtagaatgtaatgtatgtctttcagngagaaacgccaacgctagtcgtcaggaatttccagcgagcaggatccctagactatgagctcatagtgaaaatcacagcacacctagagaaggggcctcagaagttatggcgaaagatagcacacctgcaaagactcagatgttagaataggagatgcaaatatgtttaatgtgtttgaagaaacaaaggagaagctaaggagcataaataagcaagagagtatcagaggctaagcagataataaatgaaccaaatagaacgtctaaaaatgaaaaatgtaataattgaaattcaaaacttaatggaagtaatcttgatccctacctcacacaccatagaaaattaactcaatgaatcatagacccaaacatgaaattcaaaactatgaaacataggaaaaaagttttgtgactataggttaagtaaacatttcttagatatgacaccaaaaatagagcctataaaaggaaaaaaattggcaagtcatactttaataaaattaaaccttcttgctatgtgaaaaccattgtttagagaatgaaaagacaagttaccaggagaaaacctttgccagtcatgtagctgattaaggacgtgtaaccagaacatacaaaaaactgtcaaagctcactaatacaaaaacaacttattttgtacagtgggcaacagatttgagcagacactccaccaaagaagctctctaggtggcaaataagcactgtcctctgggaaatgcaaataaaaatcacaatgagaaactactgcacacccgtgagaatgccttaaa

SEQ ID NO: 572884 - DNA, 659 bp, Homo sapiens
tggcgttgttccacgccccccttgggaggccccacgttgcatcggttttgctgctattgtgttggcccggcccccggttatcagcgcggtgacccgttccccacacaagcgcggtcggccgcaccagacagtagctttttcgtcgtgaggttggctacggcgtcttccctcgcggtggattgcctcacgttagctgatcggtagccgggggaccaagactgacagttctattgctcccctttgcttgccgctcgctcacccgcccgtccgtccaggttcgcacggcgcgggaagaagagcgcgcgtctccagcgaactctatggttggttttcacaacatgcgcacctcgtgataaggtccatgatagggttcataacctccgctggaatacaggcgaccacctactgtcgggacggattaacccgccccccacaagtgtgcaagcagagcaacactttctgtcgggcccccaccgtgtgcaagttatcatgtttctatgcgcgtggatgaccgccctcttgagtctattggagttctataaaactcctcagtttctttgtgggcgatcacactgattagcgccccaatagtgcgtccgcaggatcgtctggagacccccactaggagatatcaaacagggagaacatagcaagaaaac

SEQ ID NO: 572885 - DNA, 451 bp, Homo sapiens
ggctgaggccgccagctgcatgggatgtgcaggcggtgatcaactttgcaaagcttaaacattattttcccttcttcctcccttccctttgaatattccctctcaggtaaaggttgtggccagaaagcacgggcagcctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgaaaacaacaaaaaaaaaa

SEQ ID NO: 572886 - DNA, 331 bp, Homo sapiens
agtttatctgattacagaacaggctcctctagagtggatatgaagcaccgccagtgtcatttgagttttaacgctgtggctcgtagtgttctggcgagcagttaagtagatttaactgcttgaggttcagggctacgcatagtggggtatctaatcacagttcgggtcttacctatcgtgtgtaccagatatgttcaagccacttacgtagtctatctttgtgtcaactggagtatcacctacaactcaggtgagttccacgctatatatgggaagggggtgactctaaaacactcttatacgccggcttctatctgacttgggttaatcg

SEQ ID NO: 572887 - DNA, 813 bp, Homo sapiens
  misc_feature (6)..(6): n is a, c, g, or t
  misc_feature (34)..(34): n is a, c, g, or t
gggctntggtagaatgtaatgtatgtctttcagngagaaacgccaacgctagtcgtcaggaatttccagcgagcaggatccctagactatgagctcatagtgaaaatcacagcacacctagagaaggggcctcagaagttatggcgaaagatagcacacctgcaaagactcagatgttagaataggagatgcaaatatgtttaatgtgtttgaagaaacaaaggagaagctaaggagcataaataagcaagagagtatcagaggctaagcagataataaatgaaccaaatagaacgtctaaaaatgaaaaatgtaataattgaaattcaaaacttaatggaagtaatcttgatccctacctcacacaccatagaaaattaactcaatgaatcatagacccaaacatgaaattcaaaactatgaaacataggaaaaaagttttgtgactataggttaagtaaacatttcttagatatgacaccaaaaatagagcctataaaaggaaaaaaattggcaagtcatactttaataaaattaaaccttcttgctatgtgaaaaccattgtttagagaatgaaaagacaagttaccaggagaaaacctttgccagtcatgtagctgattaaggacgtgtaaccagaacatacaaaaaactgtcaaagctcactaatacaaaaacaacttattttgtacagtgggcaacagatttgagcagacactccaccaaagaagctctctaggtgggggggggcccggtccctaaacaatcaacatccccggcggtgagaaaaggggttacgccttgggggcgtta

SEQ ID NO: 572888 - DNA, 940 bp, Homo sapiens
tccccaactccggtcgtgcggccgcccgggagggctctgcagttgcgcagtttgctccccggcccttttcccctccgtccccgcgctcctgacgccgggcgtgacggtcaccacgcccggcggccgccattacagagagccgagctctggagcctcagcgacgaaggaggaggcgcagcgggccgaccgccggattacctgcggtgaagagccagcggcccaggcgcccagccttaaaggaggccgccaggaaggtacacggaggaaacccggcgccgttgttgtgcttttgttagcccccgtgtgtgcgcgtgcccccgataagggaagcggcagatagcggaacagccggatttggggggcgcgtgttgcccatttcctttgggccgcgaacactctgtgtccccccaaggcggatggtcttgccccacaggggtgtcatcggacgcatgtttggaacgcagatttgccaggccggtttgttccacgacttccccatgtgttaagacgaacgccctcgttggaaagaagggccttaagagacgctcccttgaccaaaaaaagaacttccatcgtgtcgcgagagcgttccgatctgcccccaggtacccgttgcctgtgctggcagcattgccctgtggcgccaattccctgtgcaccccccggtgacccccttgcttgcgacgttggggtgccaacctcccccggttttcccaattttcccgtgtgtcctgggagcattttttgtgcgcccgcggggctttttcttccgctggaagccgttgcccggtgcgtggcgccccaaaacggtccggtccgcgggtaaccgcattcaccattgctggggggccacctgtgcgcgccgccgccccaccccagttttgggggttcttgtagcgcgtgctccgcacctcgtgacccccccttgtggcacacttct

SEQ ID NO: 572889 - DNA, 145 bp, Homo sapiens
gttagtctagagatccctgcttgatgtactgctgcttagtgtcacatgtgatcagcgtctcctccccaatctgaatggtggggctgatcccagcacctagcccgtgagctccgattgtcactgtgacagtgcacttgttggtgtc

SEQ ID NO: 572890 - DNA, 280 bp, Homo sapiens
  misc_feature (226)..(226): n is a, c, g, or t
gataacagggatatttaccttttgaagtaataaaatattgcatgtatttttctgctaattattttttgtcttttgatcttgtttaaaacatcttttatgtagtcatgtattttttcctttacagcatctgggtttcctgcattacttattaagaagctttcaccacctcgcagttgtagagatagtccccgaaatattattccaataaagtgttttcctcctttcntccctgcctcctcttccttccttccaggataacatttagttctttattctgact

SEQ ID NO: 572891 - DNA, 12288 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 572892 - DNA, 12045 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 572893 - DNA, 995 bp, Homo sapiens
cgggcgcggcccgagcgcgcaacttgcctagccggagcccgtgcggccagcgcacggcctcaacccgcatcggacccgcgccccgcggccgatgcatgggcgcgcgcgctcaggcggcccctggcccgggcgggctctgctgctgctgtgctgctgttgtgtgctcgggctgctgggcccctgggcgcgcagggggcgcggggccgggcggggcgggagaagaacaggttaacgccgcagggtcaaacacctttctcccagagcgtcaggggccatgtcggggaggagaacgtgcgcgccgatcgagaagttctggccgaggctgacttgggagatttgtgcggggagtggatatgtggtggagaacgcttgtggaaagtttggacgaggctccttggatgtcttggaggttgaggtctccgaatcctgtcccagtattctcaggcccgagcctcggttgtccaagtcagcccggggcgcggggcgctccgtgggggccgggcgtcgtccttcctggccatacgtggttcttgtcccggctgaccgcttggggcttcactttcgggcgtcctggacggttgggtgttcgggcgcttcgttctggatcgggggggccgccctgttcccatgttccggggtgtaccttctgccgagtccgagggcgagccgggaaacgcggggctggcggaagcgacgggggggccgacgaaatcatgagccgggccagggctctaaggggggaacagtccaaggggcccggataccccggcaccccacggtgtgggagaacggtgtgcccctgggaagagcggcggagcgccaaccgtctaagggggtgtcgggcggggcctcaggacatataagtgcccggggggcgccaaaaacagcgtttaaagaagagaaaacaccgcgtttaaaagggggggggggggacaaccgcggcggacaacgcaggaggcacacagggcagcacaacagggcgacgccaaacacgt

SEQ ID NO: 572894 - DNA, 12130 bp, Homo sapiens
agcggggcggcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcaggtatgcggcagttgggggcgtggcccgtgcgggagctgcaccggccctggatgatgaggcgctcttgatgtgattcgcttcccagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 572895 - DNA, 12080 bp, Homo sapiens
ctggctccgcgtcggccggtcggtttggtcggttgtagtggcctcgccgcccggtccgctgtcgcagcgctcatccgcgccgggagcccttggctgcgtcgcccggcagccgcgggagcatttcctgaagacgtagtcatgcagcacgtcagcagctcccagagcagccagcgccatgtccagtggcctggggcctgccccggcgcgggcgaggagcagccagcgtgctcccagccgtccctgcccctcacactgccatcccccagccaccaactacagcagctgatggtccagacccagagtcccacgcagcccagtccggggccggggcaggccttgcagaatgtgcgtgcaggtgcccctggccctgggctgggcctctgcagcagcagccctacaggggacttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggccttcaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcagcaacagcagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccagcagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcaactgcagtcgcaagggcagatgcagacccaggcaccccagccagcccaggtgcccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttataaaaaaaaaaagaaaaagtcgac

SEQ ID NO: 572896 - DNA, 863 bp, Homo sapiens
ttggcccccgctgtgcttcgccctctttttttcagacctacagtcctcctccccctttggtaggctttcggccccaccacaggggtccccatttttctgtcaggaaggcgcttctgttcctgggtcaaccaccgaggcctgctcagggctttcaacctgccggcattttttcactttctcggggtgactcagtgcatattagttaagtccttctgtgtatctaggaaatgttaatgtcacttacgcttgattctcaaaatggacttctcaccgtgcccccatttttcactaggccctattaagagttgtgaggtacgccgaggagaaggcaatggtgcggagtcgagactatgtactaagggcgccctcaataccctcataagtcagagaggagagaaggcaaaagtgcccatacctggtcttcaaataaatagttgcttcacaaaagcagaggtcccaccagagaaggcctagaaaagaggcaatttgttcctgcttcatatgcggaaaccccagtggttatcaatacaatcctcaactataaaacaaactttggtatactgtttaggaggacaaaacacatgatcattgaaaactccaccttcaatggaaaaatacatgacatatattaatttccatgcagggcaatacatgaaaccaaacagctgcacaatatgtgatgtgacacacacatgtatgtgtaacagttcaagcgagggaagtcctgcatcacaataaaggataacaaacaagatcagatgaagacaatggtgtataccatgggatgggttcaaatgtagtaaacatcattagcagtaggggattggaggcagagaagaattcagcacgcagactactttgat

SEQ ID NO: 572897 - DNA, 727 bp, Homo sapiens
gactcctgctcagcatggctgctttagggactgttctcttcacaggtgtccggaggctgcactgcagcgcagccgttgtgggcggccgcccagtgccgactacagcagcgactgcctgccagcccccatcggttacgggccctttaccgagctcccagattgtcaatatgcggatggcgccctgttccccccaatgaaaggccagtttcgaaagaaaaggtctgacaggggaagactggttgtggcaaagaagggagtgggtatctggggttgttcaccggggaaatgttgggacggtcgtgctttttaccaaggcatggggaaggctccaagggccaggcaagaaaatgtttggacggggaaagaacccaagggggaaggccgggggaacaaattggctttttaaaaccccaaagaggggggtttcaccatctgggaaggggagcacccccaattttttcccccgaggcttccaatttaaaagaacggggcccaaccgttgcgcgtgtactttcccttttttttccctttcaaaagaagaactacatcagtataggactgcactcatcaacaacatcacacaacaatgctgtgttggtgtggggggccgcgctgatctggtgacgccccgtcggcggagagaagagcttctttgatgaagaacacaccatgcggtcgtggtgtggggggcccggaagccagggccccccatagtgtgtggcgtgtc

SEQ ID NO: 572898 - DNA, 346 bp, Homo sapiens
ggtcgacgggagacagacaaaagaatcaaagaagtaattcagccgggtgcggtggctcacgcctgtaatcccagcactttgggaggccaaggcgggtggatcacgaagtcaggggatcgagaccatcctggctaacatggtgaaaccccgtctctactaaaaatacaaaaaagttagccgggtgtggtggcgggcgcctgtagtcccagctactcgggaggctgaggcgggagaatggcgtgaacccgggaggcggacgttgcagggaacggagattgagccactgcactccagcctgggcaacagagcgagactccgtctcaaaaaaaaaaaagtcgacgcggcc

SEQ ID NO: 572899 - DNA, 369 bp, Homo sapiens
  misc_feature (147)..(147): n is a, c, g, or t
  misc_feature (366)..(366): n is a, c, g, or t
atactgggtacctaagttgaaaaagaaccccacaaatattcaaaactaaattgcaaaactgcaaaatgagagcattagagaccagtggttggtttttattcttgttttaattttcagcgctttgtctggtacctgccatgtggcgtnttttaagtgtttgttttgttgatgatcaaataaaataattgagaaaataacttttttccaagcttgggcagatattgagaattaagaaagggacagtttaaaattatatccatcaagtacactgatgaaacttaacctaatgggccttgggcccttttgggaaaacctgtttatgtttaaactaggggcaatgtttaccaatgtgtacatctttccaantaa

SEQ ID NO: 572900 - DNA, 329 bp, Homo sapiens
  misc_feature (120)..(120): n is a, c, g, or t
  misc_feature (188)..(188): n is a, c, g, or t
  misc_feature (267)..(267): n is a, c, g, or t
  misc_feature (323)..(323): n is a, c, g, or t
ggaaagggtccctcctgctgctgctggtgtcaaacctgctcctgtgccagagcgtggccccttgccatctgtcccggcggggctgccgatgccaggtgacccttcgagactgttgaccgnccgcgcctgtccactacatcataacctctctcagaaatgtcagcgaattcataacggatacccatggncgggggtcattaccaaggcataacagtgcacacttttccttgcaccccgagacaaggagaagccaacagataatgattntggctgtagcagatattgcatctggatgagcttgatattggcacggagactggatngcccgg

SEQ ID NO: 572901 - DNA, 490 bp, Homo sapiens
actaatttttgtatttttagtagagacggggtttcacctagtttagccaggatggtatatacaccacattttgtttatccattcatttgttgatggatatttgagttgcttccaccttttggctgttgtgaataatactgctgtgaacatggttgcacagctatctctttgagtccctgctttcaactcttttgggtatattcccagaaatggaattgttgtatcatatgataattctgtttttgaggaactgccatagtttcccatagtggctgccccattttacattcccatcaacagtgtacaagtattccagttactccagatcctcaccaatacttgttattttgtagggttggttggttttttgttttcttggcagtggtcacctcaatggatgtgaggcggtgtctttttgtgaattgcagtttcctaaaattagtgattttgagcatcttttcatgtggtcgttggccatttttgtatcttt

SEQ ID NO: 572902 - DNA, 206 bp, Homo sapiens
tgccaaagcgtagtaccaaaaaaataggccgggcgcgatggctcatgcctgtaatcccagcactttgggaggccgaggcgggcggataatgaggtcaggagattgagaccatcctggctaacacggtgaaaccctgtctctactaaaaacacacaaaaaaaattaggccgggcgcggtggctcacttgggtactacgctttggcag

SEQ ID NO: 572903 - DNA, 145 bp, Homo sapiens
ggcccccctgtggattgcaaccaaaatggggacttcctgggtatgggaggtcactccctctactcactgagtctaggattagggagggttattgccccaacctattgcaattgggagagtggagggacatggctcagacctcctc

SEQ ID NO: 572904 - DNA, 326 bp, Homo sapiens
gccctacatctccccgagaagaggtgaaagagactgctcctatctgcttctgcatcaaacttcaggctcaagacctgtccagaaaaaaaaatgtcttctttcagggatgaactgctgtcctcatcagacgccttattttgtttagaattcaagctcacttgacaggttattgtgaagattaaatgaattaatacatgtgaagcaactgtaacaactcttgacatgcgtgggctggactttcagaagaaacgttgtcagaactctgcccaactgaaaacaagcctactaaaaataaataaataaataaaattttaaaaaattgaaaa

SEQ ID NO: 572905 - DNA, 369 bp, Homo sapiens
gcgtcgaccaacaccataatgcctgttggtttacgtaaaaatctccagttagaaatagtaaccataggctaggcgcagtggctcacgcctgtaatcccaacactttgggaggctgaggtgggtggattacaaggtcaggagttcgagaccagcctgaccagcatggtgaaaccccatctctactaaaaatacaaaaatcagccaggtgtggtggcacctgcctgtaatcccagctactcaggaggctgaggcaggagaatcacttgaacccgtgaggcagaggttgcagtgagccgagattgcgccactgcattccagcctgggtgacagagtgagactttgtctgagaacaaacgtagaaaagtcgac

SEQ ID NO: 572906 - DNA, 201 bp, Homo sapiens
  misc_feature (4)..(4): n is a, c, g, or t
  misc_feature (7)..(7): n is a, c, g, or t
gggntancaggaatggctagggtagaaaagaaaaggggactcccagatctgaggggcatattgtcctaatgggaggggtgcaaaaggcacgtcagaagaggaggtttgagcggggcatgattagtcagtgcttactccaccagggcacagtgtcgggggggctcagtgtcaacacctgcccacctctggcacttggagagc

SEQ ID NO: 572907 - DNA, 249 bp, Homo sapiens
gagctccaagcacatgatctaatagattttataaccagtgcgcggggaccatcaatactgccggaaagaggttggaaggatctgaaatatgacatatcgtagatctggatgcattaaggagatgacaggaggaagaggctggagctgcccccatgcagtgcctgctgatgtctcaggtcggccaagcagcctcccgtagagcacagcttctaggccattatctccaaagggcaggggcacagtctgggc

SEQ ID NO: 572908 - DNA, 1852 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572909 - DNA, 1085 bp, Homo sapiens
gctttatctttacaagtgtgccactgtcaacttggctcaccctgtatagggattgcgcggcgcttgaacagctcaaatccatagagagcctttcgtattggtctccccttgttgtgtcagctggcgtcttttccaacagtaagccaactcaagttcccagtacccattcctggcggatgacttcagacattaggattggtcaggtgtattttcttataataggcgcattcagtttcggaaaaggacagctgtttcattaatgtcgcacggtaaaggaatagtggcgtactacaggtacgtacgcgtgctgcgtgctcatatttgttcctcgtgatcatattgtatctctcaaagtttggaagtatatctcgtgtgcttttgctgtttttctatgcttcctggaattctaggggactcatgagatgacttgaggttctaagagttctgcaagtgagaagacactacatggtcagcagcttgccacatgaagaacccaagctcctgtcaaagttgtgaatgcgactttggatgagattgaagaaggcccagtggacggttggtcttgaagacgtggcacgtgtagtgcgattatgaggaccgtctcgcagatccatcaagatcaaaggagggagagctgttcttggctgtttttgtctttgtttgcgtcttcttatagcattttgctttattcttcggaatgtaattttcctatcggcatgttaactcggtgcacatcgtgtaacctgtctggtgagcaacctactaattgggatgagttctacggtacatcgtgtattcgctgactcttggcggtacaactaactgttgtatataatacagtctctgccacagatgcaagtgacctcttcaggggccacagagtgcgcctgaggaaggataagcttcaagctggccatgggggtcgctcaaacagtcactccaggcttagatgatagactagcctaggtcatcagagcccagactctcacagagactaaaatcagagctctgtcttgttatcgataaatttcatcgcttggaaaaagaaatgctgaaagccagtgttagaatatcggggtgaccaa

SEQ ID NO: 572910 - DNA, 2865 bp, Homo sapiens
  misc_feature (2331)..(2331): n is a, c, g, or t
  misc_feature (2550)..(2550): n is a, c, g, or t
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatgctgggggaacagaagggataagaccttttatttttctcaggaaggattgtggaagacttcatagagtnagtggcattggagattaccttgaagtgaaggaagacaaagaaggaaaagagatgaggcataaagtgatgaaaccaggcacaagaaagtgtgcggtgtgttctgggacaaggaatgttctgctactgtcgaataatggggactaaagctggcttgttctggggaaagctcatataacgtatggattttattcctcaatagtaggataccaaatactggtnttgaattggggacacatactgggatacaagggccagtaattaaagttggagaagggctggaaacttggggagatttgaaggagaaatttaagttctaatatggttggctttttgggaatacagtttttaaattgacggggattattccattatagatggtggattactttttattgaaaccggttaaaagagtgtaatttaataatgtgcgatgtaaatcatgatacattgcaaggagaaggagacaagtaggtgaaaatggatagggatgggaggggttaaagcacgggggttgtgttagatgtatatgtcctt

SEQ ID NO: 572911 - DNA, 2318 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctaaaaaaaaaaaaaaaaaaaaaaaaaaaaaaaaaaggggggggcgggtttaaaattttcccctgaggggggcccagttaagccggtccccagtttttttgtccaaagggggcccctatataagggggccgtttttatataaagcaggagcagggggccgcgttttaacaaacgtctcgtggagcttgggaaacaacctgtctgactgtggggacatttttggagaggaggaaaacccttaatcttgtgcgtggggtggaccttcatggcgcgcacactcttcccctgacaggagaatttaaaaagcgtctgagcggtaaacttataaacactttgccagcggttcttttaggtgttggttaacaccgagggcggcaatttgtgctggcgcgtcttgaaaaaaattttgggctgcacgtgatttgcatttcttggaagtatttttttttcgcgggactctgtgtgtaac

SEQ ID NO: 572912 - DNA, 1890 bp, Homo sapiens
gagagagagagagagagagagagagagagagagagagagagagagagagagagagagagagagagagagagagagagagagagagagagagagagagcagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572913 - DNA, 405 bp, Homo sapiens
cgctaacggaagataccttgcgattgcttggaaaaaatcgccccttccagcactaatatatctgagcacatcctagtcgtcgatagagtgccttggctcgccaggtcgcccgacgatacgaacaaaggcgcagtctacatgcgcgattccgtcgccgatggaggctcgctgcttgggctggtgaaaaatgcatagtgagatactgggccggtgactaagccgggaatggccttacacgaagacactatcgcctgacagatggtaagtaggaagtgtacattgaagcaactgtatatcggaaacagccattaatagagccttgactgaccgtgagcacggcgatctgggtagatgtgctgtgcactactcgtgagacctgctgctgccacggtccccggactgggg

SEQ ID NO: 572914 - DNA, 211 bp, Homo sapiens
agtcacacagggaggtgatacatgttcgtgtaaatgatgtaatgcaaaatttgtttaatcttcgccttaatacttttttatttggtttgattggggaactgatgagccttcgtgccccccttcccccttttttgtcccccaacttgagatgtatgaaggctttgggtctccctgggagtgggtggaggcagccagggcttacctgtacact

SEQ ID NO: 572915 - DNA, 2671 bp, Homo sapiens
  misc_feature (2137)..(2137): n is a, c, g, or t
  misc_feature (2356)..(2356): n is a, c, g, or t
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatgctgggggaacagaagggataagaccttttatttttctcaggaaggattgtggaagacttcatagagtnagtggcattggagattaccttgaagtgaaggaagacaaagaaggaaaagagatgaggcataaagtgatgaaaccaggcacaagaaagtgtgcggtgtgttctgggacaaggaatgttctgctactgtcgaataatggggactaaagctggcttgttctggggaaagctcatataacgtatggattttattcctcaatagtaggataccaaatactggtnttgaattggggacacatactgggatacaagggccagtaattaaagttggagaagggctggaaacttggggagatttgaaggagaaatttaagttctaatatggttggctttttgggaatacagtttttaaattgacggggattattccattatagatggtggattactttttattgaaaccggttaaaagagtgtaatttaataatgtgcgatgtaaatcatgatacattgcaaggagaaggagacaagtaggtgaaaatggatagggatgggaggggttaaagcacgggggttgtgttagatgtatatgtcctt

SEQ ID NO: 572916 - DNA, 1799 bp, Homo sapiens
ctcagttgctaaacctgaggttctagccaaagaggagcttcctcctcttctctgaacggactcctgtagcttgcaacaagtagctatggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572917 - DNA, 596 bp, Homo sapiens
ggccccccccaaacccaaaatttgggtgggttaaaaattttttgggaaaatttttaaggggcaaatgggaacttttttttaaatttttttgggaaaaaggggaaaattcccccaatttccgaggttttttttggagggtttggacccaaaaagggggaaaggggaaaaggggaagggggccatccctttgggggaacaggggggcctttttcccatgggggggattccactttcccttcccgacccattggttgaaaagaaaaaatgggggttttggcatttttccccaatttccccaaaaatccagggggccccccgggtttgggaaaaaattttcgggcccttttccctttaaaccttaggggattttaaaacagggttcctctcggttttaacccggggaggtcgcctctgggggggtccccccccctccccttaccacaggggacaaaaataaaccccgggagttcaaagggggccgggcatggggccccgcctttggaggggggccaaaacccttttatagaaaaggggggggtttcccctttggaaatgggggggagggcccaccctttttgaaaaaattgaaaaaaaaa

SEQ ID NO: 572918 - DNA, 2051 bp, Homo sapiens
  misc_feature (715)..(715): n is a, c, g, or t
  misc_feature (722)..(722): n is a, c, g, or t
  misc_feature (729)..(729): n is a, c, g, or t
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaagtatgaaatattataattacaaagatcttaaaagcatatttcactgttcacattttttctttttaaaatttctttataactattatatgacattttcctttatcaggactttataacaatttaaaataaagggttagttttgcagaatacatgactggaggcattaattactttgaaantattatntcttttngccccaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572919 - DNA, 1000 bp, Homo sapiens
ggatgcacggcctgggttttaactcggccgaggcggggatcaggtcgctgagaggtatacctcttctgggctcaatgatggacaacaatgaagcgcctggcctacgccatcatccagtatcctgcatgaccatgctccggcacggtggtgcctctcgatcctgattgctcaggagagcttggaatgtctgccatccatgtgcctggatgacttgctgtttgtgtggtgactggtagaatgacatgtgaccttgcgctccctcgagactactgcctggagatattttgaatgctggcttgcctactggtgcaatggagatgccctgcaatgtgaccatgatgtgagcccctgctggctgaaccctctgacctttacctgacggagtggacatcaagcagcatggcagagctgcctctaaaccagaacgtgaaacgagcagatgaaagttggacacacactttgaatcgctagcctgtgcattatgctacggcaaagccatccgagctcaacctcagaacaatcgccgatcttatttctagcaaacatgagcctgcgagcctaacatgcaaaactctggctatctacgcatgtgcgcggtgcagtgtgacgtgcatgagcgtggccaatccttgcattttgcgcccgtgcctacaagaaaaggccttactggcaggactgcggcctggctgcctctccaagaactgtcaacacaaaggacaccggttggaagggcccgatgtggcatatacctaacatcagtaacagggctctggacagcgttggtaatccactgactacgccgtacgacattacaagtatccacacccttcaatgacttagcgggagtcatgaacgtctgggtgaatgtcactccaggactcacggcaccggcgctatggccagacttcagaacatacaccgagctaagagacaacctggctacatgagcctgttttgtacccttttaccatctccagagtatagcacctctgatcggcag

SEQ ID NO: 572920 - DNA, 514 bp, Homo sapiens
aacttatatatcttaaagcccaatataaccctcttgtaacaagtggggaatatgatatgctaccttgttttaacctgaattgagtctcccttagctgagagagccagacaaactccattttggctccttcacttgcagctccttgcccacccaattcctcaaggacttaacttgtgcaagctgactcccagcacatcagagtgcaattaactgataaggtcctgtggcaagttatgcccacagttcccaggaattcgctcgggtgatagtatcctaagcccctgcatttgtatccagtagatagcacccaaagcccttgcacccatcaccttgtgatggatttaaagcccctgcacctggaaccatttgttttcctgtaaccatttgtctaacttttttttgcctgttttacttctataagattgctatagctaggctccccttcccctctctaaaccaaagtataaaagaaaatctagccccttcttcagggctgagagaattttgagcgcta

SEQ ID NO: 572921 - DNA, 1997 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaagtatgaaatattataattacaaagatcttaaaagcatatttcactgttcacattttttctttttaaaatttctttataactattatatgacattttcctttatcaggactttataacaatttaaaataaagggttagttttgcagaatacatgactggaggcattaattactttgaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572922 - DNA, 783 bp, Homo sapiens
  misc_feature (18)..(18): n is a, c, g, or t
  misc_feature (79)..(79): n is a, c, g, or t
  misc_feature (82)..(82): n is a, c, g, or t
  misc_feature (84)..(85): n is a, c, g, or t
  misc_feature (87)..(87): n is a, c, g, or t
  misc_feature (90)..(90): n is a, c, g, or t
  misc_feature (96)..(97): n is a, c, g, or t
  misc_feature (166)..(166): n is a, c, g, or t
  misc_feature (169)..(169): n is a, c, g, or t
  misc_feature (173)..(173): n is a, c, g, or t
  misc_feature (189)..(189): n is a, c, g, or t
  misc_feature (195)..(195): n is a, c, g, or t
  misc_feature (209)..(209): n is a, c, g, or t
  misc_feature (319)..(319): n is a, c, g, or t
  misc_feature (363)..(364): n is a, c, g, or t
  misc_feature (382)..(386): n is a, c, g, or t
  misc_feature (388)..(388): n is a, c, g, or t
  misc_feature (392)..(392): n is a, c, g, or t
  misc_feature (416)..(416): n is a, c, g, or t
  misc_feature (421)..(421): n is a, c, g, or t
  misc_feature (436)..(436): n is a, c, g, or t
  misc_feature (459)..(459): n is a, c, g, or t
  misc_feature (598)..(598): n is a, c, g, or t
  misc_feature (612)..(612): n is a, c, g, or t
  misc_feature (614)..(614): n is a, c, g, or t
  misc_feature (639)..(639): n is a, c, g, or t
  misc_feature (691)..(691): n is a, c, g, or t
  misc_feature (747)..(747): n is a, c, g, or t
gggtttggaggggaaggntggggtgaaaatgcagatgtgcttgcagaatgtaatacttgttttcccttccccctccccntcntnncnccnattgtnntcccggcgcgtctggggggctgagacaggtggttcgcctgaccccaggagtttgagaccagcctgggcnacnctgngggggcgcgcgggctntggcgnaacatgcaaaactnggctggccatggtggcatgaacctgtggtcccagctactccggaggctgaggcaggactgctcgagccggggaggcaaaggctgcagtaagccaagatcacgccactccnctccagcctgggcaacaaagcgagacccagtctcaaagaaaaanntaaaaaaaaaaaaaaaannnnngngggnttgcccctgggcataaaacaagtnttggngggtccgggtcatcntttacaagggttgaattcctccngggtgtgggttggggtgagatttccttttaggtactaaggttccccaaggggttgtcagacagggtttggctgggccagcagagacttgacaactccctctccctaacccgctgcccacctgtggaaactcccaccccnccgaccaacagggngngggaacaagcaccctcaagggggtnaagttctagaccccatgtaataaaaggtggtttcaaggccagatgtacattntttcattaaccctcacaatgcactctgtgaggtaggtgcaaatgccagcatttcanagatatgggccttgaagttagagaaaattcaacagt

SEQ ID NO: 572923 - DNA, 1825 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572924 - DNA, 1760 bp, Homo sapiens
agcgggctgagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtccccta

SEQ ID NO: 572925 - DNA, 589 bp, Homo sapiens
ctggtgttcggaggagaggcgctcgctgctcctgagctgcctggtaagctgggctggtgtgcggtgctaatgtgatcttacccatgatacacacccttataccaaccatacactgaggtgtatgtaagagggagcgtaagcatcagctgcaagccagctgcgtggtggagtgcatgtctcgctccgtgttcgtactcgatgaaggcatagccacggggcttacctgaccgcttactgtagaccatgtgtaatacttttgataaggtccgtacacctcaaactctctccggagcttggataactgttgtgtcataacttcactctcgccacgaaaggaagtcttgaagagatcccccttgagcattgggatcattgtgaggggtccaacattttaagctctgactccacttcttgctgtacggacgctcaaatctttacccgtctattcctctccatgcgctcctctcgggtacaagaacaagtagcagacgggcctctacgaagggctctcaaacctcgaatgtacgggcaatgccacaataaggttgatgtgtgtctacatgtggcgttctcaggggtggacgtatga

SEQ ID NO: 572926 - DNA, 276 bp, Homo sapiens
cattactacatgcaatcaaagtcatttgaaagtaagaccatctcccttgtggcaggtatctcggtataaagtaactttacaacatatgtgcgagaacagaagagctttacaccactgtcattatgttacctatagagacaaaactactaacacaagtaatatgggctacaattataacacaaacctgtgagagggcatgatacaattaaatttggagggccttcttggattattatcactactactgtctgctcacaatttctgtgcccatttcaa

SEQ ID NO: 572927 - DNA, 974 bp, Homo sapiens
  misc_feature (18)..(18): n is a, c, g, or t
  misc_feature (22)..(22): n is a, c, g, or t
  misc_feature (101)..(102): n is a, c, g, or t
  misc_feature (133)..(134): n is a, c, g, or t
  misc_feature (144)..(144): n is a, c, g, or t
  misc_feature (148)..(148): n is a, c, g, or t
  misc_feature (150)..(150): n is a, c, g, or t
  misc_feature (159)..(159): n is a, c, g, or t
  misc_feature (168)..(168): n is a, c, g, or t
  misc_feature (238)..(238): n is a, c, g, or t
  misc_feature (244)..(244): n is a, c, g, or t
  misc_feature (255)..(255): n is a, c, g, or t
gcacagccaggaggcggngtgnaagtggccgtggggcgggtatgggactagctggcgtgtgcgccctgagacgctcagcgggctatatactcgtcggtggnngccggcggtcagtctgcggcagcggcagcanngacggtgcangtgnanggagagtgnggcgtctgnctggggtccgcagtttcagcagagccgctgcagccatggccccaatcaaggtgggagatgccatcccagnagtcgnggtgtttgaanggggagccagcgaacaaggtgaacctggcagagcatgtacaagggcaagaagggtgtgctgtatggagttcctggggcacttcagccctggatgttccaagacacaactgccagaggtatagtggagcaaggctcgagcgctctgaaggccaagggagtacaaggtggtaggccatgtctgagtgtaactgatgccttctgatgactggtcgagtggggccgagcccacaaggacggatggcaacggttcggactcctggactgatcaccactgagggcctatcgccacaggagacagacttataactagatgatatcgctgagtgtccatctatcgcggaactcgacgtcatcaagaggttctccatggtggaacaaggaatggctctaagtgaaaagccctgaattgtggaacccaggattggcacaggccttaaactagtatgcctaggcccgcaaatatcatctccacagatctgaacgcccttggggcagactaatttcctacaacccatacacctatatctccaccatgccaagccccttgtgcatgggagccccatgccaatttcaactatcggcccacaatttctcaactaaaccacttgctcatagaccaccactcactactacataccacacaaaaaaccacgacaccacaactcacaccaacctatcacactccaaaaacattcaacactcacactaccacaacacca

SEQ ID NO: 572928 - DNA, 255 bp, Homo sapiens
gcacagggccagcaggatagaggctgagcctcggaggggacgtgagctggagagagcaggctagtggtttccctatggatagaatatcagaatctggccaggcgcggtggctcacgcttgtagtcccagcactttgagagactgaggtgcccagatcatgaggtcaagagatcgagaccatcctggccagtagggtgaaaccccatctctactaaaaatacaaaatttagcggtgcatgtggggaggggggtacc

SEQ ID NO: 572929 - DNA, 271 bp, Homo sapiens
ttcgattggcgggcacttagtgaaaccaatctctactaaaaatacaaaaattagccaggcttggtaggtgtgccctgtagtcccagctactcaggagcttgaggcaggaggatcacttgaacctgggaggcggaggttgcagtgagccaagatcgtgccactgcatccaagcctgggtgacagagtgggactctgtctcgaaaacaaaacaaaacaaaaatcaagtccctgtaagttggccgccaattcgaaggggtacccgagctcgaaa

SEQ ID NO: 572930 - DNA, 569 bp, Homo sapiens
  misc_feature (31)..(31): n is a, c, g, or t
  misc_feature (40)..(40): n is a, c, g, or t
  misc_feature (65)..(65): n is a, c, g, or t
  misc_feature (102)..(102): n is a, c, g, or t
  misc_feature (115)..(115): n is a, c, g, or t
  misc_feature (255)..(255): n is a, c, g, or t
aatttcccctaatccctggccactcctgaanctttgtggncttaatctcaaaaccccttaaacangttccccaaaggctccctactttgcaccaactccccngggtaatacccantcaatccctagggcatcaaatcacccacctgttatactgacaagtctgaaatccttacatcctaacctcgtctccctaagctgactgaccctcttcatttaaaatcttacaagcacatcaggtcgggcaccttggctcanacctgtaatcccagcactttgggaggccgaggagggcggatcatttgaggtcagtagtttgacaccagcctgggccaacatggtgatatcccgtttctaccataaaatagaaaaattagccgggcgtggtgccgtgcgcctgtaatcctagctactggggaggctgacatgggaaaatcgcttgaacctaggaggcggaggtttcagtgagccgagatcacaccactgcactccagcctgagcgacagagagaaactgtctcaaataaataaaatttcctataagcacatcaaatttgacatattgaaaaaaaa

SEQ ID NO: 572931 - DNA, 239 bp, Homo sapiens
catctagaagagttgcagtttataatatttcatcacctcatgttttcatctatctacttaagatatgggtaatttacaaaccacaattacagtgttataatattccatttatttctgtgtacttactataaccactgagtcctttgccttcagatgatttcttattcctcattaacatccttttctttctgattgaagaattccctttaacatttcttgtaggacaggtctggtcgacg

SEQ ID NO: 572932 - DNA, 118 bp, Homo sapiens
gccagcgccgaccgccccaaaaatactcccaccgggatcagggcgattaatgaagactcaacggggactaaaaaggggccccaaaaaaaaccaaaccacctttctacgtaccgtatag

SEQ ID NO: 572933 - DNA, 327 bp, Homo sapiens
accgccagacctatccagatgatactgcagacaaagggtgaggcaacaggagacatcactaccgactgttgatcaggcacaggaagaacgtgcaatcttacttccaggatttcacatctggaagaatgccttgggagctgtgggtagcccaaggactgttcccaggcaaaagaagcaggcacagggcccaggtactcaggctccattttgacccaacgctttattgtccattttacaacagtgctcatctttttggctttacaaacgtgcgtgatgaattagattttccaactattacactcaacaaagcactgtaaaactaaactc

SEQ ID NO: 572934 - DNA, 326 bp, Homo sapiens
aaactctcgcggccaagatatataacaagatgtaaaacatctatagatgaatggataaagaaaatgtggtatatacatacaatggaatattattccaccttaaggaagtcctgctgtatgtgacaacatggatgaccctgcaagacattacactatgtgaaagaatccagtcacagaaggacaaatactgaatgatttcacttatatgaaatatctaaaaatagtcaaattcagaaaacagagagtagaatggtgattgccaaggactgggaggaaggggaaattgggaattgatgttaggtaggtatcacagccgcgcagagttt

SEQ ID NO: 572935 - DNA, 398 bp, Homo sapiens
  misc_feature (14)..(14): n is a, c, g, or t
  misc_feature (20)..(20): n is a, c, g, or t
  misc_feature (25)..(25): n is a, c, g, or t
  misc_feature (40)..(40): n is a, c, g, or t
  misc_feature (42)..(42): n is a, c, g, or t
  misc_feature (61)..(61): n is a, c, g, or t
  misc_feature (117)..(117): n is a, c, g, or t
  misc_feature (143)..(143): n is a, c, g, or t
  misc_feature (147)..(147): n is a, c, g, or t
  misc_feature (160)..(160): n is a, c, g, or t
  misc_feature (168)..(168): n is a, c, g, or t
  misc_feature (202)..(202): n is a, c, g, or t
  misc_feature (233)..(233): n is a, c, g, or t
  misc_feature (244)..(244): n is a, c, g, or t
  misc_feature (248)..(249): n is a, c, g, or t
  misc_feature (259)..(259): n is a, c, g, or t
  misc_feature (271)..(271): n is a, c, g, or t
  misc_feature (308)..(308): n is a, c, g, or t
  misc_feature (381)..(381): n is a, c, g, or t
  misc_feature (393)..(393): n is a, c, g, or t
  misc_feature (396)..(396): n is a, c, g, or t
ctcagtacatcatngtgcanttacntctattttcctcagngncctgctcctagggaactgngacctaagcacaattagatcgctaagataaagctcaacaggacatatcaataagcncaacttgatagagcctgcttctctgnagcnccagcacctctgnccatcagntgctgctgggctgctgccaatgtacatgtagggngcagtcttctgctccccattcaagcttaccntgtagctcggnagtnnaaacataagngctgctgtacantgtaagttcccatcataatgctagctctagataccanattgacaagtggtaaatttgaggtcagaaaacaggagtgttttcctcagagatctccataattgaaagaaagnataaaatgcttnttntt

SEQ ID NO: 572936 - DNA, 374 bp, Homo sapiens
gaggcaaaaacttttatttcctgattttaaaaatcggccccatcataaaccccctggctttttttggatttggggtctaatgggtcccaacagggcctttacacagcccctttattcccctttttgggcctgcccatgagcctgagtgtgacaaatcaattagctttgtccctccaaactgggggagcaggactagacttttttggcaggcaaagagctcctcctcggccagtgttcgagcctggtccaccactcctcaagtcttcttgcttttggcttttggggccttggcatccaacgtgctttgggcatgagtgaggggctttacagcattaagcacaagggcttcaggcagcaccagccacagggctttc

SEQ ID NO: 572937 - DNA, 110 bp, Homo sapiens
atgagtacgggagagaagagaacaagattactatcagtaatgacaggggccgttggaggcaaggaagacatagaacgtatggtccaggaaccagacaatagatacaaagc

SEQ ID NO: 572938 - DNA, 2177 bp, Homo sapiens
cgtccacggcagagccaaggggtcctggaggccgtgggggagactcggaaaccagagggtgggcggtgccagggtgcacacagcaaaccggggctgagccaggcctgggacaccgagcccagcctctcccctgcggtgtgactgtgggtcccagggtggacgtgccggggcccccagccagtgcaggagaggcctttgagcagcttacctgagaagggcccatggggagctgggacctccggcctccgtcgcaagggcctgcgctgctctgagggcccgtcggcagctgggtcagggccacggggagctgggacccccggcctccgtcgcacgtgcctgcgctgctctgagggcccgtcggcagctgggtgcccagggtcccgaaggctcagggtggccctgaggaggctggagctccaccgcatttttcatatgaggaacccagcacgtcccgcctgcctccggcccctggaggctttctcagtgacaaaccgtttctgtttctgtcttgttttctcagacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgttctaaaggccgtccgggactgcgtggagaggaacgggctccacagcgtggtggatgacgacctggacactgagcacagagccgcctcggcgaggtagtgtccgccggccgctgcgcgtcccgaaactgagacagaggggccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgcggttttggaggacccgatgaccaggcgtcctgcgagtccgcccgctggcctgcagcacccacctcggacttggctgtggacggttggtgcaagtgcatcctgcagggctggctgtgcgcagctgtgggctgacctttgcagagttttgtggaatagtttgcaatgtcataaaagtgcaataaaggtacagcagatgtg

SEQ ID NO: 572939 - DNA, 197 bp, Homo sapiens
cgctggtattgagtggcatgtgaggctcgagagctgaaggggagctacgtccaccagcctgtgggtctttcggtttttttttggtggtggtggtggttttttaaggatggagttcgctctgtcgcccaggctagagtacaggggcacaatcatagctcactgcagccttgaactccgggactgaagtgatcctccgg

SEQ ID NO: 572940 - DNA, 1018 bp, Homo sapiens
gcagagggcgtccttactccagtatttccatgtgcttccctgacccgggccggcctgcccaccaggtccctcgaatcggggcctctcagcgtttgagctctgctctcgccccgtccctctcctcactcctgcgggagaaacggcccctgttctttccgccccacgttgtcctcgtgagtgtgtagtccaggtcctgtttccccacagagactctgcaaaaaacacggggcccagaggtgaaggcagctccaggtggggtcaccccgaggcagggcagagcggctccgtcccctcccacacccgtgctcccgctaatgcagcctcagcgccgcagcccgggcgggtccatctgcagacgccaaggtccctgccgcagtgtttctcttctgctcctcatggcacgcgccgggctccccagaatctggcctgggccccccgtctcacgctggctccccgcaggtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtgagcctgtcctcgcccctgcacacccagggaagggccggccacctcccagctacctgcagcccacctgagaccctggggacggggggagcagaccctccagtggagggatgggaatgtcgcaaaggcccatctcagagccagatgcagagggcggccccaggccccaaccaggagggagggccgccccgggagtgggacctccgaggcacaggaatgctgcagaccaagtcccggcagagctggtgttacctgggaaacggaggccaggagaggctgctggtaggaagagcaggaccgtgcagaatagatgggcctctgcctgcacgcggtacctggagccagccagcgggggataggcggcctc

SEQ ID NO: 572941 - DNA, 412 bp, Homo sapiens
  misc_feature (6)..(6): n is a, c, g, or t
  misc_feature (77)..(77): n is a, c, g, or t
  misc_feature (138)..(138): n is a, c, g, or t
  misc_feature (159)..(159): n is a, c, g, or t
  misc_feature (171)..(171): n is a, c, g, or t
  misc_feature (178)..(178): n is a, c, g, or t
  misc_feature (187)..(187): n is a, c, g, or t
  misc_feature (196)..(196): n is a, c, g, or t
  misc_feature (203)..(203): n is a, c, g, or t
  misc_feature (205)..(206): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (223)..(224): n is a, c, g, or t
  misc_feature (226)..(226): n is a, c, g, or t
  misc_feature (235)..(235): n is a, c, g, or t
  misc_feature (242)..(242): n is a, c, g, or t
  misc_feature (248)..(249): n is a, c, g, or t
  misc_feature (254)..(254): n is a, c, g, or t
  misc_feature (259)..(259): n is a, c, g, or t
  misc_feature (269)..(269): n is a, c, g, or t
  misc_feature (271)..(271): n is a, c, g, or t
  misc_feature (274)..(274): n is a, c, g, or t
  misc_feature (277)..(277): n is a, c, g, or t
  misc_feature (279)..(280): n is a, c, g, or t
  misc_feature (295)..(296): n is a, c, g, or t
  misc_feature (310)..(310): n is a, c, g, or t
  misc_feature (313)..(313): n is a, c, g, or t
  misc_feature (341)..(342): n is a, c, g, or t
  misc_feature (351)..(351): n is a, c, g, or t
  misc_feature (372)..(372): n is a, c, g, or t
tataangctgaaaaattatccttatgaattttagatacaaaattaccaattaaatattattagataaattcctattnttcaaaacacaaagttgtatatttttttttattgggtgtttttttaaagttttcttttttnaaaaaaaaaaaaaaagaaaanaaagggcaacangctaacnccccatgcntgaagcagngcctggntnntntncnttgtgggcctnntnaaaaagttnactttcntaggcnnccaancaaancctccccctncnccncantnngaactgcacccaccnngtgcgggccccctnggnaacccctggggggtaggagggagggggnngcgagaggnttacacagggagtagagggancgatttatggtgagagaccggctccgggggctttaccttg

SEQ ID NO: 572942 - DNA, 2176 bp, Homo sapiens
  misc_feature (201)..(201): n is a, c, g, or t
gcggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtnctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgttctaaaggccgtccgggactgcgtggagaggaacgggctccacagcgtggtggatgacgacctggacactgagcacagagccgcctcggcgaggtagtgtccgccggccgctgcgctgcccgggacggagacagagggggccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgcggttttggaggacccgatgaccaggcgtcctgcgagtccgcccgctggcctgcagcacccacctcggacttggctgtggacggttggtgcaagtgcatcctgcagggctggctgtgcgcagctgtgggctgacctttgcagagttttgtggaatagtttgcaatgtcataaaagtgcaataaaggtacagcagatgtg

SEQ ID NO: 572943 - DNA, 292 bp, Homo sapiens
  misc_feature (107)..(107): n is a, c, g, or t
gcgaggggtacggtatcacagggtctagaacagggagagtcctgaaagactgactggccagccttctgggtttaaagatgagggaggaaggggcttgataaagattnggcaactggagaaccgccccaggggggggttcccagccctacactccgcacgccacttaccttcttactgcacgcgtgttctcactgcacgcattgcctcactccacacattacctcacttcacacattttctcactgcacgcattttactacacacatcatcttacttcacagattttctcact

SEQ ID NO: 572944 - DNA, 2212 bp, Homo sapiens
  misc_feature (201)..(201): n is a, c, g, or t
gcggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtnctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgttctaaaggccgtccgggactgcgtggagaggaacgggctccacagcgtggtggatgacgacctggacactgagcacagagccgcctcggcgaggtagtgtccgccggccgctgcgctgcccgggacggagacagagggggccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgcggttttggaggacccgatgaccaggcgtcctgcgagtccgcccgctggcctgcagcacccacctcggacttggctgtggacggttggtgcaagtgcatcctgcagggctggctgtgcgcagctgtgggctgacctttgcagagttttgtggaatagtttgcaatgtcataaaagtgcaataaaggtacagcagatgtgtgtcggcctcacggggcgggtccctcacaaaaaaaa

SEQ ID NO: 572945 - DNA, 895 bp, Homo sapiens
tcaaaaaaaaatgtgtgttttttttatataaaacataaaaaaaaaaaaaaacgggggggggggggggggggaaacccccaaaagggggggggagaaggaaaaaaaactttttgggaaaaaattccaacccaaaatgtgtgaggttttttctcctaatttttttttcaccacatcttcctcagctcaacaaaacaacactcttcttcattttgttggttgcaaaaaaaatccggctatttttcacacacatcaaggagaagaactgatcaccccaccacacgacaacaataatacaaaagacgcctccgaggtgtcatattcttctgcgtgcggaggggtgtcggcgcgcgcgctgggagggaggaactccccaggggggcgggcgcgtggtggccaccccaaaaaagccccagcgtcgctcacagggagaggaaagacccaggcgtcacacaaaagtgagcgccccgcgggcgccaaagtagggaggggcgcgcgcgccaaacactctccacaagaataactagccgtgcctaaaaaagaactcccccttaaggggatcatctaaataagagagaacaggcgcctagtattaccccccggggggaggcgcacataaagagggcccacacatccttccaccaacaaagggcggccccattaaacaccggcggtggtgcaacgtgcgccgtcggtgcacccaggggggcgccccataaggtgtaacaaactctccttgtccactgagtccccccgcacggccgcgtcaaacacgaccgggggggtccccaagatacacaccccacgtgtgcgcgcaaaaaattctctgacccccgggaaattcttccgtcccaaaattttccaaaaacttcacaccaccccatgcggcggagacaca

SEQ ID NO: 572946 - DNA, 2104 bp, Homo sapiens
  misc_feature (201)..(201): n is a, c, g, or t
gcggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtnctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgttctaaaggccgtccgggactgcgtggagaggaacgggctccacagcgtggtggatgacgacctggacactgagcacagagccgcctcggcgaggtagtgtccgccggccgctgcgctgcccgggacggagacagagggggccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgcggttttggaggacccgatgaccaggcgtcctgcgagtccgcccgctggcctgcagcacccacctcggacttggccttgccatatgcaaaggccaaggcatgctcctcttggccttgccatatgcaa

SEQ ID NO: 572947 - DNA, 419 bp, Homo sapiens
  misc_feature (41)..(41): n is a, c, g, or t
  misc_feature (52)..(52): n is a, c, g, or t
  misc_feature (202)..(202): n is a, c, g, or t
  misc_feature (246)..(246): n is a, c, g, or t
  misc_feature (307)..(307): n is a, c, g, or t
  misc_feature (315)..(315): n is a, c, g, or t
  misc_feature (317)..(317): n is a, c, g, or t
  misc_feature (350)..(350): n is a, c, g, or t
  misc_feature (361)..(361): n is a, c, g, or t
ggactttttgggtcgtaggaacctggtatgaggtcccccgnacgggattagnatccaataccccttcgaggatcaggaagtctactagatatcggaacgtagcgacctcctcaacgacggctaatcgtaaggagaaatcgcccatacttcctttatcatatagccgtcacgacacgcaataagctatatacgcacacactanataagctccattaacctcgtgctatcaggaagtcacagtacggntgcgaaagtctcttcaacatccatccaaacagttacggaagaaaaccacgtccgctttccncgatcggncnaagttactccctccaagaccttcgaagcagaancagtaaccaanaaaccaacctaagccccggtatggcaaattaccagctacgatttacccgcctgtcttg

SEQ ID NO: 572948 - DNA, 843 bp, Homo sapiens
tggtagtacagaggttaactaaactctgtaaatgggaagatcactgggttacccagtgctctcttataaacataattccaaaattgttccatgaaatccgttttaaaatgaacttctctgtgtgccacagtccctaggacgggtgcaaggaccacagtgtcaagtctggttggaggatgagtctctgaagagacagaattcctgccaaaaggcgcacagaacataagtcagccaattgtgtcgtgccaggatacttggacttgggttggctgctgctgctgctaagggatatggggagggttaccccttcccaggtggtaggacgagggttgtgggtaaaggtctgtcgtaaaggacccctggttgtagctccaatgattccgatgcgttgtcacgctctcgcagtgacgcgtaatatcagcattttcccagcctttttggaagctctctaggaaagcctacccgtggggtaatttgccccggtccatgtacacacctcggcggggggatcacaaagtaccagggcgtactgcgggaatcccgggagacaggatacttgcccagggcaaacaaatggggggagacgccagcacataaaccctgcccgagagagaaaacccgtctgcaaggactcaatgcgggtggcgacaaggcggtatggaatgggcctggtcaagttgtcctgacccagttcttgccaaggggaatcgcggcccctaaaggagcgaaatcgaagccgtacgatgaccaccgaccacacgccgacacgccaacaacaggaacactcacccacggcacactcgactaacacacgacccaaccgaacacaatcagcacacacca

SEQ ID NO: 572949 - DNA, 2684 bp, Homo sapiens
  misc_feature (201)..(201): n is a, c, g, or t
gcggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtnctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacaggtgacctcagaggccctgccggagccaagggcacatcagagggctgagcccactgtagacaccccctcggcctcccgaccaaggatgccaggtcatctcggaggccctgccagagccgagggcacatcagagggctgagcccactgtagacaccccctcggccttccgaccaaggatgccaggtcatctcggaggccctgctggagcccagagcacattggagggctgagcccactgcagacaccccctcggcctcccaaccacggatgccaggtggtctcggaagccctgctggagcccagagcacattggagggctgagcccactgcagacaccccctcggcctcccgtggcctgaatgaccctcccgtggggtcaatcagaaaagggaaaatcccatcagccaggaacaaggagccacactcttgcctgtctgcgctctccgggaggccaaccgtgatgccatttcctggtgactggaggaggcaggatctctcctggccaacaacatctgcttctacggcgagtgttcctactactgctccacggagcacgccctgtgcgggaagccagaccagatcgagggctcgctggcggccttcctgcccgacctgtccctggccaagaggaagacctggcggaacccttggcggcgttcctaccacaagcgcaagaaggccgagtgggaggtggaccctgactactgcgaggaggtgaagcagacaccgccctacgacagcagccaccgcatcctggacgtcatggacatgacgatcttcgacttcctcatgggaaacatggaccgtcaccactacgagacttttgagaagtttgggaatgaaacgttcatcatccacttagacaatggaagagggtttgggaagtattcgcacgacgagctctccatcctggtgccgctacagcagtgctgcaggatccggaagtccacctacctgcgtctgcagctcctggccaaggaggagtacaagctgagcctgctgatggccgagtctctgcggggggaccaggtggcacccgtgctgtaccagccgcacctggaggccctggaccggcggctccgcgtcgttctaaaggccgtccgggactgcgtggagaggaacgggctccacagcgtggtggatgacgacctggacactgagcacagagccgcctcggcgaggtagtgtccgccggccgctgcgctgcccgggacggagacagagggggccggacctcccagcaagcgcatgcgcccgtcgtgaattcagtgaattcagaggcaggacgggatcatccggagtcgggagctgctgccacaggaggcgaggctccccaggtctcataggacacattttgtcagtgtttgaccagaaaagcttgggaaggaagcgctgtctgtgctcacggacagaggcggccggcgccggaggcattccatcctttctgtagggaaaggagcctttatttactattttgtatttatatttgatgaataagtatataaacagagacgtgtacacagatgccaatcacctaccaaaccaaacacgaggaccgccctccctggttctgggggcccctcaaggccaagctcacccctcaagtgctctcacactcgggacctaattcaagtaaaaaccctttctccttcctggggcctcggctcctggagggctggagggtctcgtctgaggacgggaggaggctctcgctggacgtctggcctgtgcgctggtggacggatgcctacgcggttttggaggacccgatgaccaggcgtcctgcgagtccgcccgctggcctgcagcacccacctcggacttggctgtggacggttggtgcaagtgcatcctgcagggctggctgtgcgcagctgtgggctgacctttgcagagttttgtggaatagtttgcaatgtcataaaagtgcaataaaggtacagcagatgtg

SEQ ID NO: 572950 - DNA, 186 bp, Homo sapiens
gctaacttgtaagatctctatcattatggatcttcaatgatttgcaatggttgtcgcgttactgaagacttggtgacaatcattacattagtcacgtctccctacaccatggattgcctgatggtgaataagtgtcgactgtgcacgacaggctttccatggtgtagagaacacgtcgaattcgag

SEQ ID NO: 572951 - DNA, 922 bp, Homo sapiens
  misc_feature (201)..(201): n is a, c, g, or t
  misc_feature (737)..(737): n is a, c, g, or t
  misc_feature (758)..(758): n is a, c, g, or t
  misc_feature (880)..(880): n is a, c, g, or t
  misc_feature (882)..(882): n is a, c, g, or t
gcggccgagcgcgccttgcgggggcgggatcccggcgccctaagaccccacgaccccgcgcaccggccgctgctgcgagaccccggcccgcgtcggtccgagtcgccccccggccccggcggagacgcctccctcctggccaggctgttcgagcacccgctttaccgggtggcggttccgccgctcacggaggaggacgtnctgttcaatgtgaacagcgacaccaggctcagccccaaagcggcggagaacccggactggccgcatgcgggtgctgaaggtgcagaattcctctcccccggggaggcggccgtggactcctatcccaactggctcaagttccacattggtatcaaccggtacgagctgtactccagacacaacccggccatcgaggccctgctgcacgacctcagctcccagaggatcaccagcgtggccatgaagtcggggggcacgcagctgaagctcatcatgaccttccagaattacgggcaagcgctgttcaaacccatgaaacaaacgagggagcaggagacaccccctgactttttttatttctctgactacgagaggcacaatgcggagattgctgccttccacctggacaggatcctggacttccgccgggtccctcccgtggccggcaggatggtcaacatgaccaaggagatccgggacgtcacacgggacaagaagctctggaggaccttcttcatctctccagccaacatggnacgggggcccgcattcatctntccaggtagcctggcacgggggcccgcattcatctctccaggtagcctggcacggggagcccacattcatctcgccaggtagcctggcacgggggcccacattcaactcttcaggtagcctngnacggggggccgcattcatctttttcaggtaggcttggacg

SEQ ID NO: 572952 - DNA, 885 bp, Homo sapiens
gagggagtgagattgcatccctgggcttagaagtgacggagagaagacttgtgtagtattttgccatcagcacaaggaaaaccaggagagagtctgcctccaggcactctgtagccttctgccttcgtatgttcagaacggtggcataggtcttcccactccacgtcgatggcttgacactcttacggggtctgcatgtgcgtccactcgtccattggtggccccatgctcagctaacgtatactctggtacagtttcgctgtgatgcaagtcagtcaccttggaaggcaagaagcattctcgaagtaaccgttggaaaacagaacagctttggcttttgcagaagattgatgactagacctgtgttcctctagacgtgcctatggctaccacgtctacccctttgttcgcagacgccgagggcgctggaactgacatggcagtctatatcgctctgtcccttggaggcctggggtctatgctttggctcctctgaggtggaacgagactaagatgggcagctgaccgagagcagcttgtgtgtaccatggcttctctctcatggcttcctgagtcctcttccgctatgcactgcgccttatccctcaggcagccatgaggagcctccctggtcctgaccagagggattacgtttcgcgagtggttgcgtgtgggttcctggtcgatgagtggcagagcgttcgtgcgccccctgcttggcactgctgtactcgtcgcaggttcacttcgctcggccggattccgtagtgggaaagtggacggccatgcccagacagggccatgtacgcatcaaagtggtactcttccgggaggaaggggccacgttggcagactgagtccaaggggctaggtccattagcacag

SEQ ID NO: 572953 - DNA, 326 bp, Homo sapiens
ccacatttgcaggattcagtagaatttgaagaatcattgttagaatcatttccaaacaaatacactaagcaaaatggtgaattatggcttattttgaactgcatctttaacttacgaaagatgtactaattgtgggggtgcctgagtcaggcggagctgacccagggttgggaccgattgcagctgcccaggacccatttgcttggtccaggctatgtcctcgttagatgtactgtggtccacggactctttgttgtgtggcagacagtcactgtgggatgctcttcaatgtccgcagttacagaattggtttactttgatttttg

SEQ ID NO: 572954 - DNA, 145 bp, Homo sapiens
cacgagggaaccggagaacagtctgcaggaagtccaagtcatcagtctcgggcatcaggcggatgggagaccgattgtgtttggtgacagccagaacgttgtatcggtcaatgacacttttgacgaggtcatcaatctttctggg

SEQ ID NO: 572955 - DNA, 660 bp, Homo sapiens
cgcgcaatggaccccaattgggcgcaggatctccccgaggagcaccgtccttgtctggccccctggcgccaaacagcgtcctgtcgcccgcgcggtttttccgagaaggcttttattaatcgggcccctgtcccccctccctcgggagcccctgtttgcaccaccatgccgccacatctcgcccctggcatagagggcacctcctctgctgcgcgcgagcccccccctctttggcgaccccatgttccccccccagggttggcgtccccctggtgtgtgttccctcctgcacgaagtgttctcttgctggggcgacccaccaacgcccgggggtctcgaccccttccctctctccgcatggttgtgagctcgcgccgcaacaccacgctgcggtctttgtcgagcacccgctgtctcctaagacagccagcgtgccacccccgccccgccgatgtgggcgccgcacccctgcgaagcgcacttgcggagagacacacccggttgggtggggcgccctgaggagcaacccgccaggcgcacactagcgcaagaaagcagagtcgacactgcgacgactacgagcgctagttgcgcgctgcgaggtgcgcgggcgagttccacaaacagcatgattgttgtcccgcccacagtagacagaga

SEQ ID NO: 572956 - DNA, 168 bp, Homo sapiens
tgtatctctctccaaggcctggtcaagccctaagggcatttacaaatctctgagaatgttttttttatactaaaattgccccttatattctactgtgagaagggcagtttgccctatattgttttaaaaacgaagagaaagaagaaaaaggaaaacccagaaaaaaaa

SEQ ID NO: 572957 - DNA, 793 bp, Homo sapiens
ggcgtgggcctggtgcgcaagtgggaggtggcaggctgagtactccggctgtgtgcgggcccgttctcgggcgaacgtctccagccatgaaccggttgggtacccggttggtgggagccacgggactgttcttcgtccgcgcctgcgaaggtcccgcatgcaatggaaaagctcgacaaaactagcatatgtctgggggatgatatccatccatggtttgcaatcggaaaacgggagggggaagaagggcagaattgtgcccaaggattaaagatagaaggattcctccagccaaaggtggtgccccaagccaattccagggatgaagagtggcgaatgggggaaatccaaaccagaatggtgggtttgggaaagactaagtctgggattcatagaggaaggagtaatggcctggaaaagaaggacggtacctaagttggcagtaatacactgggccttgcagtagggaaacacggaggtgaatttcgaaaagaggaattaagtcttaatgaatcggtccaacgcttctaagtgacaggaattataggacccacgtatgtggccaggttgtaacaaaacgggagggcaaaacttttctggagaaccacaattgaaggggggcagaggaaaaccaagtaggcaggttctcaaaggagacgctagcccgagttagggcgagaaaaaaattaagatttccaagttaatttttacccacgggggggaattaactttagttcctcaagaaagagatacttcgtcagggaaacttccttttcagaaagagggctgaagt

SEQ ID NO: 572958 - DNA, 179 bp, Homo sapiens
  misc_feature (75)..(75): n is a, c, g, or t
  misc_feature (149)..(149): n is a, c, g, or t
  misc_feature (177)..(177): n is a, c, g, or t
attcttttctctttctctttcccacctcatgttataggtcattggtgcgtatctagagcagagggaggacttggngggttctgccacatgggcaaagctttctacttgaggcttggctctatgctaattggcttccatgccatgttacnatagcacctggtttcttggctgggtttngg

SEQ ID NO: 572959 - DNA, 125 bp, Homo sapiens
  misc_feature (4)..(4): n is a, c, g, or t
attnagcgacgcatcgtggccgttaagtcttccatctatgtctgaatcacacccatctctcactcacacctcacacaaggtgccagagcgctccccttctgctgacatttatatggacggactca

SEQ ID NO: 572960 - DNA, 1539 bp, Homo sapiens
ctagttctagcgcgagggccgccctattttttttctttttgtaagggtaaaatttactactggtaacttctagtgtctatagtctatattcggaaaaaggtagaaaatggagttacaattgggattctgttttgtccacaggaagtgtcgtggttaaaatcgtggtgggtgctttatatatgaagtactcgggtctattctatagctcttcaaaactgcgagtccttggggcaactccagcttgcaagcttcccaaagtacttctataagaagttatatcagcacatcttctaatttgggccagtgttccagtttatacagcgttaccaaacactatagcagagtgcaagaattagtgggggaacatcctatattcagaagtacgtctaatacaattcgggggtcatggagagtgctcgtgctgccgctggtgcatacacccagaagaaacccacctaacacaagacaccacacgggcttaacacaactccctaatgggtgctacgtcacaacgcggctcaaggcccgagcacgcacatcctaacagggacatgcggatcacctcttaccccgtgggagcctcttaagtaccgtcatagacctgaagattacaacgcaaacctaaaggcaaccatatatgcagcttgacaattgctgaaacaccagtctgtcccattcatcattgggccttccaggtggctaaccgtggttgacaacacttcttataatttgttcacccacatgggccctccacaaatactccgcggcgaacaggacggagcacacacgggggaccaacaagtccgccctcaaagacgacgataacacccacgttagaagaaatacaacaccaccgacataacatccgggccccactcaacaccaccatgcataacgcgaacccacatcggacacaccccaatcccccaccaaaacacagacaaggcgccatagggaaaccccatacaaacagcaatgggaaaccagggtgtgacagcgaaaccacgagggccagaataccggggggtcaaccgcccataatcgcaaaaccatcgcggcacacgcaccgcaccacccgtaccacccgcagcaacgacacccgcagccaccggggaaggagaagaaagagggcgggtcaaacgacacggcgacacccagcgcatccgaggtcccacgctgtgacacccgacgcagcaagaacacgctaagaggggaagccagtagggcccgagaggaggagagacaaggaacgcagagacagggcgtatgaccactagcggagctatagcgtagacgagcaggagaggaaaacagaaagacagaagcgggcgccaatcacaggtcaatacatatcgatgcgtgtgtggttgtagttaggccagcgcaagcaaggagatgacaagacacggcgaagaacggggagcggaggaaaggacgcacgtggtgagcacgggccccagcagaggcacacgacgaagacgcggacagacagagcagagcaaggagagagggtaagaacgaacaaagaccaaggcgacg

SEQ ID NO: 572961 - DNA, 178 bp, Homo sapiens
ttgtcacgtactcggtttgagcggggaatgctggacattgtaatgggttatggagacatgtcatattacgtatgctagggtgagtggtacgaagttttttcatagcgatgtgtatgaattggtcgtaacggaatcagccgtatgctgttcgaattcataagaacagggaggttagaag

SEQ ID NO: 572962 - DNA, 189 bp, Homo sapiens
tctggctcggcaccccgtagactttagcattggctgcattttgctctttggttagcttatctgcaccttgaactgctggtgcagcctgtacagtagatgctaccactggcacagttgcagcttgagcagctgcaggtttcgctggtgtctgagtaaccgcttgtgccactggtacaggggcttggccct

SEQ ID NO: 572963 - DNA, 1096 bp, Homo sapiens
gctgagattacaggcgtgatccaccagcaccctggactgccttggaactgacacttttatctttcttcccggctttgatctcgttattgttcagaagcttcactgtcatgaagatgagaattactaacaagaagcacaaggtacatgcaggagagtgagagatgtagcccgttgaaggtaggtggacacgcatgttgggaccatatgtagaagtggatgcatgcatacactaggactgatggacgcgtacatatgatgcttagtggtggcgaagctcttgcgagaagactcccatggcaaacgcagggatagagcatgtagttgttggacatgctacgggaggagagcctagaagtcggatttggtccagcgccgttgccaaaggggcctttgttctaggtcgtaaattcatgggcgactacaggatccggggtatcaaactaggcgagggaaagcttacttaggcaaatacttgtgcgatcatcgtagcagatctatagcagcatcctcttaggtaggcagggcccatatctggggcactatatttgagtgaggtccaacctgcagtcttcattcatgggacgtaaatttgcgggtcaggaacccaggagaataccccagtggatagccaatcctttagacatgaaagacgtttttgcaggattagggtgtggccaggaacatgcacgtaagtcccagtaacagtaaaacgtgggtggactaaaggatcggcgatatgtttggggcacgtagaacgtcacgggaggaacataacggaagagagggaacacaccttcacttcaaacgcgttaaaacaaatacaagaatttgtgggtaaaggagcagccgacaggtaagccgttaaccccataacgggggagaaaccggggagtggcactgagacgcggacatctggctgcgggagagcgcacgaccgcctggtgggccccacagcggcttggcgcattatacgacgttatcaccacagtttgggtgcgctcgtacttcgtgcggagtgttacccccccataggagggtaagacgccctgcggtggggaaagcaagtgggccgcgtcggatagtctgcgaaggaatt

SEQ ID NO: 572964 - DNA, 624 bp, Homo sapiens
  misc_feature (573)..(573): n is a, c, g, or t
cttttgagattcatccatgctgttttatcagcagttccttccattttattgctgagtagtattgccttgtctggatgtgccacagtttgtttatccattcttcagttctacaacatctggattgtttccaatttggagtgattataaatggtgctgctgtaaacattcacatgtaggtctttatgtggacatatactttcatttcttttggataaatagctaggaatagaattgctgggttttataaatatatgtttaacattattaggaaactgccaaactattttccaaagtgtctgtatcattttgcattcccacaagcaatgaataagacttctcgtatctccacatttacaccaaccattggtactttcagctttaaacattttagtctttgtactaggtatataatgccatctcactgtgttttgaatttgcatttccctagtgtctgatgatattgagcatcttttcatatacttatttggcatatgcatgatgaagcttctttgatgaagcttctgttcaaatctcttgcccatttttattgtgttggtggtcttattggattgnattattgagtatacagacttactagatcatgtttgcaatatttatccagtc

SEQ ID NO: 572965 - DNA, 110 bp, Homo sapiens
taaatgagtttatagcacacagatgagacatttttgaaacccgattattttaaaaaaaaaaagtcgacgggccgcggtcgacgggccgcggtcgacgcggccgcgaattt

SEQ ID NO: 572966 - DNA, 316 bp, Homo sapiens
tttttttttttaaaagggggggcccggggacccggggtttaagaaaatttgaacccggggccctggggggaaaaaaatggggccccttctggaaggccccttcgggttggggaccccctttttcccaatgggaacccggggcccccccaaatgggggggggggaaaaaaaccccctgggcgggtttccctggggggggcccaaaaattttgctttagggaaattcccggttttttttaaccccgggggggccccgggtaacccccaatggggggggggggatctcgggtaatttttccggttaaaattccctttta

SEQ ID NO: 572967 - DNA, 388 bp, Homo sapiens
  misc_feature (367)..(367): n is a, c, g, or t
gaaagggacaggccgggggagctttgtaaattagttatgaaactgcctttggaaaattatgactgagacagtgaaagagatctaacgtaaccgactccatcttggttctaaacttttaagttgtccttgctccttcctggacgtatgctgaactaactttgggaggaacttagtttatagtttaaaataaagacgataacagcctttacccaaaacaaaccaccttcttgcctgggggactaggacttgcctttgtagggacccaaaaaatgaggccacaaggttattaattatgggtttagggtgttatgtaggctgggagactaccaagagtcttgacccctccccttcaactggttcctaaggntccagttgctttgaggatatt

SEQ ID NO: 572968 - DNA, 127 bp, Homo sapiens
cataaatttacaatatgctgaacattatgacaagtgactaggcaagttggcaaccaggacacgattctaggttagaaccaggtaaggataaacactagattagataaataaggtcaacgaagtgaga

SEQ ID NO: 572969 - DNA, 387 bp, Homo sapiens
gctccgacccctaataatgagagcccaatgtccacttcacccgggttgaccgaggcgtcacggaatgcattgaagagacatttcacagccttcggagtggcatgggaagcctgcataccaacttggagaaatgcccctggagacattttataaaggcaagttatgttttttaatttcagaaatatttcattgcgggaatattgctagatatagtataagacagtaccagctcaatatctaaaccactgctgctagtgtttgcgtagatattgccattctgttttatataacccttttacggggcgggggctaactgtcctgtacagttagcgtaaaccacacgaaattgctatttttggcaagctccagtcaaatatcagcaatttc

SEQ ID NO: 572970 - DNA, 1975 bp, Homo sapiens
ggaagaccaaattacctactcttactcaccagacaaccttagccaaaccatctacccattatattaagtatagcgcgatagaaattcgaaaccgtggggcaaatagagtatagataccagcaagggaaaagatgacaaattaataacctagcagtagagtaatagcaaggcacgtaacactcgcgtactacctgtctgcataagtgacattgaacgggagcaacataacttgtgcgaggagtagcccaatcaagctaaggaccgcccggaaggccgagactgagtctaccgtaaggaacagacttacacatagtagcagcacccgttcgtagtctaggcaaaagtacatgggagagagtgttacctagggtagaggcgatcaataccgtagcctgagcctggctgattagtctggtgttgtccagaggatagaactctgtagattcaactgtgtagaactttgtcccaccaggaacccgtctagatccccgttgtaagatttaacctgttagtccaaagaggaacagctctttggacactagtgaaaaaacccttgtacgagagagtaaaaaatttagcagcccatagtaggcctaaaagcagccaccaattaagaaagcgttcaagctcaacacccactagctaaacaatcccggaacatataactgaactcctcacacccaattggagccaatctatcaaccctaatagaagaaggaaccccgaacaagcccacctctaaggaggggccccccgggcgctatgttccggggctcccccagctgaaagcgagccaaacacggtttctacccgttttgtacagagctgggggccccagagtgctcgagtatttgaccgacgtgggacaccagcacagcgcgaaacggatgggcacacacaaaaaagggaaacgtcaaccagacatcgcagctgcaactgcaatagagaatagggtcacgctacacgccacgcaaactaagcgacacaaggaagaagaacgagacaagaagaaaacaaacaaagagacaaggaaacagacagaacagtaagaagtaacgaacgaagaggacaaaagcaaacagacagacacgacagacgaagaagagagacagagaaagacagcaggaaggaagacgcagaagaggacagaagaacaacaagacgatgagcaaaacccaagctacagaggaagcggcgacaactacaacggcagagaaaagagagacggcagaggccccacaacgagaacacgagaagagaagggcagaacaagaagaaagaggaagagcaagagagagcggagaggagagagcagaagagaaggagaaaggagcgacacaggacaagaaaaagaagaccgaggacgaagaggaaacaggaacagaagaagacggcagacagaaggaaaaaaagggaggagaagagaggacgagcaggcggagagagaagagagagacagaagcgggaggagggagaggcagcggaagcggggagggaagcgggagaggcacaagcgagcgcgcagagagcagagacagaaagcaaagaggccagagagagagacgagagaggcaggaggggagaagcaggagaagaagcggggaaggagagagagagaagcagagaaggagaacgagcgaaaagagagggagacacagaaggcgaaaaggcggagagacgacgcggggagggcgcagcgggggcggagaggaagcgacgagaggggccaagaggagcgcggaggagggaaggcgagcaggcggacacaacataggacgaaaagcagaaagaaaagaagcaggcgcagaggaagcgggcggaagcgaaggaagagagggaacggaggggaagaggagaaggagagggcggacgagaggagggagaaaagagaagccagggaggaagcaagaaggagcgcagaaagaagagaggagggagagagcagagggggcggggacacggcaggggaggagaa

SEQ ID NO: 572971 - DNA, 796 bp, Homo sapiens
  misc_feature (682)..(682): n is a, c, g, or t
  misc_feature (698)..(698): n is a, c, g, or t
tgagatggagtctctgtcactcaggctggagtgcaatggcgcgatctcagctcaccacaatctccgcctcctgggttcaagcaattctccggcctcagcctcccgagtagctgggattacaggcgcatgccaccacacccagctaatttttgtttttcgagtagagatggggtttcaccatgttggccaggctggtcttgaactcctgatgtaatccacccacctcggcctcccaaagtgcagggattataggcgtgagccactgcgtccggctcaagtgaatgttcttaatgggatcatgggatctagaatggtgaatccttttcagaaggtggactttgcccagatccatcaaaggaatcactatttatggcagtgttgccttatgaaatgtgtttcttaggtaataacacttgaaagtctgaattactcctggatacatggactgcagaatggatgttgtggtagcaggcatgaaaacaacattaatcttgtacatctccatcagagcttttggatgactaggtgccttgtcaatgagcagtaatattttgagaagaatcttttttttgcaagcagtaggtctcaatggtgggcttaaaaatattcagtaaactatgctgtaaacagatgtgctgtcatccaagctttgtccatttatagagcacaggtagaatacagntagcatgattcctaangcctgtaggattttcagaatagtaaataagccttgggcttcaatttaaaaaggtactagctgcatttggctctaacaagggtcaacctgtcctgggga

SEQ ID NO: 572972 - DNA, 478 bp, Homo sapiens
  misc_feature (371)..(371): n is a, c, g, or t
atctaggctgggaatagtggctcaggcctgtaatcccagcactttggaaggcttaggcaaaaagatcagttgagcccaggagttcaaggccaccttggacatcatagtgagactacatctctactgaaaaatactacgtgctgggcatggtggctcacacctgtaatcccagcactttgggaggttggggtgggcagatcaagaggtgaggagttggagaccaggctggccaatatggtgaaaccgcatctctactaaaaatacaaaaattagcgaggcatggtggcacaagcctgtaatacagctacttgggaggctgaggaggaagaattgcctgaacccaggaggcggaggttgcagtgagttgagantcgtgccattgcactccagctctgggtgacagagcaagattccatctcgaaaaaaaatagtacaaaatattttaaaaaataataaaagttgtctattctgaaaaaaa

SEQ ID NO: 572973 - DNA, 290 bp, Homo sapiens
  misc_feature (171)..(171): n is a, c, g, or t
  misc_feature (185)..(185): n is a, c, g, or t
  misc_feature (209)..(209): n is a, c, g, or t
gtacccgacgagttgtccgagttatgtttatttatttagatacagggtttcactctgttgccctggctggagttcagtggtgattatggctccctaaagcctttatcttctgggctcaggcattcctcccacctagcctcccaagtaggtaggactgcagctgtgtacaancacatctgactgtntttaaatttttttctttcttcttnttcttcttttattattttttttttccgagagagaggagttttgctgtgctgcccaagctggtcttaaactcttggccttaa

SEQ ID NO: 572974 - DNA, 324 bp, Homo sapiens
  misc_feature (313)..(313): n is a, c, g, or t
tttcttggactaggaaagggaactccctgaccccgtgcgacttcgccgagtgaggcaatgcctcgccctgcttcagctcgcacatggtgcgcgcacccactgacctgcgcccactgtctgggcaacgtccggtcagtggcagatggcaaccgcgggtaaccttccaagcatggggcacacatggccagcacaatcgagcccaaatcgtatctgcgcgtcgactccaagctgggagctgtagaccggagctgttcctattcggccatcttggctcctccgctctattggcgagttcttaacaggacagctaccnaggtcagcagc

SEQ ID NO: 572975 - DNA, 125 bp, Homo sapiens
ggcatatgcgcctgcctgagaagttcactggggacagtagatgagaacggtacggattcttcccagtcacgcaaaatacgacacgcagacttttggatcgggttgttccgtcctggatattacct

SEQ ID NO: 572976 - DNA, 106 bp, Homo sapiens
caagctttgagtgcccgagattgaagagttcaaatctgagcaatgatgttgatgttggctaagagaattctcgtgctcaccacatctaagttgcccgccaatcgaa

SEQ ID NO: 572977 - DNA, 416 bp, Homo sapiens
  misc_feature (88)..(89): n is a, c, g, or t
  misc_feature (98)..(98): n is a, c, g, or t
atggtggctccgggttgcaatcccaacattttggaagactgtggcgggaggattgcttttgattccaagagtcaaagatcagcctggnnaacatggtnaaacccctatctctacaaaacaaacaaaccaccaaaaaaattagctgggtttagtggtacaccctgtggtcccagttacttgaggtgaaagtatcactcaagcctgggaggtagaggttgcagtaagctgagatcatactccagcctgggcaacacagtgagaccctgtcttgaaaaaaaaaaaagaaatatcttggttcttttatgaacatgtagtcagatctgctacagagagactttagtttctttccttacctcttttttcctttcttttattttaacttaaaaaaataaaacttaaaaattttgtaagttgta

SEQ ID NO: 572978 - DNA, 205 bp, Homo sapiens
gggcattatgggagtctaactcctttcttaggtgatcctcctacctcaaccttctgagtagctgtgactacaggcccccacggctatacccagctaattttggtatttggagtagagacgggttcaccaggtgggccaggctagtctcgaactccggacctcaggtgatcggcctacctcagcctcccagggatgcccaacaggg

SEQ ID NO: 572979 - DNA, 907 bp, Homo sapiens
gcttggcggactgtcccaagctgtggataacatctagaccaggtgtttgcaaacgtaggggacaatttttgatactcaggtaatgttgccaatgtctgagacatttcatatcataatgaagctcagtggggcaggagtgccactgtggccatcttgaatggaagtgactcgggactcttctgccatacattgtgcaatgcacaagagatgagccctgatgacaatggacttcgttgacgttacaagatgtcaacaaagtacgggggtctatggcaccacactgcgttgtgaggacacttctgcatacaggtctctaaagaaggagagggggatccggtgctggacttcatgtgtgcccgaccaaagatttgccatctggaattgggtatgtccctcgattgtgttcaatgggattgggcccatgtgaagccccaaggttgtcgaagggacgtcccgagtgcctcggcctccattggcggccacgtggtctctcatgagggtacctcaatgggtgttgcagtgcggttactcacaaagatgtattgatggcctaaacaccaggacaatccgtggtggcctccttttctcattccaccttgtagacgaaaagtgtggttcccccttaccatttccaccattggatggagttcttgggcccttcacagccggtgaactgtgagtcatttgacctctttcttaataatacccagccaaggtattcgtaatagcagggggaactggtacacagggcaggacagggttccatggacataagctggccctgtattatggtggtctcacctaaaacgggtattattaccgatgacagctcggtcaacatgtccaacacatacacctttgcctgaaaaaagactaaaaagaaacatacacaacatgtatgcaacta

SEQ ID NO: 572980 - DNA, 115 bp, Homo sapiens
  misc_feature (3)..(3): n is a, c, g, or t
  misc_feature (71)..(71): n is a, c, g, or t
agncctaagttgttggcatctgtcacaatcgtggatacccaaatgcgcgctctataatttcgcaaaggagnaaaggagcaatttttgtgcgtagtttgttgtagggtgttgcagg

SEQ ID NO: 572981 - DNA, 1562 bp, Homo sapiens
  misc_feature (1229)..(1229): n is a, c, g, or t
gtgacataccttccgtgcgtgacatggcttcccagagtgacgagagtgtgcaagtactgcgttggtcctagaaggtatacgggatgctgtggtgggcgtgtcacggctccggataagagcacccgatgccacatgagatgtgcgattgcacacacaatgtgctgggtcctcgacactatcacgtttagtcgacgtggaccattggatacgtggtccactcgagtcgcgactgtcttgggctcagatgcgtactgtaagacagagatgacttgacatcagctgcatcatatcttgcgtcgtccaacagcggcttgatgtgcatggacaaggtaacctcgatgcttactcgagcaaaagatgggggccacaaccagcgcatttgtgtgacgcggatgatgcgcgagtttctgtccattggggatagagccattgctgctcgcgagagctaggtggaagcgactattgggccagtgaacaatagctccatgatgggaaccccttttatagtggcgaggtagaggtagtgccaccattgaggtggggccttgcaattcttcgctggactctagctatgttactcagggctatccacgctagaccctagctacgtagcccttgaacattcggggacacttagacgtcttgcgacgcgcagaaagagagctcgcacttttgaactcccacaacaaagtaccggtgcgtccgaatggttttgaggcgccattcgcaagcggagaggatcttactacaccctgtaaccttgggaatgacaggctggcaattgggaaagaagcaatgtggacttattcactcctgtcgaggacaagcctcggtattgtagttcccctggttcccgaaatatcacgtactagaacttactttggttgagaagccatggggcgcgattggcatttgagagtcacaagagtcttggccacaaggtctagagaactaacattttcccaatcaacgggggtcgcagaagcatcacccttaccattgttacatcatcgaaggtgataagcgggggcgggagacgcgaactcagcgccgcagttgcacctgttctacagccaaggaggcccatgggaattgttctgtaaggttgcagggacacacggtcaattaggaaacgcgagggaaacattgtttccctatgaatttccgagcattccgttgaacgtcatataatcccgcaaaaggggacggacgaggccagaaagagcctngtataaatacaacggaagggcgtcgcgtacaacgcagccccaggtgccgaacgaatcgaaattccccctatggcgacatttgcatgggtggcttgccgggagcaaaacggggcgacacgggcgtgggtcgagcaggactgaaagagctcccgtgcaccaggtacactggcccttggaagcctgcgagagcacacgccaagggaagcgcacaacagttgacgcacacccagtgaagcgagagcgtacaagacgagagggccgtggcaacaggggaagcaggaaagcggttacagtcggagagcagcttggaacacacgagaggaagtaggacag

SEQ ID NO: 572982 - DNA, 178 bp, Homo sapiens
gtggccaggctgcgcacaccatagcgctgcatcgcgggtatcaatgataaactctgcaggctcacaggtgtggccttcgtgacggccctgaccagagacccgaagcacgactgggcatccccaactttccgaccgggactgactcaccaaccaggacacttcttccggtgtcccgacg

SEQ ID NO: 572983 - DNA, 856 bp, Homo sapiens
gtggggaacacttgctgggtatggtggctcacgcctataatcccagcacttgggagtgtgaggtgggaggctcacttgagcccaggagtttgagactagtctagtcaacatagaccttgtttctaccaaaaatacaaaaattagccgggcctggtggtgcatgcctgtggtcctggctatttgggaggctgaggtggatcacttgagcctgggatgtctaggctataactgagctgtgatcatgccatcgcactccagcctgggcgacagaccaagacttggcctgcctccaaaacgaaaccatttgactgtcacatgtgaaaaaagagctacaagtgaagtaggctgggccaccaagacatgcacatttaaccacatgtgctaacctatactagctacaaacctgtgcttaatatactgccagaaactggctctggctgctgttactgtggagcctgctacggacaaaactgcttctcaaccaatagacgtggtactacgcctactggagctggcacaactccatagcaaatgacatgtcccggagttgctgttctcctcatctcagcaaccctacatacgttctcaagcccgacaacgtcgaacgtctactctccgactacacgataacctgtgcacgctaatatactgaagcgtccccctctcaacacactcgtccgacacacaggccacaccggggccgccagagaaagcagagggcgacagactgaacaaccgaccacactagagacgacccacactggccagatccccccacgaccgcaacccaaaccagcgggccaccaggcagacccaggcccaccacagccaaaacttaacgacagtgagccccaac

SEQ ID NO: 572984 - DNA, 725 bp, Homo sapiens
acagatccatttgctgctctgtctgccggttcttgaggtgaatgtcggaatccattatctgttcgggaaagctctctggggcaggacaaatttacatgtataggagaccagaccagaagcccttctgaattaagatctcacatactgaaggaggcatgaagagcactaagatcggaagatgagtgagctgaccagaacggcaggaggccgagcaacttaagaaccagatcgagacgccaggaaagcatgtgcagatgcgactctctctcagatcacaaacaacatcgacccagatgggaagaatccaacatgcgcacgaggagagaccactgcgggggcacctggccaagatcatacagccaatgcactggggcacagactccaggctactcgtcagtgcctcgccggatggtaaacttatcatctgggaccagctacaccaaccaaacaacggtcaacgcacatcccatcatgcagctccatcctggacatcatgcccatgtgcaatatgcacacttctgggaaacctactgctgcgccctgacgcgaggcctgcaaataaccacatatgctcccctcaacacacatgacaaaccacaagaacggggacacgtggcgcgcagaagtagcgaccctggcacggaccacccggtcaccagaccatgcagacgaaacccggcacaacaccaccaaccgccccaccactgaccacccaggtgccacgg

SEQ ID NO: 572985 - DNA, 221 bp, Homo sapiens
tcatgccaggcctcatcaacctcgatttcgccgacgtgcgttcggtgatgcaggaaatgggcaaggcgatgatgggcacgggcgaagcctcgggcgacaatcgcgcgatcgaggcagcgtcgaaggcgatcgccaacccactgctcgacggggtgtcgatgaagggggccaagggcgtgaacgtctcgatcaccggtggcgacgatatgcgcctgctcgaa

SEQ ID NO: 572986 - DNA, 1874 bp, Homo sapiens
  misc_feature (136)..(136): n is a, c, g, or t
  misc_feature (144)..(144): n is a, c, g, or t
  misc_feature (194)..(194): n is a, c, g, or t
  misc_feature (196)..(196): n is a, c, g, or t
  misc_feature (219)..(219): n is a, c, g, or t
aagccctcgaggctgcagagacagagggaaccgtgtatgcaggcgttgcaggcgcacactgagatggcagatgcacgcaactggctcgaggctcttgtcgcgggctcagtgcatccgcctccatgcagccgtgagntcctgaangcaagcgcaactgtgcacgccacagacatcttcttggcgtgggcctgcantngaaacgtgccatgcactggcagnacggcagttcgtggacagcgagtacctgcaagtaagaccgtgcagcagggcgtagccgtagctagtgaaacgccccgtgcgagcaaacgacgccccgttcccccatcagtgacaggtggaatcccggtgagaaaggcggtcaacacgcgattcaccggcgttggcagcgcatacactggaggaggtgaagacccttagtacgtttcgcgaggcgcgcaaacggcagcacggtatccaaagaggggacttcaacgggcacttccatggtcgtttgttggcagacggggggtcctcggcggaactatgccgttaactttcatacaagccatattacaggctccggcctctggtcggagactttaacgcccattcggcgaacgaagggggctcctaaggtaaggcacgacgggcgtaccccgaacctccgaacccgtggggtggacacaccattttatatgcccccagttcggaaatgtgtggacccatagcgaaaggataatattcgctcaggaggggaagtaccttacccttatgacgtgtcaacgccggccgactgggggttaactcctctctatggggaacatttgctggaaggaacatggggggcaataaaaccccggaggggaacacggggccgcccattttgagcccttttaatgccgaccactagggtggcgccatttccaaccggagtccttggacgagctagcggtcagtgctttgtgcattcccaagttatctccccctttaacgaccagggggcaccagcggttctccattatgtgccgttccacttatttaagattcgcgtgtgaatagcacgaggcaaataggccttgtatcgggcccccaccactggtggtcctcctatgcaaagggcctctttattgggcaacccccgtggcatcattgttggggcggacgaagaaggtcccccttaagggtgtgaaatcctcaaaaaaggggcgccccacatcggaataccctccctgggagggacgctaaaacatacctccctctgtgaaacgccgcaaccggcaagcgcgactacaggcacttttcccctatacttccatcgtttcttcgcaagggccattttccctaccacggcgggtctccgtagagcgcctggagacgacagacgtagaggccccacgcggcgccccccacaaggaagcttggggggcgagccacacacgctctggcgcacctacgggcacgcgcgcgcgaagagcgggaagagcggtcccacaatccccacagaggctccatgcgcccattgggcgcgagaagaataccttaaaggcggctcatggcgctggacggaccaccctccagcggggcccccatcgcgcgacacctcaagagcccacggaccagcgctccgacaaagaacaactgccgcagcacccacggagaccccccggtatcagcacacctccctccaccgctccctagccgaaccaccatccgcggcgcccccgcgcccagcgccacccgcctcccctgtccgcgcgccaaaaccaccccagcccgagcacgccgccccggcccacccacacaccccgccggcagcacgcgccaacgccacaccaccccatgtcaaccaccgcgagccacaccccactcaccacacaacacagcaccaccccccc

SEQ ID NO: 572987 - DNA, 596 bp, Homo sapiens
agcggggtggtgcgtgggctaccccaacctgtgtggctgggccgcggtctcccctcaagggcctggggccgtgcctcgggtgtacgcgtaggggtctgtgtgctgggggtggtcaccgggcagcgtgggtgagcgggcagggggcagggagagcgagagaggggagcaggtaagtgaacgctcgccttccggggcctgggtcttggggtcggggcgcgcgaggcggagcggagagcgccccaccggggggaggagcgcggacgagcttccgccagctgcagccccggcgtgtgcgggctcgcccttgggtgtcgcagcgacccaggaagtcagggcggccgtgaccaaactcctgcgggaacggaagccagactcccggggggtgggagtggccactacgttcctgcgactcgcccggtgggtaccggatatacttggcacgtcccagaaatcgagtgacttcgaaagtactagcgcacccggaacaccgtgactccatttgtgtcaccgaaagcggcctacagaaagggagaacctttgaattactagcattaaggattaccacaagaaccagcgcctggactcactgtatcccc

SEQ ID NO: 572988 - DNA, 199 bp, Homo sapiens
ctagaggaaataatcttctcaagcatcccagctctatcacagatactatctatggcactagcatgcacattctcacccagaaagcccgagacagtatgctctcatctgaaattagtctgctaggatagctgtcactctcgggtgcgctaccctattgggctgtcactctcagaaatgagacatcctaaagtacaggtca

SEQ ID NO: 572989 - DNA, 283 bp, Homo sapiens
  misc_feature (100)..(100): n is a, c, g, or t
  misc_feature (111)..(111): n is a, c, g, or t
  misc_feature (115)..(116): n is a, c, g, or t
  misc_feature (128)..(128): n is a, c, g, or t
tctaccccccccaaaccacaaacaagaaccccccaatctagcaaaaataaaaatctcactatttttgaccaagcttcctcttaaactctatacacccaanctatccttttncctnnaatcccaagttntgagatttacacaaaaatatttcattctaattactttttatactttataggtcaacagctctcttttaaacacaaaatttattcaatatactttttcaaacaaactttcatgttctaatcattctctcatttcaccattaaattaaacacactga

SEQ ID NO: 572990 - DNA, 1077 bp, Homo sapiens
tggtgagagaaaagagagagagtctaccctctgtgtgcgcaccccacaaaaaagagagagagaagaactgtgtgtgctacaaaaaaaaaaaaaaaaaaaaaaaaaaaaaaaaaaaaaaaaaaaaaaaaaaacaaaaaaaaaacaacgaaaaaaaaaaaaaaaaaacaacacacaacacaaccacacaccacgacgacagcacccaacaaacaaacaccagacgagagaaactaaaaacaacagcagaaccaccacaccacacgacacaaaaagaaagaatacataaacatagtcagtatacaaaaacagaaaacacacacagagaccacacatacaaaaagaaacaagacaagcagagaaaaccgcgatcaaacacaaacaaaaaaaaaacaaaattgacaacatcaagataaaaagagagacgaaaaaaagaaacaaacaacacagaccaacaacacacaacagagacaaagaaccgaacaagcacaagaccacgaagccacagaacacaaccaaacgacaacaaacaagcgaaagtcaaccaacaaacagcaaacacacgaacgacagacgacgaagcacaccagacaaaacaccaacgacgacaaaccaccacagacaaaaaacacacaaacaacaaacaaacaaaaagagacaaaaaccagccgcacaagcacaacagagaaaaaagaaagaaacccgaaacaacaaaaaaacaagagaaacaaaacaacaacaaacagaaacgacagcacagacaggaaacaaacaagaccacgaaaaaagaaacacagaaaaaagaaaacgaaaagagaagacaacacaaagacaagaaacaccaaaaaaccaccacacaaaaacaaacacaaaaaacaccgacgacaacaacaaaacaacaaaaacaaccaacagccaacaacacaccaaagaaagaacacaaacacaaaacgacagaaaagcaaccacaaaacaaaaacacacacaacaaaacaaaccaaaacgaacaaacgaagacaaaacagaaacaaagcacgaaaaacaacaaacaaaaaaaaaccacaacacaaacaaacaaac

SEQ ID NO: 572991 - DNA, 638 bp, Homo sapiens
gcagtagttaataatggtaggtagatagaataataattaattaggtagttcggtggtaggcgaccacgccgagcaggttagctatctagtcggcagtcagtagtcagtagtagtagtggttgatgaatgataatttgttcatgttctttgcctgcgcgctgcggtcggcagtcgtagtactactggcagcaagctatagtggtagtactactcctgtattagtgactactcgcttcgcggcggcgctagagagtagatagtctcttcttctctactatactctcgacactactactactcctactgctagatgatatatattgtagtctatatattactctctactacacactactctactattacatagtctgctactactactagtactatatgagtagtagtagtagaagtaagtagtatcgtcgacacacataatatagtcgtgatactatcatctctatatgatttctctcgtagtatagagatgttgctctctctagcatctctctctctatgtggcgtctcttgttatctcacttctctgtgtagagacagttctctctctccgtcgtgtatatatatataataaagtcgctcttccctccacacctgcacccacaaaaagacaaacaaac

SEQ ID NO: 572992 - DNA, 718 bp, Homo sapiens
taatctatgttgtggacaatggacaatctgtgcacttccagacaatatttgctcgctgctcaaatgatacggttggtatgaccctaaagtaactcgagtacttccatgctggattaggtgtggtgctaggggaagacaagaaacagtcataacaacacgtatcgggatgaaacagtgcgcctcatagcatactatctagggaaaaggactaaaacgatccatggacaagttgaaggacaaagaaacgcagacaaggtcttacctgcagaggaatatgaatgctgctacagacaatccgttgcatatggctgcatccaatatgctgaccattcccataaccggttgaatgactacatcttctccttatgagcacaatgctacatgacagaggaaatacagctgcttacttgttgtatgccttcactagaatcaggtctattgcacgtactggcccaatataagatgaacgaaatgctccataaaagctgctcgagaaaccaagacttctttctggaatcatgagacggaatggaaactaggccggctgcattttacgagttcccttagaattctgcaaaagactatacgatgacttatatctccacactctactgtgattaatatatatgacctggacactgttttcaagcagttccaatgataacggctacggggtgagacgatggacgccttgcacattttgacgaacataggcact

SEQ ID NO: 572993 - DNA, 665 bp, Homo sapiens
aatagaaacatacagcggcggttgtaataactgcgcagcatggcgatcgccgcgggcgagaacgggttgccgctgaggtcgaagccctgggctctgtctgcatccatttcaaggaggtcgctgggcagctcgctaatctggttattgcgcaagctcacttgatcaagcgatggcaggttgaatattccgatcggcacttgcgtgaggccagcttcttcgatcatcaaacctgtcagccccgacattttgctgatgtcgggcgcgacgcccagcgggttatgactcaggtccaggtactcaaggttttgcaggtcgctcagggcgtcggcgctggtggtggtcaagcgaatatggctgtttgcaaggctcagtgacttgagtttgggtagattgaacacggcgccaggaatgtcgttcaaggtatagcggtagatcagcaggctttccaggttgggaaagtgctcgagaaatccctggggaatcgacgtagtttcctctgctctcaattccagcttcgaaatgtgctcgaaatcgatattcaatgacggtagatcgcctagcggcgccagcgtcacttccatttcacgggaggcggcgggcggctcttggtcggagtccagagcggtttcacgtcgccaagctgcttccagcactgttttgagttc

SEQ ID NO: 572994 - DNA, 656 bp, Homo sapiens
cctggcttcttagtgaagacaatgtacagtatcccattagatcagggctacacagtctatgagcaataatgtgatttgtggacattgcccatgtattgtcctcactgatgatttcaagctaaagcaaaccaccttatacagagatctagaatccctttatgttctccagaggtaggtggaagaaaccatgagcaggagcaggaattgagtgataaacaaatgggctaaagaagaaaacttttcttcttgttcagttcatccagattataactttaatgggacactttagaccattagacagttgacactggattaaacaaagtcacataatgccaattacacactgtatttatggcaatgtataatttgcaaagattgactttaaaagatgctgtgtaacagaattgaattaattcaattacttattatttagaatgctaaagcttatgctagtcttttctaattcttaacactcatacttgaaatcttgctgagtttccccagaagagaatatcggatgttttttgacatttttgacccatttaataatgttcttgtgtttacttagtatacatagactttatctcatgtgtcaaaagtcctaggaaagtggttgatgtttcttatagcaattaaaaattatttctgaactgtaa

SEQ ID NO: 572995 - DNA, 226 bp, Homo sapiens
ggtcgctctaacgtgatccccgatgtgcctcttgaggtcaggagttcatgaccagccgtggccaacttgtgtataactccgatctccacatatataattacaaaaattatgccaggcatggtagtcgggcaccgtagtaattccgatgccactcgagactgttggtgcatggagaatggctctgagcctgagagcgggtgtgaggattgcatttaacgctgctgat

SEQ ID NO: 572996 - DNA, 216 bp, Homo sapiens
aagccgccccgattatgaacgcttagcgaatatcagaaatagcaaggttaggttcctgtaagcctctgggtcacaacattttcatcaactgatcaatacataatcttgtttaatgtgtgtttctgtttaaagtaccttattttattttattttatttttgagacagagtctcactctggttgcgcaggctagagtgaagtggtgcgatctacggct

SEQ ID NO: 572997 - DNA, 1153 bp, Homo sapiens
  misc_feature (55)..(55): n is a, c, g, or t
  misc_feature (1153)..(1153): n is a, c, g, or t
atcaagtgtgcgctatacaaggacggttaattggaaattgcactaccatgcgatncaatcatggtagcattcccctgtagatcccaagggttcacattgataacgtatcagggtagagatgtaatactaagactattgcaaccacgtagtaattcagacgtcaggatccatgtgcgtaccttcaggccccgtaaggactctgcatgcgggatgctggcagaggccaaggcccggcatggtttctgcggtatcccaatcacagacacaggccggatggggagccgcttggtgggcatcatctcctccagggacattgattttctcaaagaggaggaacatgactgtttcttggaacgagataatgacaaagagggaagacttggtggtagcccctgcaggcatcacactgacaggaggcaaatgaaattctgcagcgcagcccagcaccggcgcacagttgcccatctgtaccatgaacgatgactgacgcttgtggccatcattgcccggcacagacctgacagaagaatcgggactacccactagcctccaaagatgccaagaaaccagctgctgtgatggggcagccattcggcactcatgagcgatgacaagtataggctggaattgctcgcccaggctggtgtggctgctactggaatcgcacctctccccacgcaaattgcactcttccagactcaatactgactccagtacacttcaacgcaccaaatcaccctaaatctccaaagctcactttggaggccactggggtcaactgctgcccaggcaagaactccattggagcagtgggatccctgcagattgacatcgacagcttccatcttgcattcaccgaaatgctgcgcttgcatcgcgggcccaaggaaacgacaggaacccatatcccacatcttcacacacatcaacaaccacaacaagtcatcaggaacaccccaccagtgaaactgtaaatcataaccaaataccaaaaataaaacaacaccaatcaccacataacccaccatatctttacactacacctacaacaatccatctcatacatcacacacacaaacataaacaaacaacgtatcatacaacacacatcttaatgcacattcactacttgacaaatatctaaatattaacn

SEQ ID NO: 572998 - DNA, 956 bp, Homo sapiens
atctctcctaaatcatatgtttggtatgctagcactagaagatctgcagaacttggacttacgctgatatcgaggcagatcttgtataatgtcctaatgatggccttgatgacctataaaaatcgctggggcgtaatacggatgacgtctctagtaaccccttcacagattggacgtccctgcatgtgatcactatatatgggttgctaatataagcagagaagctcagatgctgagcccgcgcatgtcaaattacgccgggccctatgaccttaataggtctcaaatctccaaacaaattatgggctagacttactgtacataaccttaaaacctacttcccaattgcttaaaacttaatcgtccccaaacaattcatatttactaccaacgtgacaattggacctttccaaaaaaaaccacattaattctggaatcaaacacaaaccaacccacagccttaattcattaaggcactcatccctcctactattttataaccaaaatctcctttaattactaacattttcacagccacaggaacctaaatccatattgtactatcttcttcgaaaaccaaatatttatccccaaccttgtggtaatcactcacgccgatggagcgcaacctaggcacgaaacgccttgaaactgcagggaactattacttcctattctacacccttagtaggcactctttcctcctactacatcgcatactttacactcacaagccccttaggctcactaaaccattcacgtaattcattctcactgccaagaaactattcaacttcctgacgccaaacacttattatgatagctacacaatacgtttactaggtaagaactcccctttacggactcatatgatcctaaagcctttgtagcccaccgtggtcaaatacttgcgcagacactacacggcgatgaaaatagcccaacttaccctaaag

SEQ ID NO: 572999 - DNA, 495 bp, Homo sapiens
gtcgagtgaatgtgaacctaggtttgtcttcactccaaaaccctgaaccacagtaatgagctgtctctgtaaaggggtgtaaccgtggtcttctgctagggaagtgataatcgatcttgattatctagagtgtgtgtacatttgatctagttaggatattctttttaccttagtatgatgactgatttaaattttgttaaattttaagacccctctggggccattattataatttaaactgattgctaatttgtattatgagtacagtatagacattccaaggtcgggttgatttagtatccattacaagacacagacctccactctgtctctctcaatctccaccttcctcttttcctccccattccttgtcctacccttcagtagagtaacttttaacttattcttttagtattaggcttgtttttcctttgaaaagtttgagatactttagaaatataaaaagatagtctcacaataaacattcactctgta

SEQ ID NO: 573000 - DNA, 228 bp, Homo sapiens
aaacaaacattatactgaataaatacatttacttgcctgcttcaagaaatagccctttggcccacaggatgatactgtgttgaaaatggaccagttattactaaacaagtctgctatatacttattttagatcttgcacgttacagtcccactattcacagtagttcagaaatcagcgatatgtgagatcttgattgcggccttaagagtgtcagatttctgaagggc

SEQ ID NO: 573001 - DNA, 146 bp, Homo sapiens
cggtatggtcctagcctttctattagctcttagtaagattacacatgcaagcatcccgttcgagtgaagatacaggacattctcatcagcacagggatcccaggatgcccacttccctccacccccacaccacagccatttaggta

SEQ ID NO: 573002 - DNA, 541 bp, Homo sapiens
gggatactcaaatatttgattcatttctcttagattgttatttcctttgattgcagtattttttttaaaaaataggttcactgagatataattcaaacataacattcatctttttaaagtgtacaattcagtcatttttagtatggtcacagagttatacaaccatcaccactgatttcagaatacttttgtcacaccaaaaagacaactcatacccaactccatcttctcctgatcccccagaaaccactaatctgttttctgtctctatggatttgcctattcttgacatttcatataaatggaatcatataatattgcagcctttgtgtctggcttctttcacttagcataatgttttcaagttcatccatgttgtagcatatataactacttcatatctttttgtaaacaaacaatattccattgtatagacacaccacattcttgtttatctgttcatcagttgatggacatttgggctgttttcatctttttttttttggctattatgaataatgctgctaagtacactggagtc

SEQ ID NO: 573003 - DNA, 304 bp, Homo sapiens
  misc_feature (132)..(132): n is a, c, g, or t
  misc_feature (137)..(137): n is a, c, g, or t
  misc_feature (149)..(149): n is a, c, g, or t
tcacaaagagacaagaaatgatctctgtctatgatcactgctaccttgggaccctttcacctttcagaggagagagattgaaactggctcacacgtggggaaatacgtatactggaggcttgtcacagctgngtgtncccgtcattggnggtttgggtccagggagcaagagaaaaacacactcctttgtgttcaaagatgaaaatctttcctgagtttaggggagcccagctttgggtttaggggaacccagctttttaggtatataagggcccagctttgggtttaggggagtcctcaactc

SEQ ID NO: 573004 - DNA, 598 bp, Homo sapiens
  misc_feature (139)..(139): n is a, c, g, or t
  misc_feature (384)..(384): n is a, c, g, or t
  misc_feature (441)..(441): n is a, c, g, or t
  misc_feature (556)..(556): n is a, c, g, or t
gctcgacagagtcagctgcaacggccgatgctgcggctttcgtcttcatcgctctgacgcgagtctgctggttcataaccacgaccacgagctacggtgagcttcatgttcaaggcgccgttagacgcagggttggcanttacgtgatcgggattaacgatctcgacatcatgatccagctgaatatcggcagcggtaaccacccccgaacccttcttcgacaaggtcagcgtaacttcgtcacggccgtgcagcttgatagccagacctttaaggttcaacaggatttcaatgacgtcttcctgtacaccttcgatggcgctgtactcgtggagcacaccgtcaatctcggcctcgactactgcacagcctggcattgagganaacaggatgcggcgaggcgttgcccaggggtgtggccaaaaccacgctcgagaggtncaggggtgattttagcccgggttgactggaaaacctgcacttaaatgtaaggggtgttacggaactcatgtaccgaattcgcatgggttgaactatttttctaggccttacttgngagtagagctcgacaatcagggcttcgttgtcgacgcggccg

SEQ ID NO: 573005 - DNA, 162 bp, Homo sapiens
gggggtatgctgttcgaatcattagaacaggcaggttagaagtagcggtcttggtgacaaaatatgttgtgtacgagttcagcgtgagagtgcgtcatatgttgttcctagtgtaagattgtagtggtgacaggtgtttattataataacactcctcactat

SEQ ID NO: 573006 - DNA, 785 bp, Homo sapiens
gactcatgcagtcgtgtgtgtgtgtgtgtgtgtgtgtgtgtgtgtgtatgtgtgtgtgacagtgtctcatcaggtccttccatctctgggagttttcttcaacccatatctctagaaattacagctgacagtattatagtagtgtgagcagaggatgatgtgcaaagtataaaaataaagttattatactctcctcttgcatagatacagttatagagatatgcgttgatcacctccgtatttcccaggcagtgctgcagagtgctgtaggacatagtggtgaacaagagagacgttggtccaagctcttacagagtcgacagtctagtctcagcattataggaaaaccaggagtgaataaaccagggtgagggcttgagctctgtgtttatatattagtgaggagaaaagtgtgaaaacaagaagtcttaagtaaatattgaggtcattgtgtgggcttaagtgtattcatagaaccatcaacactagtgtctacagcaatttcaagtgccctatcgatgaggctagcaccttaatcactgtagagcgcggattcatttataaagacgcaattatggacgccattttcaatagcctgggccattttagtgtacagccaacctgcaggggacaatcgggacgaagtaataatgaaatttttaagagaatattaaaaaagcatattattgtctggtaccaaggaagtggtgtcaataataagtgtgcccctaactggatagggccataaggagtgtgcaatatgatgagcttgtgagttgaaaatt

SEQ ID NO: 573007 - DNA, 145 bp, Homo sapiens
ctatgctagcagttcagatcggcagcgcacctgctcgacctgctcacacgaaaacgaactgttcgaatcgcgccgcgccctgaccaacgcggtctatgacctgaggctggcccagtatcgctggctggcgctttcgcataagctg

SEQ ID NO: 573008 - DNA, 252 bp, Homo sapiens
actacatactccatctcggaaaaaaaaaaaaaaaaactatggctggcagtcattcagatggaattgaggaaagaataatattaataactggatttcaaaagggactggaagatgtgaatcatctatttggctgaagaattcttacttcttggaaattactttttatggcggtggtcatactcttaggtgccaaacgggggaaaatttttaaccagggaagcggaagtatgtagtcgggtaccggagctcgaa

SEQ ID NO: 573009 - DNA, 896 bp, Homo sapiens
  misc_feature (379)..(379): n is a, c, g, or t
tggtatgtatatgtgaaatgctccagcctgaatcgacattaaagcatctgttcataaatactaaagctagatgatgtgggggacattgaatgacatgtgacatgagaggtgatttgaatacctgcataacagtaagttagtcttatattgtatcatatgatatgcggtaggaagtatgtagtttttcatagggttgtattgaacgttactcgtattggattgacattgatgtatcgctcaagatagatagtagccatgtatcatgtaattcaagactatctatataaatctggttgctacgatgggaatacttgaattagacagtagttagttgtgaactaatctatcgtcattcatgcaagtgtgaaccaagaatcangtggtctcttgattctattacgccctactaaagattggtgcatgagaagataataaagatatgaatatttatcgtgctgaatagcattttaagtgtgatcagtaatattgactcaaagaacgcgcttgcctaatatttacggcccaattcgtgtgcattctccatattcgattgtacttcagtcagtctgagacctgtcgcactcaaattcgggcagagtattatatctatactagactgtgtagtgtgttggggttaataagtcacatgtatcaggagaattgtatcctgaaggtctggaggagtgatgcgtcaaaagcaagtatttcctgtacgcaaactatgtagtaagtcctggaagaattgttggtggtacgcgacacttggccttaatgccagaatgcttgtctcctaaggatataaagatgaggtgtacggtgtgaccatcctaagttagtcagaaagattagaaatgaagcgcattggagtatggggtcctactagattaaagagtaag

SEQ ID NO: 573010 - DNA, 904 bp, Homo sapiens
ggaccggcggcctcggaggaaccatggggattcctcgccgcactgtccctgcggaaggcggccccggcgccgggcctcggcccctcgcgcgcgggtcggcccgggtccgatcgagaggcgagtgtcgtgagcgtgccgcgaacaaaagaacccgctcgtacgggcagcaccgccaaggggtgcgggccgccggtggcggccgcggggataatgtggagcgcgcccatggtggacagccaccgggtcccgccgcggggacaaaccccggctggaggggcattcgccccacaaaggtagcgggtggtccacggatggacccagcatttaaaggggggccaaataaaggggtccacccaactggctggcgtcatattcctgggaaggagacaaacttgtggacccctccccagcttatttatcagaagaacgccttgtggtggttcaagtggcccttaacctcccagtgggattctccagaaaaattgaaccgcggctgatcaaccagctttcttcttccaggacggaagcgacccaggtgggttggcccgggaaaaaacttcccctccttcccagagtcctcacagaaatcctgagggtcaggccgggtgcaagccttgacggaagcgggccagcagagagatttcctggaagcgactttggcttggcagagattcactgttctcaaccacggggcggccaagacggctaaagagaccgcagacgcgatgttgagaatgtcctgagggatttcccttcaacacaggagggagcggcgggggcgtaactctacccagattgtgatttgtcgggcccaaagcacccaccttggagattcaaaaaccttgggtccaaggggcccctgaaccacacggcgtccccgcgcggcgaggagccccgggctaaa

SEQ ID NO: 573011 - DNA, 429 bp, Homo sapiens
  misc_feature (415)..(415): n is a, c, g, or t
  misc_feature (419)..(419): n is a, c, g, or t
atccagtcctgtggctcgatagccgtttcctgggctatccgttgctcaaagcgttcttcttgggtcacgtcatcacctttacgattccagttttcgtgaattaattaaaaacacgaatcacattgttttatgaaagttacacaatagttaagtaaaatcacaaattttgtatgtttgaactgtgacggatttcgcaccctatttttataaatcattatttatcagtgcattaatgttttccgcagttgctatacagatcgcatagttaacatttcgttaaaagatcctttgctttttatgattcgcgatttaactattagcaacagaaatgtgaacatctggggagtagcgatgcagcagttagccagtttcttatccggtacctggcagtctggccggggccgtagccgtttgnttcnccacgttatt

SEQ ID NO: 573012 - DNA, 249 bp, Homo sapiens
atagccctgttctttttgcgagggatcgaacccagtagtcaccaatcgagtccacttgctccagtacaatttaagtgtggatccggtcatcagagaactgcctctctgcccttagaccttatcatctagcgcttaccttacattatgcttcttcatgcttgtcaatttccacttgtcacaatcatgtcacattgcgtctggctcacattttcctgggatcaccgaagctcgcacaattctgtcacatcc

SEQ ID NO: 573013 - DNA, 135 bp, Homo sapiens
gagctcgcgcgcctgcaggtgagaaaattgagacggagctaagagatatctgcaatcaatgtactgtctctcttcggaaagttctcgatcccaatgcttcacaagcagagagcaaagtcttctatttgaaaatga

SEQ ID NO: 573014 - DNA, 343 bp, Homo sapiens
  misc_feature (134)..(134): n is a, c, g, or t
  misc_feature (140)..(140): n is a, c, g, or t
  misc_feature (146)..(146): n is a, c, g, or t
tgatctacaggactatgtggtactgctgagtgtgttctgtgagactctccaagcaaggttagaagaagaagaactctagctgggtctgctacatcactgcagtttagatggatctggagagagacatgcttgtnctctgnattggnaagatgatttactctcgggaatcttctctgtcagcctgtacatctaaaggcatgaagcactcaattgggcgattaacattaggtgtttgttctctgatggtatctctgagaatactggttgtaggactggccagtagtgcttcgggactgggttcacgcccaggtctccagcaggtaggccacaggtacccgagctc

SEQ ID NO: 573015 - DNA, 545 bp, Homo sapiens
gggggaccacgcactaaaggttggactctgagacactgcttaccgtatcatcaaagagcatatctcctgttatgatcacgcgctgatccacaggtctcttaagggctgggtaggcctgcatgccgtattgctaacagtcacaacataactagcttatactcacatactagacactcagggagtccagaccgtaggaacaatcctgcgcggcatcatgctacatcgaatcagcctccaagcctttcggatccgttacataacaagcggggtgagcaggctctgcgtcacgataaagtcactgggtcagcaatgttgctgatcgtatgagtacacagcctacgtgtgacgaatatttaactcttacatactatccttggtattgctaggaccaggggcactgcgatttcttgacggaggcaagcgatgagtactctcgattgaagcgaggttccaatgaggattacatggcctgatgtcttgcaattatgcactgttctacattatgcttagagacagatgtaccctccggccgaatatttcaacca

SEQ ID NO: 573016 - DNA, 597 bp, Homo sapiens
gatctagaggatccggtctgagcaagcgggaaacaattcctttgacaggtcaggaccgtggtggggtgagtgcactccccagggcggggcaggcaagaaaaattaggaggggagggggcaccagttcttcctaaggggagcttgagactcctctagctcccagtgcctgacttggaaggaactacaaaccacgggagcatggtgccctatttcccttccctttctcactctcaataagaacctcataggcaggggggcggtggctccagaataactaatttaacataaaatacaaacacttaggtagaacggcatggagagcctggggctccttcagcaaggtcagggaagagggaccatgatggggggagaatgacttccttacctcccattcagggcaagggctcagtagctctgcatcttgcgagtggtttttaaaaacaaaaatttctaaaaggagcagggcaatgcagatcggtgggtacctgggaggggatgtcctggtataggacaagggaagaacagagcggtaccaactcccccaagatctccccaaagatcagcacgaacaaatggcgtaggttggggaggggggac

SEQ ID NO: 573017 - DNA, 321 bp, Homo sapiens
gttatctggagccggatctcctgctgaccttgagggcagcaacatgcaactaatactaaagcagctccagaccaggcgccgtgcctcaagcctggaatcccagcactttgggaggccaaggcaggcggatcacaaggtcaggagattgagaccatcctggccaacatggagaaacccgggctatactaaaaatacaaaaattagccgggcatggagctgcgtgcctgtagtcccagctactccggaggctgaggcaggagaatgacgtgaacccggcaggcggaccttgcagcgagctgagattgcaccactacactccag

SEQ ID NO: 573018 - DNA, 147 bp, Homo sapiens
ctctaagaggtccccattaaccattggatttttttaagaactaaaaattccaaatggtggccaccacaatcacacttcctcggtacttcacttctctcctcactctccattaattctggcagtttatccagaaaaaaaagtgtagag

SEQ ID NO: 573019 - DNA, 160 bp, Homo sapiens
tagtccggaggctgcagtattctccaaggacgcgggggtcttggagtcaaccccagccccgcaaagcagccctgcctcaatggagacaccacctgagctgcccatcctgcctcatcacacgtggtcagggagcagcgcgctagccatcttagggggggtg

SEQ ID NO: 573020 - DNA, 5047 bp, Homo sapiens
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccatcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgaaggagaagcggaggagcctgcagctcccggccagcccggcccccgaccccagtccccggccagcctacaaagtggtgcgccgccaccgcagcatccacgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctgctgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgcgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacacattcctcctcagctccacccacctggagacgaatgtagccagagaggaggaaggagggaaactgaaaacaccgtggcccctcggccttctctctgctagagttgccgctcagaggcttcagcctgacttccagcggtcccaagaacacctactaattcctctccactccttcatggctgggacagttactggttcatatgcaagtaaagatgacaatttactcaac

SEQ ID NO: 573021 - DNA, 388 bp, Homo sapiens
atccctgaaatagggagccccttttagaatttattaaatccttgccctgggggattaaagcattccattagcaagagttggaccccccccccagttttcgccttcctttttttaaggtgttttaagaaaaagccctaaaagttttggattcatttttcccattctttccaaagggagaagagaaaagttgatggggtggttgtttttcaattatgccattaaaataaacatttttgttaaattcccctatccttggtttttaacggttttttttggaagggaagactacgagagggaaactttggtgaaaagtttttcccctatggtttatttattggcaggattttatgttgaaaaaggaaagaacattaaagtccttaaacctcca

SEQ ID NO: 573022 - DNA, 4753 bp, Homo sapiens
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccatcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgaaggagaagcggaggagcctgcagctcccggccagcccggcccccgaccccagtccccggccagcctacaaagtggtgcgccgccaccgcagcatccacgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtgactccagcctgggttatagagcaagaccctgtctttaaaaaaaaaaaaagagagaaaaatggctcccatagacttgcttgacacagggttgccacaaacttcaatctgtaacaaattttattatctggtaatctagcactttgggaggccgaggtgggtgcatcacgctgaggtcaggagttcgagaccagcctggcaacttggtgaaaccctgtctctactagaattccaaaaaacaaaaaaaattgggcttggcacttggggctgtgtgccttgatggtctccccaggccacttgtgcgcagggctgtggacgctcagcgagaaactctccctttggaaaccctgtgtgagagcgcacgagggttcgcagtgagacccgtgacacactcgtggcccatgtgaccaccccaaaccctgtgggcacacaaaaaggggagacacctcccagttgcctcacaagagaagaaacaaaagaggcgaccaatacactcaaggagcgcgcgcttattttcctgcggacagacgggggccccctaattcggagccgccaaacaacgccaaagaagcgcagacctggcaaacgatgacgacagcgaaccacaagccggcgtggtgcggcgcgcgcccccacacgcgctgggccctatcggaagaggagcagaacgcgagtctgatgtaagtaacgaaacactacgtagactggtgtgttggcgcgcgcggttgggtcccctcaacttgtggctaacgaagtgggcagaaagagtggtggcgcgaatgcgtcagcgggtgcttgaccagcgtgggaagaggacgacctaattggagttggcgtaaacgaaagaagatgaggaggaggagggtgggatactccgcacacccaatgtgcatgcgc

SEQ ID NO: 573023 - DNA, 596 bp, Homo sapiens
ctcattactggatactataatgcgttcaagagtttgctcattaactgtcacagccattattgatctacctaccaacagcgacaggatctatatctaagcttatgacgggctatgcaatatagcaagacacatgctgccccgcttgtgaagacgtactgataataagcacatacctagaaggaacccagaatagtggtgttatgaggaaaataaacaggataatggcatagagaatgatggggatttatgggggctatatataggttaggtgacactaagacaggcttagaaggtgagatttgagctgcagagagaaaacatttccaagcaacttcagggcaaaaccctgaggcaagaatgagctctttgtgtctgagaatctagtgtaagactagtgagaaaaactagtgggagagtgaagaggtggccttacccacccagatcattgggggtctctaacaggacatggtaaaaatgtatagttatctttaacaaccataaaaatatgcttattaaatcattatattgtgattttggaactaacataagtatggaagatacagggctactgagaggactgatgtgagacaaaggtg

SEQ ID NO: 573024 - DNA, 248 bp, Homo sapiens
ttccaaccccggggcttaatttaaaaagcatttttttatcatttatcccccttttaggtattttccaaggaaaaaattaccaaattatttcattggtcttctttttaatcgggttcaaaaagaaagcaatttttcccctttttttttaacaagaaaaaaattttttttttttgtttttgggctatgaaccatttttccaaaaaccggtaaaagggggtcaaaagggaaaattttaattaaaattggta

SEQ ID NO: 573025 - DNA, 124 bp, Homo sapiens
tatggcggcgaagatcggtggcattacccccaggctctgactttcagcatcatgcagggcttatctgtctggaggcagttacctcataataaactattaaatattgtcatcttgggaaaaagag

SEQ ID NO: 573026 - DNA, 791 bp, Homo sapiens
taaatttattcacaaaaagcagctggaaatcagaaaggcagctgccgctccagcattccccctcaaacctaaaaaaaaaaaaaacaaaaaaaaaaaaaaaaaaaaaaaaaaaaaataaaaaaaaaaaaaaaaagaaaaaaaatataaaaaaatcaaaaaaaaacgaggagggagccgcgccctcactaaaaagaatatcctccccggggaggcgagccccactatgtcggcgcgcccccgccattttttgatgaaaagagaggcgcccccttataggggggcgcgtcctttattaatacgccgcgccgacgcgccgccggctctgatatataacacacccactctaggttgtagggcgcggtggtagaaaaccaacggctgcgacgaagcgtacgagggaatctctgttggtggggaagaaggaaccacacccaacatatacctatgggggggggggggagaaaacaataatgaggagggcgggacacatacccaccctcccgaactagaacgaaagtattatattataaacgaccccccgatgcgcgagagctgaaaataataatcaaagacaaacatttcgatcgaagcgagttaatattagatcatagcggttagatcaaaaccccaccgaaacgaccgacacgaatataatgaagcgtcgggctcgacggatcgtaacgaaaagaagaacggtagggtcgcacaagcacgaagaaacaagaaatcagaatcgcttctggacacacaagaaaactatattattatacaccagccgagcaggacagaat

SEQ ID NO: 573027 - DNA, 388 bp, Homo sapiens
cgccttctgggttcagcaattctcctgcctcagcctcctgagtagctggggctacaggcatgtgccatcatgcctggctaatttttgtattttgagtagagacaaggtttcactatgttggccaggctggtctcaaactcctgaccttgtgatccgcctgccttggcctcccagggtgctgggattacaggtatgagctactgtgcccggctgagcttagtacttacaagacttgttttgctgggcattgctacaatggtctagttgtctccttttgtcattaccagaagtttgaatctctgctaaagtcttttttatcttgttcttcttcaagactatcttggcaattcttgaccatttgtatttcttaagcattttaagatcagct

SEQ ID NO: 573028 - DNA, 319 bp, Homo sapiens
  misc_feature (76)..(76): n is a, c, g, or t
  misc_feature (79)..(79): n is a, c, g, or t
actccttggaggatctgcacatgaaactgtcacagcccagaaatgccccagccccattgagatgtctgatctcaantgnagagagacattgagatgtcttcctttgcaagacacagtgtctcaactgttcattcctgtgattctcagtgtttttcctcatcagggtggattgttaattcattaagcatttattgggcctcagttttgtctgtaacatacatagactaaattattttaactagagaactacctttactgggataaaatgtaatatttttgcccttagattttataaaggagcaaaatgaaaaggatcctt

SEQ ID NO: 573029 - DNA, 146 bp, Homo sapiens
  misc_feature (58)..(58): n is a, c, g, or t
  misc_feature (70)..(70): n is a, c, g, or t
  misc_feature (90)..(90): n is a, c, g, or t
ggtcagcaggaagacgatgtcacgggccgctgcgtgacagtgcacggacagctctgtntggcagggaagnctgggcacacgatctgaggntccgggcagaggacgtcctccatgtcatcgatgaacttctcaggtacacgtcagct

SEQ ID NO: 573030 - DNA, 569 bp, Homo sapiens
  misc_feature (23)..(23): n is a, c, g, or t
  misc_feature (48)..(48): n is a, c, g, or t
  misc_feature (52)..(52): n is a, c, g, or t
  misc_feature (56)..(56): n is a, c, g, or t
  misc_feature (61)..(61): n is a, c, g, or t
  misc_feature (66)..(66): n is a, c, g, or t
  misc_feature (72)..(74): n is a, c, g, or t
  misc_feature (76)..(77): n is a, c, g, or t
  misc_feature (79)..(79): n is a, c, g, or t
  misc_feature (129)..(129): n is a, c, g, or t
  misc_feature (133)..(133): n is a, c, g, or t
  misc_feature (147)..(147): n is a, c, g, or t
  misc_feature (154)..(154): n is a, c, g, or t
  misc_feature (176)..(176): n is a, c, g, or t
  misc_feature (318)..(318): n is a, c, g, or t
  misc_feature (346)..(346): n is a, c, g, or t
gagatgggttctcgccatgttgnccaggatggtctcgatctcttgacntcangatnctccncctcngcctcnnnanntnctgggattacaggtgtgaaccaccgtgcctggtcttaacatatgtgtctntatnttttgcagagatgngatctcnctatattgcccaggctggtctngaactcctggcctcaagcgatccttccaccttaagatgtgtgtcttgttagaagtaaatcagatctggtggttttgatgctatttattcagtctcataactgtcatgactctgaatatataggctcttgaaatggtagaccnaaaaatacttcaagtatattatttgctnttcttttctgcttgtaggattctgcaactaatttttaagttatttatgtgtgtaaagccttcccaagtcccaggatacctaaagttgtaaacataggggtaaataactatttaaatgatgtctgatagataaatctatagagaagggattcagaatcccaaatgcttgcaactgatattgtattcttatgttcaggtttaatcgtcgtagtagtaggcgcagc

SEQ ID NO: 573031 - DNA, 1407 bp, Homo sapiens
  misc_feature (489)..(489): n is a, c, g, or t
gggagaagcacgacgctggtcgggatgatcagaacccagtcatggtatgaccagtgccagcttatctatcaacatatgagtcacctgaccctatgtctggagtccgtcgaccctggggccccggaagtagacgaagtgcaggccgacaggatgccctgatacaatcaagcggtcggatttttccagtccttgtatgagctcttgcgtctcgtcgcctttgagcacagagcacacctaccgtacttactttccatgatgccaagccgagtcgagtggccactggatctgagacacatagtctggcaggtctacgcgtcccaagagccttgcagcctgggatgaaccgtgcgctatgcagcgttccccaaatgtcctgtctgccatatgctctgctgtatggcatacgagtgctgtcatgtgtcgcgaccgccggtgtgcatgaatgtccagtgctgcgtgctccattggggatgccgctctggaccccangtggtgtgcctattgactaggaaaagtgccgaacactgagggtatgcggcgaaccggatggatcgaagtagtgcacccagtgcttgcagtgggcgatacctgtctccccagaaattgtcgtgttaagcccgcctgtagaggattgttatccgcgacccacctgtaacggtgggagtctttcccgcgggatgaagccttgtagatcgaccctttaagggaaactaccatggcacgtagccatagaaactgggcacggctctttggagaaggcttggattggcaccattgaggcatcccttgttttgaacactgagcaaggctactcctttggggagcataataggcccacttgacggctcccaccgaaatcgagtcatctgggaagacttgggaggacccggtctttctgggctggggtgttgaccaaggcagggatctggggcccagttcccccattgtgacgaagccaagccagaaggcgggtcctttcaaacattcctttgcccaggcccccaacgacgaagattacaacgctttttcttagctcccctttttagggcccccaaggcccttccaccacatcttcccaacgcttggtacctcattccccagtggaacaaccttgtgtgcgcttggttcttatccaggacacccccttgggaccaaactggaggacaaccgaagggtcggaaaccaggggagatataagccattggacggcataggggccctcggttgcccaatatttccaacttgtttcaccaaggggggggtgaagggctcccatagaagttgggccacaggtttatcacggttccccggttgtgtgaatacatggagcgccagggcgcagggtcccaaacctagcgcctgggcgacagtgcaaggcacggcacataggtgttccacggcccgggc

SEQ ID NO: 573032 - DNA, 579 bp, Homo sapiens
  misc_feature (579)..(579): n is a, c, g, or t
tctggagacagcagtttagctctggtggtcccaggctggagtgccctgggcgagaatctcgggctcactggaacctccagcctcccggggttcaacgcagattctccggcctcagcctcccaatgtacgctgggaggattacagggcacgctgcccccatgtccggctaatatttggtattagctagagccggggttttcaccaccgttgggtcaggctggtctcgaactccgtgacctcaggtgatccacccgtctcggcctcccaaagtgctggggcttacagcgtgtgagccaccggccttggcccttctcgatactctctgggcttgcaggtttgtcagccccaacaatagtattggcggcaagcggaagcgctaccggatatgacgtaatatccctggaggacagatctcgtccctctgggacaatcagggtttgcccccctcttggaggggcggcgctccccggcctaaagctggtcgtggagtgcgggacaaaggccgcctatttaggtgaacgggcgcctttggcaacacggggcagcccgctttgacgggccaaggaagccggaaaccgn

SEQ ID NO: 573033 - DNA, 570 bp, Homo sapiens
  misc_feature (506)..(506): n is a, c, g, or t
caccgcgtgacccgcgcgctggccatcaactgtggccaggccatcactggctttgatttccatggcggctactcccatcccgtgactgatggatccattgtccgcagaggaattctagagacgtgctcctgactgcctgcgaacatgagcaggcctccattgaacggaaggccatggagaaagaggagaagcaggctctaggcaactggaagcagctggccaaagggctgctcatcagggagagcgctgaagcgacggtacgggcccaagagcgaggcaggagatccgcacacagatgcaggaggcggactctgttctgatgaacaggcagtgaccagctctgaagcagaagcggacagagtactggctgccttctggcctcaataccgagaagatgaagaatagcataagctgatgggtgggccccaagacgaccaatcggggccagtaggagacccaccagatgatgctgcccactacaggcccggaccttgcctcggcattcncagcccctgccgttgcggcatctatgcctgtaggccttgtggagcctgcacgccggagggcacg

SEQ ID NO: 573034 - DNA, 898 bp, Homo sapiens
ggagagaactagtttcgagtttttagatatatttttggtgagtaaaatcttcataacctaaagctgggagggacccaaaaaagccaaattggtgagcccttgtatgcgtccaatttagaaagtgggctcagggttctctagaacagatataaccagtagcaacaggttgaaaaagattcgtgttcccgtctcgcactatagttttgagtgatttatataattgatttaaaatcgtattcttttccatccgtgcagtggtctcagagcgcgtggctcgtgggccttccgaggacataacattctgcgaagtagcgagatactgagcgcctactccggagtggtctgaaaagtttctgcccgacaacagaaaagctgaccccgcatgtggaccgaccaaggaagttactctctgtgagcgggggacctaccgtgaggcgccgtgatgtgaatacgacgtgaggcagttttgaagggccctttgtgtacgagcgtgactattcaaacgtgacgcggctctgtggaaacataggggaatgtgggcacctctactgtaggcgggaacccgagaagaggaggagagtgaggattcatcttatacaatacatatcacattctcccttacatttaatacgagagagggaattcatccaagcacaagagtgtgacacacaaggagttgaatagtggtgcccctttgaccagatgattgtgtataacgaaggatttacaagttcggggagacctttataataagtgactgagggatatattcgcctgtcgacaagtgtggaaaacgaagctgtgtggtaacacaatgctgcttccccgcgagaaaaccccgcggtgaccacaaggtgcatccacgttgtggtgacctagacgtggggtgggcgtatgg

SEQ ID NO: 573035 - DNA, 154 bp, Homo sapiens
tagtcggtaccgagctctctctgtggggtgggtgccagtcctgagctagacggtcccttaccttcctctctgggaagctgacctcagccggaggtctctcctggtggtgcccctgagcggcaacctgattcctgtccacatccgtactggcgcg

SEQ ID NO: 573036 - DNA, 156 bp, Homo sapiens
tcaacatttagggtttacgacctcgatgtggatcaggacatcccgagtggtgcagccgctattaaaggttcgtgtgttcaacgattaaagtcctacgtcttgactgacactctttgtcctaatcacagcagtcctacgtcgtgattgacactcttt

SEQ ID NO: 573037 - DNA, 109 bp, Homo sapiens
atctctacaggatcccctccacacagcactaggctttcctgaattgtcaagcctggtgcctttccaaaggactatcagggcctgtggtggagccagcataagccactgg

SEQ ID NO: 573038 - DNA, 451 bp, Homo sapiens
tggggcccctcctcctccatataatgccgccgccccagggaaaaagttatatttgtgggtttgtcaagcaccttttgagttttaccccgggtcacagggagaacctcttgcgggttttggtgaacccctttattaaaagggttccccggggggattccccacgctttggggggcccgggattttaaaaaaaaaggttgtggttttttcccccctggccggttttaaccaggccttttggtttttgggcccaggggtttgtgggggtccctttcggaactttaaacccttttttgggggggtgggaaatgggttttttaatgtggccaggggttttttgattttttttcccttttaaaaaaggggggggttgggggggggggccaattccccccgtttttttttccaggtgttgcccaataaccctttttgccttttgggggggccccccca

SEQ ID NO: 573039 - DNA, 252 bp, Homo sapiens
tcagactctagcaggatcccccggcggccacagctctcatggtgcctacgatcacctgctagagatgagttttctatcttctttgaccaccttgcgcccatcacgtctagcctgatgggtgactttgaagagatcaattggactaactggacgaggagcagaggcttaaggaggaggaagaagactagatacgcaaagaggagtgaggcaggcagaggtacaaggaggcatgatgaggactaagattaggat

SEQ ID NO: 573040 - DNA, 1060 bp, Homo sapiens
tgccgtcgtccctgtttaccatctgcgagacgcgtcttggcggacaggctgagccttcggcaaccacaaatactatcgaaccttggcggggaccatgcgctgtctgccaatgaaatgtcctgagcggaccaatgcccgatggcttgtgtatctatgatcgatagtccctgggaggtgcccggacacatgtccgtttggacctctatgaaagacctcataccatattaatcgcagagtttctcgctacataactatgaccacgacatatgtaggcctgtagatgacgatacaagtctagagaccacatagaggttcgaggccactcctgctacgaatgtgagcccagagtgacttcattgcgcgaagtgcggttacgctgtagacgcgcgcgccgtgcaagacgacaatacgatgtgtctccgtagtcgtcctcgcgaagggcactcccaatcgcatcttaccaaggtccacattgtgtcccaacgtgtggttagcacacgcttgttgtaacattggaacccgtcgcgactggagcacgtgtaattgtagagacggacatcaagtatctcctgaggaactaatacctataggaaagagtctagcccgatctaggtcgtagtatgcggcgtgatctctagcacattgcggccggcttgtctccgggcacacgtgatagaagcgctcgggccatgcactatgtgaaagctaggaaagcaagaatgcgactaggatccccttacgagaccgcctatcgcatgaaggaatgtgtggtccagccaggcgaaggggagtgatgattcagccaggtgagcatggaagaacatcagtactttcagctcactcttaaccagttattggctatgtgatccctgaacgaagaggtcgaatgtatgacccaagaacacgccaggcagaccgctggagcctacacctgggcccgtcagtatttcccacaggacgaaaggagacacccaagctcttgactcgtacaccactttcggaatagccaaaccgggctgtacacagcttcacctcgtggcccccacagcagccagcgctg

SEQ ID NO: 573041 - DNA, 103 bp, Homo sapiens
tctagacggactcccggacctggagactgtctgacgggacctgaccgacggacggcgccgcggggtaccgacgctcgacacttcgtaactcactggtcactac

SEQ ID NO: 573042 - DNA, 1317 bp, Homo sapiens
  misc_feature (736)..(736): n is a, c, g, or t
gtccactccatcttcgatagcattctggtctcaaagcacggaattatggctcttactcactgatgctcgcaggatgccctgctgtggcctatgatgcatacgaactgttagtgagagtcatataaaagcactacaaaacatactacatggcatcccggccgtggctcacaggatcaaggtcctgaagcatatgtactcaggcacggcattcgcaccgcgttgaccactgctaatcaattgggcacgtgtcttgcattcgtcggcgaataccatatccgttatatcagatccttagctgaatactggttgtgtattctgggaaaatagtagaactgcacagggtgagacacgagcaactcacaggtctactctcgcctcaggagtcgagaccacggagtttgagccgtgttgctcgcctatgttctaatcatgagttgcatagacataggtgtccgcataaaggggtgtagtgcggaacttgaattaagggaaacagcgacaaacgttggcaactgtgcgaatatttagaataggattcgcgaaatagggggccaaccgcgtttaacatagggggacacgaaacgcttcacgcgagaaacacccgtgttatcttttccgtgggggggtggggaagtaatcgaatgactctctgcgggacatacatttccttagcactatgaacaacgaaagaaatttttataaaggagcgcttacttacgggggaaggacccttttntgaggaagtaatggaattcggacgatgagcatcactttgtgaggcgttttcccccaactgagggatttagcgaattagtagccatgagtgcgagcaccgtgaagagcggagagcactttgggagctttaacccagttggcagactattagataatctttgggaattggaaacaggaatgtctctaagtttaccacacagggaattgttttggggtgaacactacacccacggaattagcgccattccaaaacatttgggggttttcttgggggacacaggttgcttggcaaaagctcccacaaaggttgtgcaacgaaaacgccaaaaaaggaaggggttatttattaaggcggcgacggccaaaccaaggcagacaaaccaaaaaaaagagggttggaacagacagggttgctttgccaaagctttgtggtgaggaccggaaggggttgggtaacggaagggagggtccgtttgggcccggaaaggtcaagggggcccaaaaaacttgggaaaacccaagggacttttacattaacctcattagttgatccacaggcattatggggacacactttaccag

SEQ ID NO: 573043 - DNA, 223 bp, Homo sapiens
gggagcaaggacagtcaggtcggtctgggcaggtggcattgtgcagtccccctgcgtctgaggtcgctgtctgtctggcttgggcagggttgggggaggacgatggacagagccatccttcctccaggcacttgctggtccaaccggagattctaggcctgccctgagtctgcgcaggtgctagtggcaccagagacacttcttgggacatggattctggcgg

SEQ ID NO: 573044 - DNA, 308 bp, Homo sapiens
cgatccccactagatgggccaagccaggtgaccttctagagtaacgaccacgtctacaacgttatcgtcacagtccatgcatttctaataatctctcttcatagtagtacccatcataatcggaggctttggcaactgactagttcccctaattaatcggtgtcccccatatatagcgatatcccccgcataacactacactgagcttcttgactcttatcctctcctctctcctacctcctgactcgtcatctcgctctctctctcttgtcagggtaccgagtctcgatcttcgctgatcgtcgttc

SEQ ID NO: 573045 - DNA, 126 bp, Homo sapiens
ccggtaaattagataactgtgcctggttggttagagtccagcaaagcaggacaatgtagaggttttgtcctgaatggtaataggtgaattaagggtaatcttctggtgcaaggtctggaccataga

SEQ ID NO: 573046 - DNA, 117 bp, Homo sapiens
  misc_feature (86)..(86): n is a, c, g, or t
tcatctgctgcttggtttgatgttcccataacccagtctgtcaggtattctaccatcttattcctaaatttcatttctggcaaaangagaggtcatctctcggtatcagctcgggtc

SEQ ID NO: 573047 - DNA, 1055 bp, Homo sapiens
gcttccccgcgagcggacgcggcaggcctcgtctcgctttttcttatttttcccccctttcccctttcttttttttttttcctttcttttctcccctcccccctttcaccatttcccttgcggaagggcttcccggggcaggggcagagccggttaacccccgcgcactcgtcacgggccccggacgcccaaggggcgagcaggacgccccgctcccacccggcgcactcggaccggcggacgggaacacaagcgccggagagccacccccgtggcagcaaaatccgcgtgcacacgaccgcacacggctcgaaacactgccaccacacgggacgaacacacagtcgactcgcgctagcagacgcacacacagcaatcatgctacccccatgattcgtccccaacaaaaaagcaagtgagccaccagtcaggcaccccacaggtgacacagagacggacccgggacgtcaccacagacccaataatccgatggcgaatgaagacaccgcggggagtgtgcaccactgcgcacctatgcgagagcccggagcgcacaaacacggcgatacgccacggcgagacgagcacccaaacaaacaccacacgccaccccacaaccgaccggcgaccgtctcaccccccatgcacggtcccgtacactggccgtccaacgcccacaaacacgcgcaacagcgatgtcagaaccaacccagtacagaccccagggccagcatcccgtcacctatagtggagtagtcagtcggaaaagccggagctagcgacacccagcactaaagcgagcaacaccagcctgacgcgcatacgtcgacagtggtgctgccaccaagcatgagcgtaagccgacgcacacccaggcttcgcccagatcgctcgcacaccaacaggacgcacacacaacccgagcacgaagcataccgtgggatgagcacgacagacacatatcgagcaagccacccgaggccgaaggtcgtccccactgctcgctagtccctacgcgtaccagccgccacgcagtatgatcaacaaatgaccac

SEQ ID NO: 573048 - DNA, 385 bp, Homo sapiens
agtcctgcaggtagaggcttactagaagtgtgaaaacataggcttgagattacaggcgacagcgatatctaagatagtcagtagaattagaattgtagaagataataagtgtagaggagagggttaatggtagatattgctagggtgacgctaccaattaggtgacatgagtagagtagacagcagtaatgatagacggattaggcgtacggaccggggctatagatagaatgagtaggctgatggtattcgataataactagtatggggataaggggagataggtgtgcctatgtggtacgacgtgaactagggcattaaaaatcttagggcgaaagcctaataatcactgcgccagctcataaggagatggccatggaaggaa

SEQ ID NO: 573049 - DNA, 424 bp, Homo sapiens
  misc_feature (21)..(21): n is a, c, g, or t
  misc_feature (23)..(23): n is a, c, g, or t
  misc_feature (410)..(410): n is a, c, g, or t
tggtcctgtgtccctaggggnangggatggctgcagtctctgtggaccagcagacttagcctttcctcctggtagttctgaggaatccaggcagcccagacaagtgggttccccgcaagtgaggcactgtgttaaacaggttctgttccccatgccacccaactgggtgaggaccctccaatagaggttgtcagacaccctatacaggagtgctcctactggcatcaggctggtgccctcaaggtcagaagtcccagaagaagaagcaggcactcatctttgctgttctccagcctctttgagtgacatctccaggcacagcagcgaatcagataaataggtcctgaagtgaacccccagcaaactgcagcagccctacagaagagggacctaaccattggaaagaaaanaaacaagcagaatg

SEQ ID NO: 573050 - DNA, 162 bp, Homo sapiens
  misc_feature (108)..(108): n is a, c, g, or t
tgaaactagaggatcccctcggtctaccttgttattcggctctaccttgtcttgaccgagaggaccaggaagcacttactcagatgccgaggtggatgggtgtggatnaagaggaggaggacgaagacaggagaagacaaggtagagccgacgagacaaggt

SEQ ID NO: 573051 - DNA, 1520 bp, Homo sapiens
  misc_feature (699)..(699): n is a, c, g, or t
  misc_feature (1255)..(1255): n is a, c, g, or t
gagtgcgcattgagcggagtcatcaacaagccaggcctgataccttccctgactatggggatgtgcttcgggctgtagaggaagcgtcagctgcccgacacagactctggcctcctccacggcactagcagcatcccagcatcatggcatcaggatgccattcacgacgactgtcgggcaatcgaggcttacatggagccgcaggtcaccatcagatgctcgatctacaaacgttcggctgggcaaggctcaacgaagatgcactgataggccgaaggggtattgacacctgcagctaatcaagatcgctgtagctggggctcgcgcggcgtcgcgtatacgagaggagaacatgccggaagctgtcttgggccagtggacgtgctgggctggtgactggagggtgcattcttaccacatagtaatcgccagagtcgctcttggcaaggaccagaacaagttgaagcgagggaggcggaacgaacgagatagatacaggacgagacgcacgtcctacggacgtacacaaaccggacaaacgcatgcatatacgccaaccgtgcatgaacaaggaaggcaacgcctccgggaaacggtcccttgctcatgtgagcatatatccgttgggttggaaggagggtctcaccagtaagcctagagataactgggtccactcactcaggggtgggatgacccccnttttcagtgatcccttgcccaagaaaaggccgttgaagcgaaccaaggcaaattgacagccgtaaaatgtaaacgggaaagctgcacgccgataagagaagattgcacacgtggacaaggaggcaaaaggccacagaggacaagaggcaaggggaaacgggaaaggcggggacaatggaaataatgcaagagcaagtggtagggagaacgcggagcttgacaaggacaaatgtacgtagaaatacggaaaggggtaagcggcaactgcgcactgcgttgggggcaccaccaacagaatttgcccacgagaggaaagccgtggcttcaagggaggaacgaagtaaataagaaccttgtaagggatggaccggggtcacgttgcaaaacagaccacacaggaaaagggggaaaacaggcacaacgggcctgagcgaggttaaggcgctcaggcgttaaacacaccattggagcttggtgggaaagaatacaaggaagggtagagaaaccaccttcccatgttggatgtcccattccatcacgtataacagaggaacgntactttccccaagaatgggaaggaggaaagcgatagtctccataggggaagaacgccacatggagaaccattaagtacacccgaggtaatattcacatggtgcaacgaaacgatgcagtattgccaacagaggggaggacaaaagacacacgggagaaagaaaaacacagacgaagtggggagagcggcgcgaatagagactgggtaatcaaagacagcagctaccgcgactacaagcatgggagtcgcgggcacaacggaaaac

SEQ ID NO: 573052 - DNA, 237 bp, Homo sapiens
cgtcgggcataaaacacgtaggttagactggtcttgaactcctgactcaagtgattgtcccgccttggctcccaaagtgctgggattacaggagtgagccaccatgcttggctgcacactattatattgtgtcttgcttcctatggctcagcattgtttgtgagattcatccatgttgtgggacccgtagttcatatataggaactatatactatgtgtgattacgccgatgacggg

SEQ ID NO: 573053 - DNA, 625 bp, Homo sapiens
ctaggtggaagcgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaaaccctgactccatgttcttggccatgctagctgtagttgtcctgtgcggtatgtttcccctgttgtagaggcaaaaacatattgggcatatgtttcctaaacccaactggtagtacgactggtactctggagcgagactcctcctgagatatattatgatcagggagcgtgggaccaggaaccctaactccgtctgacacagagcaatagcatcaattacacggggcccattggaaggactccctttattgttcaccatggatacgtcactcaactgcagctgtcttgcagccaatctcaggcatgttaaggtcccatggaccactct

SEQ ID NO: 573054 - DNA, 879 bp, Homo sapiens
tataaaaaaaaaaaaaaaaaaacccaaaaaaaatattgtggccctcttgagggaagctgtgtgtgtgtgacacaaaaaaccgggtggtcatataacccctctccctctctgcggggtgaggcggagggtgagcatgtgtggtggatatttttcagaatattgtgtgggggtttgtgggagagagtgggtgtgtggtagaagtttcatacctctcatgtgtggaggatatttgtggagggagaaagacggtgagacttctctcttataacagatgtgtgtgtggagagagttaacggtgtgtggggtgagtaatttattggggcgaaattaatataaaactgttggaagacaaaaaaaaaaaaaaaaacaaaacaaaaaaaaggagggtcgggcagcgccacagagagaagaaatctcgccgaggagcggcggccacaaccaacgcaaccgagcgacctccacgcacatattataggtgtaacaaagaggtggggcccccaaaataagggcgcgacctcaaccctattaaaaagcgccgagagggctagggggagcgagccccgcgacaacaacaacgggagagaggggagcgacgagagaaaaacactgcgaccaacagaggagggaaacacatggggcgcacacgcccaccccctacatacgaaggaggagcgagcagaacacaacacaaggggcgcacaccacaacaaccacaccacgaggaaacgaagcaaaccgacagccatcacagggcgaccgcacacacacaccaacacagccccacgacggaacataaacagcgcgagagaccaacccccagaaccggcggcaacatacggaccatgcgggccggaaagaacgcggcgcgggccgcacgcg

SEQ ID NO: 573055 - DNA, 541 bp, Homo sapiens
  misc_feature (87)..(87): n is a, c, g, or t
  misc_feature (91)..(91): n is a, c, g, or t
  misc_feature (94)..(94): n is a, c, g, or t
  misc_feature (99)..(99): n is a, c, g, or t
  misc_feature (115)..(116): n is a, c, g, or t
  misc_feature (132)..(132): n is a, c, g, or t
gtatatgtcgtagatgtatcccaaggaattgttaatgcagttaaggatcctgatgccaatgggaaatcctttgctttcgttggtccnagtnggnactcnttttccacctgggaannacatctttgctgtggntcacagattgttcctcccattccccctgccgctttttgcctatcgatggggagcaaaagttttttaaataagccccttttagccctggataacaagggataaagtggagcggatgcccatcccaaacatgaaattgcctcccctgcctggcttaaaaaaccttggtattcaggcaacccccctggaactcaaggccctttaggtggtgcggcgtcatcgcccttacccctggctgtttgcttaaatttaggatgtgaaaccggccaaaaccgtcaacatttagtgcctcctgaacagcttttggttttggggttttttggggcggcccatgtggttttagcccccaaccaggcggtttttttaaaggatcctggacccagttcccctatttaaacctttcccggtttga

SEQ ID NO: 573056 - DNA, 266 bp, Homo sapiens
taatgtcctcaagggtcatccattttttttcaggtggccgggtttccttcctgtattttaccgataatgggattttccgttacatttgggtaccacacttttttcctccctcagtgaacacttggcttgcttcctcttggctattgggggtagtgttaataccgacacgggggtgcaaatttttttttgggggtttgcctttaattccttttcccccccgggtttttttttttgcaaaataacccttaaagttgtttgccttttta

SEQ ID NO: 573057 - DNA, 435 bp, Homo sapiens
tctccagtatgcaaaacattgtacttctttgatacatggcagcattttgtaccagttaataaactggtagaaaatagttggtatgcttattaaagattataatttttgtttcagaacatctcagtattaaaaaccaatagttgtcaggcgtgggggctcgtgcctgtagtcccagcactttgggaggccaaggtgggtggataacctgagttcaggagtttgtgaccagcctggccaacatggcaaaaccctgtctttactaagaatacaaaaattagctgagcatagtggtgcatgcctgtagtcccacctactgcggaggggaggctgctgaggcaggagaattgcatgaacccaggaggcagaggttgttgtgagtcaggattctgccactcactctagcctgggtgacagaatgagactctgtcttaaaaa

SEQ ID NO: 573058 - DNA, 903 bp, Homo sapiens
atttagacctcggagtaatgacgaagacagtctccaggattgtactttacttttgttgcctatcctcgttcacctatgtggatactcctgcagccgaggcttccataggcgtctttcttaccactaccagccccacttgctgtcgcttcagaggacttcgtctcatggacccgtcgtgtgctcggtcaccattggggccacaatgcctgctgcccttgtcgcctcgggcttcaggggccctcatcggcatccagactcacgcaatgtctctcaccgcttgtattacagcagtccgtggacctggctacgtaatccttgaccaatgcccattgaacgcaaaccactgtgtcatcggggtcccgaattggagtggctccgatccgtccagcacactaatgcgtgaaatatgcccagacattcggtgcttgccctgcgcctgctggagccttcatccctctctccagcagctgttgagtgcaagtctgtcattgggcagatcatgcgtgcctatctactgctgctggagggaccagaaggtgatcccacggcgaacactggccactggctaccagtattccttcccagagctaggggatgcctctaaaggaaattgtagcctacgtaggtcaaggcaagggccagaggcctgttcctgcacaggcttccaggttaggcacacgtgattaggctcagctcatctagagagactgaagccatctggcttctctagattccatctctccagtcctcgtatccacattgttctgttgcatccaccttaatgtctccaaggccgtaatctcatcacggttgggacacttaatcatctcaactgccttgtaagatttccacggttgggtttctcatacatgtccggcagtaaccccaggggtcctggacagc

SEQ ID NO: 573059 - DNA, 1205 bp, Homo sapiens
ggtcacatatatgatacctctctggatcattttatattctcttcattttggttatctcatttgtgccttcccatactagccccttttcattctttttcaattttacattcattattcattcattttggctattcaagtttcttgtaatttcatggttggggctttaaacaatgtttcatttctacccaggcacaaatggcacaggcagcaggcaacaggtcatgcatcaggcacccagtgtgcatggttgttcacttattcaacagcaacctcttggaagcttatcagttatatcatgcaaccaaagcattccattttccagcgacaccaatccacaccggtccaagttgtgtgttaacacaaaattgaagcaaacacacaatactctttccagtcacgtgggttccgtcaatttgggactacaagtcatgggctcccaagtgtacaatcattccaggtgttagggtcacatgggggttctagacagggtaattcacccaggaaacaccaagacaggctgtttgtacaagccagaaacattcaagtggacccattttcttcattgtgattaggggagcctcataagcggggtggttggaaacatcacaaggtccgtttcaagagaacgcctaaattagcatttgttcattgtgttgcaccacttgggtgacccccaagaaagtccttaagccaattaactggggttgcacaaatggcttttacacagagcagagactggccaaggacaggttccgttttcacgttacatttcgtcattccaaggccatcggttggcaaagcaaacaacaatttggcccaagaacacaaaagaggaaccttacacatttccaatttctcattgggttaggtccctgtgggaatgcacgcgaagttaccttgttaccacaaaggtccaggttgtcgggggcctcacaaaatggtggggtaatacgagctcgcgtacacttggggggcaaacaccaacacttttgtgtggacatcacagattaacccaggttcggcaatgggagcttacgaaccccaaactatttgaccatttcccaatgggtgggacaatgtgttcaacaatacaaggttccatgtgaagagacaaaccacggaaaacatcttggcgacaggtttggacacccctgccgacacagagagggcaccaccagagtttggtacacacgcacacaactaga

SEQ ID NO: 573060 - DNA, 269 bp, Homo sapiens
tatagtaactacgtatctttaatatataaataaataaataaacgatgatcatctagacatggacttattatttaaaactaaaaaaatagagctatgaaatcatcgaaaagacatggagaaacctaaacttactaagtgaacgccaccaatctgcaagggctacatattgtgtgattccattatatataacattctggaaccaggaaaaactatggagacagccaaaagattaggggttgccaggagttagaggggagcgagggatgaat

SEQ ID NO: 573061 - DNA, 166 bp, Homo sapiens
gttgcagaagcaatgtgtgcagtgattgtctttggggatatttagcatttgcacattccctggaagaaaatataaaataaacacatgtccagaactgaacatgctgggagataaatgatgagcacttagaacacaaagaaggaaacagacactgggctatacatga

SEQ ID NO: 573062 - DNA, 1475 bp, Homo sapiens
ggggtaaattgtaggaggacgttagacgtcatgagtgaaacaaacaacgagttcttagcagctctcgaaagcgcagcagatcaaattaaggtgggagatgtcgttaccggtgagcttttagctattgataatgataaccaagcagttgttggtttgtctaccggtgaagaaggagttgtgccagcacgtgagtactcagacgatcgtaacatcaacctggcagacgaattaaaaattggtgataccattgaagcagttgtcatttctaacgtaacaagcgacaaggaaggcgtagttacttgttgtcaaagaagcgtttggatgcgcgcaaggcatgggaaaacttgagctttgctgaaggtgacacagttgatgccaaggttatcaacgctgttcgtggtggtttgattgttgatgttaacggcgtacgtggtttcgtaccagcatcaatggttgcagaacgtttcgtttctgatttgaaccaattcaagaataaggatattaaagcacaagttatcgaaattgaccctgctaatgcacgtttgattttgtcacgtaaggctgttgctgcacaagaacgcgctgcacagttggctgaagtatttagcaagttgtcagttggtgaagttgttgaaggaactgttgcccgtttgacagacttcggcgcattcgttgacttgggtggtgttgatggtttggttcacgtatcagaaatctcacacgatcgtgtgaagaacccggccgatgtattgacaaagggtgacaaggttgatgttaagatcttggcattggacactgaaaagggtcgtatctcattgtcaatcaaagcaacacaacgtggaccttgggacgaagctgcagatcaaatcgctgcaggttcagtgcttgaaggtactgttaagcgtgtgaaggactttggtgcctttgttgaaattttgcctggtatcgaaggtcttgtgcacgtgtcacaaatttcaaacaagcgtattgaaaacccatcagaagttttgaagtctggtgacaaggtacaagtgaaggtattggacattaagccagccgaagaacgtatttcattgtcaatgaaggctttggaagaaaagccagaacgtgaagatcgtcgtggtaacgatggttcagcttcacgtgctgatatcgctgcttacaagcaacaagatgactcagccgcaacattgggtgacatctttggtgataagttgtaagaggcatcaacataaaagagctggttcgccagttcttttatttttgaagaaaaattgagtgggcattagtgggcgctcacggtatgaaaaaggaggtgcgattatggcagcaccagtagtagccattgttggcgaccaaacgtcggaaaatcgactatctttaaccggatggccggagaacgtattgcaattgttgaagatcaaccaggggtaacacgcgatcgtttgtacgcgccagccgaatggttgaattat

SEQ ID NO: 573063 - DNA, 711 bp, Homo sapiens
ctatcgcttcgccgcagacggatgctggcgtcatgttacagtgacccactgtgtccatcaacaaggtcccctatgaggcatcatccctggagtcagtggactgcagatgcctaaagagaagatcgtcatgcacatgtagagaacaactgcacctgagatagaggtacctcttagagagcgcttctgacttgtagatgctcaagattggggatgtctctagatgccctgaagtccacctgcgtagttcttattcaatcttaggggaacgttagcgaaaccgctttgacagacccgcctgagcctaatttaagatgatctattatcaagcctagaatagtgagctactgtgtgttcacttctcaacaccaattgaggctggaaaaccccactgacccgtgcaccaccatcataattggctatcaacttaaccctttccacaagacacacacacagtagttgattatcacatagagtcaatcccttcctccaaagaggagcgtattctcctcatctgtgcgaagtacctaaggagaaacaatgtcctgtggtttagtgggtaactcatcttttgccccatgaggatgacaaccttactcaccctacgtacccaaatccctaataacaatcagtccccagccgacacgcagactcaccacacaatatcattaatctaacgccatcaaagaaaactccaaatctctaacaaacgag

SEQ ID NO: 573064 - DNA, 692 bp, Homo sapiens
gggccggtccggggcccccgcggagcggcgaggtcgaacctcgggtcaaggagagccgctccccggccaaggaggaggccgccaagatgcccgcgcgcgcatccccgccccacagcaaggcggcccctgtgagacgtgaaggtcaatggagtgagctgctggtggaggacgatggcctcctgatgccccctggctgggctggcgtgcaccccgttgcccctgcagctcaggcctgggccgcgagcgcctgggcgcgcctgggcttcgctgtgtggagcctttttccagcgagaccttggaagcttgcccaccggtcgacggccctttcgcccgatagtgcaagaacccaacacggacacagagagaaacgaacaagaacacatacataagtagaacacaacgacagagaagcgagccacaacataaacaagaaacacagaaaaagcacaaacgaagaaaaaataaaaaagaacgagaaagcagcagcaagaacagcagggagagacaggcacagaacaagcgacgccagccaggacagccacgaaaaagccaaacacgcaacaggagagaaaacagcacaagaagagaacgaggaagacgacaaaaaaaccaccaaccacaagaagaaaaaaaacagaaaaaagaccaacgacgacaccaacaagaaccaaacaacgacagcagacaagaaa

SEQ ID NO: 573065 - DNA, 257 bp, Homo sapiens
  misc_feature (15)..(15): n is a, c, g, or t
tgatgccgaggttanctagaggatcccaatcgacgatcaaggtagatcgagatcaagtacggcctattctgcttaccattttaacctagatgtcattctcactcagcaagttctaagtcaaattatgtcactctactgcttaaaatacctactcctcagaataaaatgctctggcgagaaattcttaaaagacccagctcccttctatctttccagactcatttatttctctctcctcttcctttatcacattctgg

SEQ ID NO: 573066 - DNA, 221 bp, Homo sapiens
  misc_feature (50)..(50): n is a, c, g, or t
ccccccctttttggggggggggggggggggtttcttcccttttggaaaantttcccggaaaaaaaaattttacttttttgaaattggggggggtttttttttccccaaattggggggggggggggccccggggccttttttgggggggggggggggggggggaaaaattttttttttttggggggggggcttcccgatttaaattttttttggttttttta

SEQ ID NO: 573067 - DNA, 548 bp, Homo sapiens
  misc_feature (470)..(470): n is a, c, g, or t
ccgtcccctttcgaggaaacctgagtgtggtagagaggggagtgctgcgatggtgctccatcatcgagtccggggccagagggcaggctttagaccattttcaaatgaatctgtgttcttttctttctttgttgtgttttctttattttttttagtatgctggggggtggggacgttggctcagtggatctccccagtgctgggagaatgctgtagcggcgtattgctcatgctctaagtggatgccttctcgcctctcctagtggtgtctcgacacaatccttcctcgtgtcttgtggccctcctggacgttgggcggggctacgggggcttcttgtgccctgcattgctcgcggagcacttattgtgggtggttcgtaggataggacagcggtggttgtaggctcagtgtatgtggtccaggacgtggtccttggcatctcgcgggattcctcggggtgtattcttcntcgcgtccctctcggtaccttctcacaattgtgtgcttgggggcagttgtttggggtgttgtgcagcccctcgtggtg

SEQ ID NO: 573068 - DNA, 990 bp, Homo sapiens
ggttacttccatcatgtggagataactcaggaatcactcccttggatactaaatcatggaagcattatactgacatcagaatcgtagtattgacagacaggataaataatcaccacgtgtcctgtacggatatcagaggtcccgtactactggctcgcggagtctccccttgatgggggattgagactactagcaatgacaacattctgcgtgcttgtcagtggagtagtttatttgactttagttggttgtatatccggaatcacgttgagagtatcatggtgtcttacatcatcttcgaacttagatatgctggattctagtgaagaccaacatgacttctgtccactctactagtgcacagaagcactccgcgatttgtaaggatatcgtatttgatcactcgtttaatgaacaagagactctaattgacaaaactttgataagtgccatgtattctgacatacgcctagatacgagtataaaactacgagaactcagaagatgtgtaccactatctccaatggaattgtgcctgttcatattaaatagggtgggtcctctagagtgcataacgttatagtccccttgatacgtaaacatcctcgtcccatagccacgtttaaatgtgaatctaattccatattggggagaaaaagtctcaaccagctgaatagcgaggattctagcccgcgcagacatagggaaagtcgtctcccacagtccgcagtattgtcgatgtattgaacaaaacttcaaggctcgcttcaatggaagctaacactctcatctaaacactggggggtgagtaagcaagtgattgaggagcaccactgtaggaccgctggcatcaggtgagcattgaaaaagaaaccagggaggttctgaccacaaaggaagcatttcggcacaggagaaccgagaatcctcacagtattggtccaggaatcgggcagaattcttcccggaaaaagtctgggaaaggaaacg

SEQ ID NO: 573069 - DNA, 143 bp, Homo sapiens
ccaaaaaggttggggcccgcttttggaaaagttggaaaaggcaaaaaaacgcattttttccctcagcctttggaaggaaccagccctgtgggactaatttacaaactgtagggtaataaatttgtgttgtttcgaccccctta

SEQ ID NO: 573070 - DNA, 99 bp, Homo sapiens
tcacaagtaccggatttaacttcatactggcgggaaaaggcacggaagaggcaggaaaaacagtcttgaatcactggatgctggcccctaccctcttcc

SEQ ID NO: 573071 - DNA, 1465 bp, Homo sapiens
  misc_feature (916)..(916): n is a, c, g, or t
  misc_feature (949)..(949): n is a, c, g, or t
  misc_feature (985)..(985): n is a, c, g, or t
  misc_feature (1000)..(1000): n is a, c, g, or t
  misc_feature (1008)..(1008): n is a, c, g, or t
cgcaagtagtgtttatataggccgtgtggcatatgtgccctcctatatctcccctggagaagtcccctgtgcttcccgagagcccctactaaaaggtggccctcgtgaagaaaaacggggccatctacgtgggaggatttattcccattttcccaagttttcacaggaggtaccccctcctgggacatacaacatttgggaaaaacctctttttttagaggcccgtcgctttctttcactaaaggggcgccacacacacttgtgcataggggcaggggtggtgaaaaaaaaaaagtttcgagaaagggtatatgtcgtcaatttttataaaaagagtgttgcgttgtgggtaatttattcctggggggtgttaaaaaaaagaaatagggttttggttacagcaccattttcacgagaaatggggggagaagattttgtgtcgcggcccccctgggtttttgccttcagagttttacttcttgggggcgcgttaatatttctcctcgggttaaaaattcgatgtagaccttcccccaaattaagggccccatccacatggaaaaaagagtttcacaaaaagagccgcgcagagatgggccccccaatagtttaaaagcattgggttgggttttaaaagggcccccagagggcgcctccttcccccaaaccccccagttggggcccccacatggacactttgccctgtgggtggagcacccctgggggggcacaagtgtcgacctctgtagaactctatataaagagtggccccctcctacgatgtgtttcccgctctgtctcgtgtttaaaaatatggggcggatataatatagatatatctcgggagcctctactctctcgacaaggaggggcgcgagatatttttggtaggggctataggaccttaaatggcctntctgtttagggagaaaagccacattcttgtggnagatctcttctcacgcaccacacaggagaatttctntctacacagagaccnctgagagntatattctgtttttatataaataataggagaatgggtctcaccccacatgagaacctgtgagataactggtccgcgtggtggtcccacagagatggcgtggtcacatatatggtcataatatatggttcttctcacacgagaaacttgagaatgagaatccacattggaggaaaagccggcgtggagatataactatgccacgagcacacaaatttgaggagaataacaatataacaacacgcacttgccaccgggaaacacatacacgaggagagccttttctgtgagattgggtgggagattttttccctcttttaatgtgggagataataagtagttaacttgtgaacacagagataaattttggagataaatttctattaatatcaactctgaagctaattgtactaatctcgagattgtgtttgttcataataaaagtgaagtgaattctga

SEQ ID NO: 573072 - DNA, 528 bp, Homo sapiens
ggctttcataggttctatcacacacgtgcggatgtaaattgttttgcatcatgcgactagcttattaattggctgaagccctatgaatgagataggctcctcttctctggtgacaatggggtaatttatcaacacaccccgattcaggggagtctggagtttaaggtttacggaaggtgcaactaggagagggtgctgatttatcctcccgacgacaagtgcgaaaagccgaacactgtttttacgtacaaattctcacaaaaataatagagaggtaatatagtcacctggctagtacgaaaactcattggaaaccaacttccatgccttcaccggtccaagcattaccaaaatacgtatccgcccctcttttggactaggttccctacataaagatttatactcttatttggaggcggaacaacgaagaggtgttcccccttgtccgcaaatggcggggaaaacagggccttttgatgcgggggcgaagggtatcttttttacaaaagaagggtaccctggtgcccc

SEQ ID NO: 573073 - DNA, 562 bp, Homo sapiens
  misc_feature (556)..(556): n is a, c, g, or t
ggagagggggtctcaaaatcgtgagaaattttgggtcaagtggtttccatgaagaagtactggatttgaaaaattaataacttagaactgccacgaggcaaaaaagataagccaaaggggtccacaaaacattctcgtttcgttctgaaggttgtacgatgcatggttatcattaaccagtctttgactactaaacttaaatggccaatggaaacaaacagttctgagaccgttcttccaccactgataaagagtgggggggcaggtataagggataatatgcatttagccttctgagctttctgggcagactgggtgacctggccagctccagcagccttctggtccacggtttggatgacacccacggaaatggccggtctcatatcacgaacggcaaggcgacccaaagggggatagtcggagaagctctcaagacacatgtgggcttggcaggaaccatatcaagaagggcagcatcaccagacttcgagaatttagggacatcttccagctttttaccagaagggcgatcaatctcttccttcagttcagnaaagtt

SEQ ID NO: 573074 - DNA, 166 bp, Homo sapiens
gatcccttgagtgtcactgtcgagcagctgggattataggtgtgtgccacacacccagctaatttttatgttttagtaaagaacaggttcatcatgtggcaggctgtcttgactcctgactcaagtgatccgccacctcggctcccaaagtgctgggatacaggcg

SEQ ID NO: 573075 - DNA, 131 bp, Homo sapiens
gataagcggtgaggggcctgaatgacaacttcattctcaaagaggagcaagtgtggacagttttccaagcagcggtcacccaatgtcactgttcttcaagatgaagcatcggagccatgatcacattgtta

SEQ ID NO: 573076 - DNA, 335 bp, Homo sapiens
  misc_feature (252)..(252): n is a, c, g, or t
  misc_feature (298)..(298): n is a, c, g, or t
  misc_feature (319)..(319): n is a, c, g, or t
  misc_feature (327)..(327): n is a, c, g, or t
gtatagtcacagaattgtgcaacaatcaccagtatctaattctagaacattttcatcaccctaaaaagaaatcctgtacccattagtagtcactccctgtttcccctactccctcccaaccactagtgtactttctgtctctatgaatttgcctagtctggacatttcataaaaatgggaatcataatatgggcacagcctttttttgtctgggctttttttcacttaggcataatgtttgccttctcaagnggttacccatattgtaggcattgtggtcaatatttcttttaatgtnatggtaattaccaatggtaantggtaatnagggggta

SEQ ID NO: 573077 - DNA, 269 bp, Homo sapiens
ggacgagaatgcagtgtgtgagggatgcttctttaccattgccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaa

SEQ ID NO: 573078 - DNA, 412 bp, Homo sapiens
taggggcatgcggatgaggggcatgcaggcggattaggggcaggcagacgaggggcagtgcagtacagtgcatgcaggagacaggcatgcccatgagttggccagctgcctgcgaaatagcatgggcaggaagagaggtgagtaaggtgacaggaagtggaggcagctaggaagggaacacagggaggatgctggagggaagggagtgacatgttatccgtctcgcagtctggtgctgtcctaacctcacctggcatgagtccccccggtagctagcggggcacaggcacagctccacattgctggccagggccccctggcctgctgggctggccacctccagtgccatcctgcgcatggagacagccgaggagatctgtgagaagagggcacggatctgcagctgctccag

SEQ ID NO: 573079 - DNA, 604 bp, Homo sapiens
  misc_feature (221)..(221): n is a, c, g, or t
  misc_feature (226)..(226): n is a, c, g, or t
  misc_feature (251)..(251): n is a, c, g, or t
gacctgcctcctgcctgcccctctcccgcccagactgttagtaaatggacattgtgcccagcccggaccttgcaacccaggccggggtggagcatgggcctggccacctctctccttttgtgaggcctccaggtttaggcaggacaaggccttttccttcccacccgccctccccacggggcctcgggacctcaggtggccccagttcaattttccgctgntggtngtgggcccttaccttccccagggtnccagtttttggcagttttggaatggaagggttttggctgcccccaccttcttaagggcaaaggtggagggtggggggcgcttagtagggactcagggccatgcctgcccccctcatttcattcaaacccccccctagtttccctgaaggaacattccttagtttcaaggggtagcatccctgaggagccaggccgggccgaatcccctccctgtcaaaactgtcactttgggggccctcgctgcttttgtgtgtggtgagcaaaagtggagctggggggggtggaaagcccggggcccctgccccctccctgacccgtttaatatataaatataaagatgtgtttatgggtga

SEQ ID NO: 573080 - DNA, 374 bp, Homo sapiens
  misc_feature (2)..(2): n is a, c, g, or t
  misc_feature (9)..(9): n is a, c, g, or t
tngaggtancatctcttccatgccttcttctttctctttccggtgcgaactaactttaaatacttcggttctcccggggcacgtactttaggcagagggacttcccattttcccgccttctcttttcttttctgtttaatcatatgggaaagtactttagctcgagatggtccctctcggtccagcagataggcaggtacggctcccgggggtgtcttttcatcattctttggttgggggtgtctcttttcatgcatctggatagtcttttccattggtattttctcagcatgacgctgtttatggtaaagcttagccttcagaccaatcattttcttggccttcttggaacgttcatgactaaaggtgctgaa

SEQ ID NO: 573081 - DNA, 760 bp, Homo sapiens
caggcttggtacgcgcctgaatttattggatcgttgggcggggtgcggcggtcctgagcggctgcggcagcggaatttttgtcccgggtcgctgcagtgacggggtgctggcgcatcgggtgcgtgaggcggccgtgtgcctgcctggtgcagaatgtcacgatggacgatggcgtgacgcccctgatccccgacagcctggccataccagatcttcctgagcctgggcccggcctgacgtgctgtgccgccggagctggtgtgccgccaatggcaggccgtgtcagcgggacgagttcctgtggagtggagcagttcataccgatacataccaggtggacccgagaagtgcccacgaaaacccagcggaccatgtccatggatacggacggaggtaccagcggactgtaattgacaagggtgcaccatgcggatggaggtgcaagaagactgcgggaaacacacagaccagagtacatgaaccatcagacttcgtcccatatccgggtaccaagatatcgcagtcccatgcatcccaaagagaagatggagaagtgatgaaaggaaatcgatgagagggcgagaacagaagacttggaaacaaataaattaaggcgttgcattataaacaagaggggcagggaacaagttgagggagacccgtaaagagagaaatgggaagcataagagcaacaagaaaagacaccgtgaaattacaaagtaagggaagaaaaatataaaaacatgggattggacgata

SEQ ID NO: 573082 - DNA, 1076 bp, Homo sapiens
  misc_feature (643)..(643): n is a, c, g, or t
  misc_feature (661)..(661): n is a, c, g, or t
  misc_feature (664)..(664): n is a, c, g, or t
  misc_feature (667)..(667): n is a, c, g, or t
ccgtcgcagagctttcgccactggcccggggccccaagaagcacttaaacgcgctgttgcacgcgccgaagcattggactgcttgacaaactaacgggtgctactttgcacctcgctccactcgacaggtccccacaacgctgacgggaactgctcttccctcctgcactcgcctccttcctcagcgcaactacgacctcaacgctactgcgcttgcacctgcgacgcactgacggctacacacgcaagactactgctatgcaacgctttcactcaaaattgactggcaaggttcgagctggcatgtcacatacccctgctggacttcactggcactgctcatcagccactcgacgaacgacaggctgcaacatttccgcctggctctatgacaccaagggccgcttttgcctgttcaccgcatcacagctggacagaggcaaagctacaagttgtgcaaagtgaggacacgattactgctgggacgtgaagggaatccctcacctggtgactcatgatgctcgaaccatccgctacccagatcctgtcatcaaggtgaacgatactgtgcagatagattctagggactggcaagataatcaactttatcaaatttgatacaggccattggtgtatggtgatnggtggagccaacctcggncgngtnggtgtgatcaccaacagggaaagacatcctggttcttccgactgtgcgtgcatgtgacggatggccaatggccaacagcttgccacgaggcttccaacatcccggtccttggccactgtagacttaccctctccttacttcttctacaagactatccttaaaaagcctaaagaccgcatccactaacacaaccaacaactcgacgactatcggcggcgcgcaccggccctcaagggccggtccacccgtcccgaccgctccttccacggcccatcgcgcccatagggacctaaacgaagggaccacccccccaaccccccaccccccaccccccccaccaccaacacacacccaccccccgcccacacccccacccaaccccccacacacaccccaccccacccccccc

SEQ ID NO: 573083 - DNA, 731 bp, Homo sapiens
atcggggctcgtgggcgacgcgggctgttggtcgcctcggcttgcattctgtggggcactgattcacggccggcctcgtgctcgaagttgatctgcgtcagggaatcgtacgtgcgttgttgctcgatttgctggtctgtggttggtccctgtgcagtgaatggatggggttcaacctgagctccacccttcctcagggaataagcagtgtgagaccccgtatatccactggctgtcttgcgatctccgcgggtgtccctcgagactcctatggtctatcgcgcggtccccgtgcaggtgtgggcctccgtcggccccctggtcccaggctcttggtggtgctactccttgctcgggtacgacttcttggcggccacgccccgcttgcctgctgtaagactccagtgggggtgggacggtgcatggctgtccccaaccggtcggtcagaggccatggccagtgccttggggctgtgaacttacccatgcacaaggtgtttaggggacatgaagagacgccttccctccagggaggtctgcgattcctcatctggaggcactaccattgtcttgttcatggccccctttccctgcccgtctggaagtttatgctccacaacataaagcgagcccaccaataggcccctccaatagtgcccttcctccacaattctccgtcccccaggaccaagggggattttcactcacttcccacctgggggaatggctcc

SEQ ID NO: 573084 - DNA, 244 bp, Homo sapiens
  misc_feature (2)..(2): n is a, c, g, or t
  misc_feature (41)..(41): n is a, c, g, or t
  misc_feature (216)..(218): n is a, c, g, or t
anaatgaagattgccgaatgcatgggtgctgaggcgggcanaaccggtttgcatggttcctatagctatggcggtaatcccaacctgagggcaaagcgcatcgtggcgatacccaatgatgtcgatgtcgaggtgggcgattgggttgaggtcagcatcaccgactgccgtctggcgcttaaaaaataaactctggaagcaaaggcccttgagtcnnnacatccttccttcctctctgcgttag

SEQ ID NO: 573085 - DNA, 1117 bp, Homo sapiens
  misc_feature (3)..(4): n is a, c, g, or t
  misc_feature (142)..(142): n is a, c, g, or t
  misc_feature (155)..(155): n is a, c, g, or t
  misc_feature (168)..(169): n is a, c, g, or t
  misc_feature (176)..(176): n is a, c, g, or t
ctnnagatggcggctgtgccttagagagagcgcgctctgctccctgcctttgcctcactttacgcaactttccctaactttcgggcagcctcagggggcccccgtagccccctgcctttcctagggacttactggggtcgantcgaacctttttntgggagaaaagcnncttttangagctattcattattcgtgccattgtatggaaaagaagcaagcctgtactgagagcccagtgtcgtttgtattattccagcttaggaatgccatggcagcaacatccagttatatgtgcgctctcctaatgaggattatcaaatcatatacggacctgtaattagatattaacttattgctttattttatatgaccagattaacatatttgaggagtcataatatttatttatacgataaaaataacaggaggatttgtgccttcattattaattactcttgggatctgatacttttctctactagtagactaggactcttggatcttggacaatacatacatgggatcagtaaatacctgtgccacaggactacaaagacaaacacagatacaccacctccccgcttactatccaagacttacaagatgaggagacaatccggcacacacagccaagacggagcacagttaggctacacaagcaatgcatcgaagtcacccagcctctgaacaacagcttcagggggaccagaccaccagggacagaacaggccgacaacgtgcacgcacctggaccgtgcaccccagcgacagtgagcattggcagcgaagtccgacacgacagtctcgcagcccgcagcagcacgccgggaacacgagcaggaacaacgagggccagaagccagcaagccccccagaagaccaaggagagacaggcctaacaaagacagggtaaagtggagacagtgtccaatagctgcggctagggagtagtggggcacaggaggaaaaccgcggggtgatgacagcggacgatagggaaggggacaaagcgagaaagcgcacagagcgccatgaccaggccagggacaagaaagtgagcaagcacggcggagacacgcgccgtacgcactagcgcgtacgacgacgcgtcgcagag

SEQ ID NO: 573086 - DNA, 1786 bp, Homo sapiens
tggtggcgcatgtctgtaatcccagctactcgggaagctgaggcaggagaatcgcttgaacccaggaagcggaggttgcagtgagccgagatcgcgccactgcactccaacctgggcaacaatacaagactccatctgaaaaaaaaaagatcacacaggaaaacagaagttcgattttacgtcgtacactgctgtaatttcagcacatgtggactcgtgtaaccaacaccataaccttccatcacccctgaaactccctcccgccagccctttagggttgcccctccccccgaaccccaccagcccctggtgaccactgatctgtcctccaacccatagtgtttttccgggaatgtcacaaaaacagaagccgaccatgggtcacctttctggcgcctttctccccgcacaaagtctttgtccttgtgaagttgtcacgtgccaaacgcttgtccctttttcctgctgggtaatactcccggtgccgcccttgctgttcgtcgatgcacatctggctgcttttcgctggctgcgagcggagctgctagggacatggccacggggctgtgagagcggagtttcctctctccggtgaccctgagctgcgcctttctcagccgcctcccgaggccccaggcgctctgcgggggctctggcggggttggtgggggtgggcgttctcgttgtttcagcggcgctgccccaggccctgcgggagggaccgtgggacccgagacatccccgcctggcctccgctccccacccgggagtggggctcgcacccccccaagctcgggtaaagacgcttctggaaggaagggcgccccgcggaccccgcccaaccctgcccagcccagcccagcccagcccagcccttcccggggcggcggcgcgggaagcaggcggcggcgcacgggcgtcgtcatggcaaccccaccggctccgggggccgggaccgctgccccctccgcccctcgacccccgcccccccgcccttcctggctgcggctggacccggctgcgcggggcgcgaggctgcctttcccgggatcaccagggaccacccggcgcgctccccgggaatccgcacccctggccccagcgctccggagcgacccgggtcagcccctggctgcctgcaatgggcccccgggcgaaccccgggcggacccaggagtgagcacccggtgcgcggcaacgatgatcccgcaagggaagctcacgggaggcaggagctgtggcagccgccccaggatggggcgcggggagcgcgctgagctgtcctttcccgcagcggccccgcggttgaagcgtgggcttgggttttggtttttcttctgtggcaacagttctgttgagatattactcgcctgccatacaactcacccattttaaaagtacacctcaggggtcctgcgtgtattgacaaacccgccgccgtcaccacagccaatttcagaacattttcatctcttcaaaagaaaccctgtacccttcagctgtcaccctcctggtccccatccggtcctcgtcccgccctcagcagccacgcactgcctgtaaagtcccctgtcctgccctgtaggtggaatctataccttggggtctgttctgacgttcacctaacagcctttccaggctcagctgtgctattgtatggaccagggggttgttttgtttttgttgtttgttgattgtgtgtgtgtgtgtgtgtgtgtgtgtgagcctggcgtggttgcgggcgcctataatcccagctgctcaggaggctgaggcaggaggatca

SEQ ID NO: 573087 - DNA, 219 bp, Homo sapiens
gggccccccaattttttttcccccccgggaaaaagggggagggggtttttttaaaacctcctcccctttaggggaaaaaaaaagggaggggtttttttaaaaaggccggggggggccttaatttttttggggccccttttaattggaacttgccttttaagggggggggtttttaatttgcccccggggggagggaaaaaaaaaaccctttttttttta

SEQ ID NO: 573088 - DNA, 618 bp, Homo sapiens
  misc_feature (3)..(4): n is a, c, g, or t
  misc_feature (142)..(142): n is a, c, g, or t
  misc_feature (155)..(155): n is a, c, g, or t
  misc_feature (168)..(169): n is a, c, g, or t
  misc_feature (176)..(176): n is a, c, g, or t
ctnnagatggcggctgtgccttagagagagcgcgctctgctccctgcctttgcctcactttacgcaactttccctaactttcgggcagcctcagggggcccccgtagccccctgcctttcctagggacttactggggtcgantcgaacctttttntgggagaaaagcnncttttangagcgctcttttcgtgccctgttggaaagaaaaccacccgctctgagagcccgaggcggtgttttcccacttaagacccagggcccaccattttgtgcgctctcctaaagaggggtttttctttttgacccgtgtagaagtaataatcgccgtattattttgaccaccttacatatttgagggtgattatagatataaatcgcgctttaacgcaggattatggcgctatttttaataatttgggagctgagatttttctactagtagataggactcttgggttggacatactacatggatcacgtaaggtcacgaacattggtgataattttgaagagttatttgcttaagattgccctcgtttttgttgatccgccaaaaactttgagggacgcctcaggtacacagcatgtgtcttgtatctagtgtgctacttttatga

SEQ ID NO: 573089 - DNA, 731 bp, Homo sapiens
  misc_feature (331)..(331): n is a, c, g, or t
gagggtcggtcggctttgtctggtgtgagcttgtctgtgtccctgctgagggtggacgtggttggtggattggcggatggtatcctggttatcctgctaatagagtcaaaagatttgcagaatcttcgtctgatatagacccgcttacctggcatagatccattcagcaccttgaaggatggatgccctaggatgtacactctagtcgaaaaaatgctgaaggccagagaatccgagggactataagagaaatgctaacttccgcgcccagattccaagggatatgcgccatcagtccttttgcctggcacatcagcttggaaagatgttngccggcttcttcttttcatgacatactaatgtctcagtaaggaagtcacgaacccctggcacctgcgttcctggtcgttactgtaggaggatggtttatgacaagtagttcctttgctgtcgaaaggtagtctcatggatgctggtaaggaaacaaatacaacgcctcttggcactgtttgggagtccccgatgtgatcgacactaatctgaaaaaagtgttgaattggccaaatgatccccacgggatttaaaaaagaatggcctttcgctatccccggaaatcgaagctaaggaagggctcaatccttttggcgagagacaaatggcgacggcctagggatagaatagagcccgcaatcttcctttattcctggatttttagcaaacaatctcaagga

SEQ ID NO: 573090 - DNA, 171 bp, Homo sapiens
gatcactgccttgcacccagcacaatgaagatcaacgatcattgctcctcctgagcgcaagtacgtccgtcgtcgagtcggcggcgtccagtccgtcgccgtcgcgtggtccaccgtttccagcacgagtggtcgagtcagcaacgcacggacggtagttacggaggtccc

SEQ ID NO: 573091 - DNA, 958 bp, Homo sapiens
ggcggacgctgcgggaggcccgggagcggagtggaaccgatcccagaactccggacgtgtgcgggtgagtcgcagccatgtccctggttaactcgttcttgaaggggctggcgcgcgtgcgggcgtgccgtgagtggaagtgctgggcggccctggtgtgggggccctgtgggaaactgtgctggggaggcctgatcagcggggccgggggccgggggcggcagcagggcagtccggcgggcagccggttggttggaaggcggcggctggccggatgggaacgggacatgccgcatcctaaggcgggacgctcatcaggccgccatcaaggcgaagacgggttggcgcaggtaacaaaaagtcgggatgccccccggcctcccgcacgacaaaaactatttacgctttcccaatctgttgggaggggccaacggagacgtgacgggaggggccggacaagtttcgcggagaaacttcttgtggccccaggctggcttgggcagactggaccctggcagggtcaagcgcccagagaaatcttcatgacgccttttctcaattaaggtggtgacccaggaaaccgccttgcattctgaagcgactgcgttgttggggacattggaccacaattgtcggcaggtcatgggtgccgggattgattacgcgcaaccacagggccaagcggggctttggaggacatccaaagttactggtggacaacccttcacaagctgcaggccatatacaaagcagtttcgacacttggaccgatcgggacctttggcaggaggagaccccagggtgccttgagcacgcagggttcccctgtgaggagcttctcaaagagatcaccggcgcatcgataaggggacctgcttgaacccaccaacgtggcgcgcgaccaggcggccaaacttgacagccgggcacccggcacaccgcgggcgcagttataggc

SEQ ID NO: 573092 - DNA, 879 bp, Homo sapiens
  misc_feature (38)..(38): n is a, c, g, or t
  misc_feature (40)..(40): n is a, c, g, or t
  misc_feature (43)..(43): n is a, c, g, or t
  misc_feature (258)..(258): n is a, c, g, or t
  misc_feature (292)..(292): n is a, c, g, or t
ggcccccgcggccggccgagctccgtggactccgcagncnggnccccgcccctcacactacgccgggcggttccctccgagccccgccgggacagcgtcgacgctgcacacaccccagagaagccagaggacggcgcctgcaccggacacagcgcaacaccggcacagcacagcgtccacaccacaagtgagcctagggagctgtgtctacactgcagacgccggcctgagcgcacgcttcttcatgcaggctcagcngagggggaagaacacctccccgagggtggaaganctgtggccagcagacagatggacggacagacggacacaggcgaacaggcagcgcaggggtgagccgagccggtcaaatgggccaggacccggctccgtgtgcccttcacagtcaggatgacagaaccccgtggaatatgaaaaatgccgggagacagaccccggaggcacagcccctcaccgggcagggaggccgccagagggaagcgcactccagaccaccagagccccatctgattaaggcatcgagatcaaagctcagcagagggcggctcatgatgggcagctcaaaaaaataaacccaccaatcagagtccgtgttcctgtgaccggtggcgggttcggatgcagaggaggcttctcagtgcggttcctcctcatctcggaacctgccaccccactcaagcccgacataggccaggacagccaggacggccgcagcgagggcaacacgaggcccgtcgacatcctgaggccccgggcctgtcgccgagtcccggcttggggagtgtcccgggccacactggtcctgctccggctgtgtggtctcccaggcgcgtggctctccctccgggcccaggctctggt

SEQ ID NO: 573093 - DNA, 1184 bp, Homo sapiens
ccggacgctctcaggctctcgggcgcacggatccaggtcggatcgaggccctgtatgagaaatacaatatgtgggccatagaactactgaacatggagttgcaagacattgtaagggcctggatttgccgcaaatcctcgtgcaaagatgcttcaatgccaaagtagactatctatatcgtgtccgtgcgcgagtctcatttcctagcccagcttcgctagactcccgagattgcgagggatagccaagactagcagtatgcagtgctgattgacgacgccatgacaagtcctggctaagcaaggtcatgtatgggtagctaaaacaagatattagattccagaatcagtgccaccatgatgaggacaagcttaggaggtcaagtagcttcgtcgcttgtccgctcccttgtctccacgatttccgtattctgacgagtctagctgtgtgctctgacactatcccagaggcatatatccttggcgtggaatcgatgtgtgtgcccgtggctcgactcgattcagtattaactcaaagatcacataggagacctacaggagaacagatatatgcatgcattttacaaagagaggctgacgctgtgcaacaactgatctaccttgtatctacgacaaatcgcgtgtagcagagcatcagcttgcgagggctgatctattctgatacctcaccaaggatgcgatacgtgggatcgtgtcaaaagcctactactaacttagatgctggaagcgggatgcgtttgaacatggaaagagccatcaatgagcaaaggtgtggcatgaggtcaccagtgtccacatcttgaccaaacggaagccacatgcacagagaccggatattgccttcagctacagagaaggacccgcaggacttgcgttcagattgaacataagcgtattgggcacctggagaccgggaaacggggcgcatgacgaaacggtcagaagacgcctcgaacaaaaaggcctccagaaagggcgctcgaacccaagaggcacctcccactggcaacacactggcccaaaccacacgaggcgccgaaataacgaggcacggaacgtcaaacaggactaggaaagacactacagagcaacggcgaaccaacagagtaccgcaacagacaacacagagccaagataaaaacgacacaaccgcacaaccacaca

SEQ ID NO: 573094 - DNA, 128 bp, Homo sapiens
accagctgggtatatttaagcaacagcatttaacatagcaaaacattcacaccatgcagcagccaacaatcagtcccatttctctataagcaaaaccacataaacactcacacaactttccatttttc

SEQ ID NO: 573095 - DNA, 1017 bp, Homo sapiens
ttgtgtcgtgggttgggactcctcataggttacttgctcatgcggattcatttcactttgtgtgcaggtgtcgttgtgtcttaagacctctttccgttggcccctttgttctcgacggtgttgtactgtgcttgtttaacttggtagcgtaactcctctggcgtgtgccgactcttcggttaggcggttccaatggtaacatgccgtggtagatggggctctagggggattcctcggggtatatatcgggccagttgggatgcccctgtgtgttataatgtactggatccgttacaatttgcgttgaatcacataagtgtgagacgacaatggtggcgcgtcttagaaaggctgtgttggggcaaccaactgatggaatagccctcattgagtgctcctttgactcattctgcgtagcctgactaaactcttgccggatactttgaatgtctaaccgcggacgcttgcaagctctcgtttcgttctatctgttggtgtggtcttgctgagtcatgtgggacgctaatggcatgcaagttaggtcaggtgtggggaaggcgtctggctgtcgcttggatgctatgggaggggatagtagtcatagttagatcagtagattttagtatcataataatggatgtactatcttgtatagagtgagatcagcagtagaatagtagtggtagtgtgcgctcaatagcgagagaagaaccctaggtatggatgtataaatatgttagagcgtttaataataatcgttgatcagggtcgcgtgtggcttcacacactgttaatcgccagctacatttgggatgtctgtagacgtgctggagtcgcctgaggtcatagggtttgaataccaacactggactaacatgtgtgcaaccagctgtctcttctgagaaatactattatgagtccagatgtggtggtcgcatgcctgtaatcccagctagcttgggagtactgaggcaggagaatcaattgaacctgggatggaaaccgctccaataagca

SEQ ID NO: 573096 - DNA, 157 bp, Homo sapiens
ggaaatatttagtttttttaaaattcctatgttttttaaaaaaaaattcaaagcaagcctggttgtaaaaatggtgtaaaacattggggtgggggatcaattcccaaaatgctttttatgtttggtttggaagaaaacaataaatttcttttattga

SEQ ID NO: 573097 - DNA, 196 bp, Homo sapiens
  misc_feature (182)..(182): n is a, c, g, or t
gtagagagaaagccttccccctgctgtcttgcggccgtcttctgaggttctctgtctggggttggctctcttaaccctttctctgctcccagcgctggctcaccagggaaggtaggaggggcctccctcctggcttctgcatcatgcgccagcgaaacatcactggccgttggtctctcatngacttaacgtggct

SEQ ID NO: 573098 - DNA, 554 bp, Homo sapiens
gcctagccagagatatttatcttgttttgttccgtggcggggaaatatccagtccctatggggagagtgatacatctcttaatagtggcgggcgctatatctaagtaagcgagagataaacacctagggaacgaaccactatattgttaaggtcccccactcttgtagccgaaacaatccactcgcccgtcacaggcacaaacagagggatgtatttaaaaagaagtggttttcccctccccccccctttttcaagaggaggaagaccaaataatttgtcttagcagacagagaataaatagatagattctccaatgaagagcgaatgattgcctgcggtagagcggacgcacgcgcggctatgtgtgtgggaggcggactcaacgcaccatattgaacaacgactcacgagccttcggagggacgcccacttcgctggcgcaaggataggtggagaggcacacccgggagtctacgaacgcgccacgccgcgggcgccattaccgcgtggcgaccacctagattactctccgcccaacaaatagacagagaaa

SEQ ID NO: 573099 - DNA, 125 bp, Homo sapiens
  misc_feature (87)..(87): n is a, c, g, or t
  misc_feature (89)..(89): n is a, c, g, or t
cactcagcctgccaggagcgtgtaggaggggtcgggagaaatcaggctctcgaagctcataaaattcaacgtgaggcagcagtacangnacgcccgaagcacagtgggcggtcataaaggagcgg

SEQ ID NO: 573100 - DNA, 301 bp, Homo sapiens
gtggttagagtagcaggaaggaggacggaatattgatatggaatatagatattaggagattataagataactcgtctagaactcctgacctcaaatgatccactcaccttggcctcccaaagtgatgggattataggcgtaagccaccgtgccccaccttcttttctttctttctttctttttttttttaaagagagagcatctcactctgttgtccaggcgggagtgcagtagtgtgatcatagctcacggtagccttgaaccatggggttcaagccatcccaccttaatctccctagta

SEQ ID NO: 573101 - DNA, 580 bp, Homo sapiens
  misc_feature (37)..(37): n is a, c, g, or t
  misc_feature (92)..(92): n is a, c, g, or t
  misc_feature (123)..(123): n is a, c, g, or t
  misc_feature (137)..(137): n is a, c, g, or t
  misc_feature (140)..(140): n is a, c, g, or t
ccccggcttacttgccccaccagcagaaggttctgcngctgtattaaagccgctcgccacctcgagtcatggtgtatccacagggacaagtnccggtactttgcttgcttgatgagagcccgntttgaagaacatangantgagaaggatatgatgagggctacccagctgctgagggaggcagaagaagaattctggcagaatcagcatcctcagccgtatatcttcccagactctccggggggcaacttccttcggagagatatgagtgcttacaaggttccagaatggtgcttagattactggcatccctctgagaaagcaatgtatcctgattacttttccaagagagagcagtggaagaagctgaggatggagagctgggatcgggaggttaagcagctgcaggaggaaacatcacctgatggtattatgactgaagctttgcctcctgccagaagggaaggtgacttgcccccactgtggtggcatattgtgaccagacctcgggaacggcccacatagaggcaggcccctcactgttcatgcttgcaagtgagagtttcagagcacgctcaca

SEQ ID NO: 573102 - DNA, 585 bp, Homo sapiens
ccccagactagcatgtggttctatatttgtaaagttattgggataagaaacaattaaacagtttgtagtaaaaaaaaaaaaaaaaaaaaaaaacaaaaacatagtggcgcggacgcgccccgcggacccagcgaaacaagccttctcaagaaaccactgcgtggggcgcgcgcgcgcggcgccccagaggaggcaagggagaaaagagggccacatacaggctgttcgcccaaggaagaaccgcgggaccagcgaacagaggggcgtggagcattctccaacacaaaataaaaaacgcgccgcggggcggaacacccgacggagggttctgcgaacacaaaaatcccacacagagggaattctgagaagaggacctaataagggggaaactaaaaacaacacgggagggccaaaacggagcgaggcacccgagaaatatatcaaaatatagcgcccgccgccggaggggggtctaagaccaacaaacgacagaaaaaacacaacacaccacaaaaaaaaacacacagaaaagaaaaaacagaaaaagaaaaaaataacaaacaagaaaacagacgaacaaagaaa

SEQ ID NO: 573103 - DNA, 1337 bp, Homo sapiens
cgcaccccgcggttgggagtatgtgtgttgtgacgcgcgctcgcagtgggtgtgtgtcgtgctgccccggccgccctgcacgctcttgcgctccacgatgagtgtgtgtgtggggtgttttttagagtgggctgtagtccggccacagcggtggtctgtggggcgcgtgtttctcagagaggtggtggtaagcgaccgctcgtccgtgcccccgccatgatcaccgggggttggttgtttctagtctcagtagtgttggtcgaagccaccaccaggatgtcgccgcacccctcgccccgggcgtggtgctccccgtggtgcctcttacaagaaggggggtctgttgttgcacaaaaagggggggcgccccccgttcgaccccgccggtgatacgtgtgcgccccccataaggggggaaaaaggggagagccgcgcgaacacacccaagggtgttgtattttcctggagaaaggggggaagacaggaaaaagggaaatgtgggaacggggccacaccgccctttcccgcaattgtggacgctgttctcccccctcggaggggtgtcacccgccgcacaaagagggtggtcgcaagaagcccccctgtccttggaggggcttccccctgggggagattgtgcccagcgctgctctccagggcccaaattttaacctgttgtgcacacccggttaccgcaccaggaaagggcatgtgcgcaccccaagcgcctccccagacatctctgtttgtggttatagggatctctctcccctgtctcacgtgccccctctgtctgttctctcagagaaagaggcgccagcgcacacacaccccctgtggcaaagaagcggcggagagaagagagagagacacatgtgagcgccccacaataccgcacattgccctgtggaaaatattacatatatctcaccccaggagaaaacactgtggtctcttgtggcctctcttgaataccacctctccacaggcctccctctgatataaagctttcttgcctccccacacccctcgcccacacctctttctctgtttgaagaaatatacccccgcctccactaaaaagctattcttctcgcgcccacctcccacaagcccaccactgggggtatggggttctgctgtgtgctggaagagactcttggtgaattcgccggtggccaaacacagacccccggatttccagaaaccagatattctcatctcccatgcccactcccgccacgccaccccctggaaaaggggaaaatcggaagaaagtatttataagatcctttttctggccagaacccctgaaattaatcccgctggtgccccca

SEQ ID NO: 573104 - DNA, 860 bp, Homo sapiens
tagtggtgccgcccccctctgtttgagcccgcggtaatgttggttgtttccaaccacgacgtttgtcccctgctgatcgattgacacacaaagggggaatatgtgtcaaaagtacgtggttaacaggacgcacgccggttacgcgccaaaaagggggtcctggtgggacgcaccgaacgatgctcccccaagcaacgccccgttttggttaacatgacagacgggcggtaataacacccccttatgggcgcgcgccaaaatgtctctgtctattctatttatgagtgccgctctgtttaaccccgtcgctatattcccccggttgccccgcgctgtgtacacgaacacacactattgttatcaccatccgccgtcatgatcccccccgcccaccctctttgttgttacatcaactagttaaaccctctgcgccaacacttgtggaagtggttctccccaaaagtcctgctaaaaatagctgtgaacaccctgcttcaccctcacgtcccccctcttatgtggtgacaccacgagtcaccgcgtttttacaaccttcttcccacgattcttttattgggtggggttgttaatacaaacggctggacgaataaaccacgatctttgtgtcggagaaaccctgagagtagtttctcccaccccacgctggtaggaggagtcctcgggtcccccttctaaggcgtctcgtagattccgccagtctcctggttgaaccgggttaggagaacaaccacctcgttgtggaaaagaagaaaaacgttcactcggtgcgcaacaaattgtgtgcgccaccagcttgctggggattaaaaaaccccttttaagccccaaacccacataac

SEQ ID NO: 573105 - DNA, 112 bp, Homo sapiens
caacgcaaacccaagtaatatggtcattgagccagctggcggatccaatagtgagacatctgattgccgcatgtacactcgtccatgtaactcaaagaatcgagcacagagg

SEQ ID NO: 573106 - DNA, 100 bp, Homo sapiens
tggtctagaggatctatcccgagtcttcatgtatattccttgatattggacatatgatagtacgagaaatagtggagtagtgacaggtatagctgcagat

SEQ ID NO: 573107 - DNA, 797 bp, Homo sapiens
tccctcccgtctgtggtgccatcattaacacctccttgtcctccgctcctgtgctgagtccctttgtgcttggtgtaatagttgccacgcagagtttgctaaccctgtagtgcagcagcactaagaacgaatgcgtgtggtggaagcagaggcaaccgccgcaggcagctccattgctgcccgagtaacgacgtttcttatcccagaacgttcatggcgtgtatccttctttgtgggaagagcaaggtgaccatactaccagaagatcaactctaggctggtgtagttgcgagtaggtgacctactaagtggggcttaggagagtatggtggttcagagcccgtagttatccgcagcaagttaaggaaggttggacgcgtgggaatgggatgccttttgagtcccgaggaggtctttgaagatgcagactgtgtgggcgaattcgataggttggagaaccccttgtactgctaagcggagatatacataggaatacttgggccacattaagaaatacactcaggggggaacctttcagaaaaacaccctaatgcgtcgggcatacctcccagatcaggttagccatatgctgcttggcgaaaagggaacccttgactccaggagcgaattacaatgcaccactcttgcctcccgggtggggacccaggggattcagcccaactctttaaaagttactccctagtctacagcccgtggttgagaacccacctgattagggattaggggggcagacggcttattgcaggggataccaacatgaataaggtacctaagcg

SEQ ID NO: 573108 - DNA, 458 bp, Homo sapiens
atatggctgtcgggacatcacgatgcccatcaacagcgccaacaggaaaatatgcgccacgtagagtgtccacacccgacgcaggattttcaggcaggcgaagagatagccctcgcgctgcagaatcttgccgtaggccagcacggctgcgtagccggccaggaacacgaagatttccgcggcgtcactgaacccgaagttctgcacggtgatgttggcgagggggttgtgaggcacgtgatcccagaaaatgaagatcaacgccaggccccgaaaaaagtcgatgcgcgggtcgcgtccgttcagcatggcagcgggctcttgaacaagtagttgaatgacgaaatgtgagcgcgggcgtcgccgcacgtcgggcgggcgcaggttggcggtatttgtaagcaattgcaaaggctgggtattactgaatgtctctagagatcaatgatcaccagggt

SEQ ID NO: 573109 - DNA, 184 bp, Homo sapiens
  misc_feature (113)..(113): n is a, c, g, or t
  misc_feature (141)..(141): n is a, c, g, or t
  misc_feature (147)..(147): n is a, c, g, or t
tgaactcctgacctcatgtgatctgctggcctcggcctcccaaagtgctgggattacaggcatgagccttgtctggctagttcatgaagattttactctggctcttaaaatgngctacatgtctttaaaacaagcttatgnaatccntttctattctctggacaaacaggtttagcactggaat

SEQ ID NO: 573110 - DNA, 289 bp, Homo sapiens
tgcgtcaattagtgtgcatgagtaggtggctgcagtaatgttagctgtgttaggctgtactggcagtgttattggttgaatgagtaggctgatggtttctgataataactatgtatggggataacggggtagtaggtgtgccttgatggtaaagaagtgggctaggtgcatattttaatctatagatgcgaaagccctattaatcacttgcgccctgctcataagggtgattggcatggctagggtagatacgatacgttggggtggttggttgtaacatgagttgagg

SEQ ID NO: 573111 - DNA, 826 bp, Homo sapiens
gtccgagcacaaagagaagatgaccgagagactctttgtccagccaatgcaggacacactctgtttacccaagaactggtgtctgcagatactaaagaagagcgggatctcgggatgcaaaaactcaatcaagttcttgttgatattcgcctctggaaaagctgatgcttgtacaaacctatggaaagccttaaactggaaattcccagtgctatctagaggtttcgatgtcatcttaagaaacacacttaagagcatcagattgacctgatggcatttaatgcttaagtaccgaaagggtgtgtgccaatattcactaggtataatgcaggtcattcatatcttgggtatgtaaaacttaaactgattttctgtcattcatcactgagtagaagtaacatacattatagtggatttgctaaatcttaatttaaaaagcctcattttcctagaaaatctaatattcagttcattcattgacacatatttttttcaagaacgtacgaaattctgaggtgtcttctgggagctgtaggctcttgaagcaagcaacggtcttttcaggggttcggagacagaaaacccaattctccaaatctcagtacattccgaaacggctgtgatcagtccatggaaccggaattgcattgggacctagggtaccggacaaaaaggcaagggccttcagcaacttttccgtatgcggtctcgaccctctccatatcccacatcttgggtacgccggggcgggtccaaaagtgtgtccataccccgtgagcagcggccactcctcaaagcaaccgccgctcgccacaacaagggcgcc

SEQ ID NO: 573112 - DNA, 268 bp, Homo sapiens
  misc_feature (82)..(82): n is a, c, g, or t
ccaaagcccctcagcctgccttgcagaccaatggggtccatgttttgtagccccctcccctacgcctcacccctcctccctntcacaggttttgggcggccagtgaaaaaaacccagtgggggaggcagggagtttggtgcctgcaaaaattttttgcttctttcctggggggaggtggggaggttttagcaggagcgggccctgtacccccctgctgacctgctgtttggtaaaaaaataaaggttgtgtggctgggggaacggaga

SEQ ID NO: 573113 - DNA, 733 bp, Homo sapiens
gagctcgagtggccgatggcaacgatgtggtcaaagtcatgagctggtggtcgatggtcctggaggtggtcgaacaaatgtgatgactagagggatcacaaggaagacacagaacatatgtaacctcacttgtaccaaacagtaagcagctgttggtaagaatgaatgatgaaacacggtagagggacctagatgcctgagcagtctgaacttgcacacttgtgtgaataaccgtcaacgacttcaatgtgcgctgtgttaataatttacttgatatgtttagtacagtacttaaagacctactcttctcgactggaggacagcaatttcaatggtagaaaatcgagtgaacaatatgaataccatttacgcaagaaataggcaaggacggaggaaatgatcatagagctggagggaatctgagggggaccccgatgtcagtatggaaccttgggaagaatgattatcgatgacggaatctatgccgatctgtgtctacagtctcgtcggtgctacacgcaataaactagccgtcatgcattcttctcatgacgttaaatcaaaggattctgcatgcgatacctgggtctagtctgcgagtacttgctctattcagcaattggttgcactgacgtgataagaaggtggctcgactaggatgaacacggattcccctgggtgcaacatgcttgatgacagagtccgaataaggccccctcgtggatgagcctta

SEQ ID NO: 573114 - DNA, 439 bp, Homo sapiens
tagaagactcactggggttccacagctatggctcactaccaggagctgatgaatcgggcgaggggctcaagacagagctcaggcatcaccacacctcaggcctttggggcatctcccaggtccccatctccgggacaccgggccatggtggtgaagccagacagcgacctcaaaggtggcctgggagtcccctacagcccctcagcagagggcagcactggattgcttagctccatcccatagttctctacttcatataaatggctcaggccctcccaccccttctctaacactagctgcaaggcagaagccacagcagcctcggtccagccggcaggtggccactgggaaccatgtgtccacgggcgtaggggagtcggttcctgagaggtctgagggccagagctgccctctacattaacatgctgtctctaagggt

SEQ ID NO: 573115 - DNA, 851 bp, Homo sapiens
  misc_feature (506)..(506): n is a, c, g, or t
gctctactggcttctggccgatctccgttccgcgcctcctctggattgcactcgaacacaacgtgatactgttcgtgacacggtatcaatgatggacgtgatgatggtggagactgagatgggcctgagttccaccgtgatcctggatgacactgcggtgtgtgaacattcctgcatcgcctgtcgtaatatccagggatccgaatatgttgctatgagtctcgatagggagagattgttgctatccaagctgttggactgacgacacggtactggtagttagacctccttcggacagactagtaaactgcttgacaatagtcggagtaggacgttcgcttatacgcttggtgcgatcaatggtacctcgcttactatacggatagaaagctaacgagttcgtgtcacggaacgctctgaagttagtgccaatcgactcgcgaggctaggcgtcaaagtcagatcgcgattgaagcattctaggacacttctggtaaacaacccantctcatggatcgcaaggtcgttccagggtacacggggaggtcaccttgaaatggcatggattagtcggaatgcccactctaagtgccaaggactgcgtgaaactgtgttggggctattcctgtgtgacctcccgtgacacatagaagaatgcacaggcatgatccaatgttgatcatccacggagatgtacatgacaggtctgatggcagaattgccaggttggcaggccagtagccgcaacggtagaatggcgtgcacagactcctgagagtcctgcagtgggtgaccctgcatggaatcggcggctactcaagtggtgagccaagtagggggaacatgaaaca

SEQ ID NO: 573116 - DNA, 134 bp, Homo sapiens
  misc_feature (38)..(38): n is a, c, g, or t
aggatcccatgttatcgccaacacattacaacataaanacctcattcacacgagaaaacaccctcatgttcatacacctattccccattctcctcctatacctcaacccgacatcattaccgggttttcctctt

SEQ ID NO: 573117 - DNA, 1294 bp, Homo sapiens
tccgggatccggaggctttaattaatttttttcacataaattacacaagcactttataaaaggtgtcacacaaaaaaccaccttataagtgctctaaataaacacccccccacccctcaaagggtgttctgggaaacaatggggctgcgctttttattgtagaaacccctggtctggtcgctgtacctgaggattgggcgcagggagatcgtgtaggtgggggcgcctaggcaacacccaatgtgaagcgctggtttgtacctggtcgggctggtggtgtagtggtcgtagtggtgtgcccccatgtggtgggcgctcatgagaccttttgtgtgttttggtggctgggagggagatgtcgccaatggctgtgttccaggagatagatgttctgggtgtgttcacccctctgggacctgcgtggctctagattcggtagggggtcccacaagtgtgtgtacacccctctggtggaacctctcctggtctgagtgttgagaaccatctctctcgccctataatagtatgcgccccattgtgtgtgtggcgtctcctgggcggtgagacccccaccagggagggggcgcaccatgttgagacccacctcactctgtgtgtgctttgtggcgcgccctaatggggtgtgtcccccatgtgtgtgttgtgtcagactgcagacagacatgtggggtgtcccaccaacgagagaacgcgggtgtttccccccccgaagtggcgccaccagtattcccaagatattggcacacgagccctcgtgtgggggaaacccccccgaggaaaaaggactccctctcctctgcgctctataaaccctcccccctgtggaccacttctgttccttcgtgaaaaaatgccccccagcggtttcaaacacaccctctcaccactactcaaaccgcgcggggaactcttcacacaccgcccaaaaagacaacgacgagaattttccgtcttcaacacacgcagcttctccacgcacccccgcggtctggccggcggagcggccccttccgtgggggacggcggcgcggggcgcgcaatggttgtctcgcccctatggtgccgccccgttgggatgagcttcttcttcgcccccgcgacatagcagggacacaccacccggcccttgctcgcgtcgcccacaacactgttctggggcgggggcccgcctttacgcggcgcgccggtcgctcagaaggcggccttgctgttttccccccatcacatggggcgtgccgcactctttggcagtggcccccgacacgggtctcgt

SEQ ID NO: 573118 - DNA, 1961 bp, Homo sapiens
  misc_feature (1961)..(1961): n is a, c, g, or t
caagatcctgtctctccaaaaaaaaaaaaaaaaaaaaaaaaaattttacatttttggagttccagaggaccctcttattactctggatttcattttcagaggggttagtataaaaaattatatttgtataaagataatgtatattttttaataaattcaggctggatagggtacacaggaaaaagggggaccaaaaagagaaatttgtctaattattattccccggtggcccttacacacattgcattaggcctcaccaccagtatattacacgttattccacacacaacacaagacggtgggatacacaattgtggtgttaccaattacacatataaacgccctcacatgtggacacacacatatcattatattacacccacagaaggtctcccatctagtattaacacatgtgaaagtattttcaacctcgtgggggtgtgtcggtgaacaccatatgtgtgtgagtggggggatatataagaaacacaagtatgttttatgagatgaagatatatcttacacaatatatttatggggaatatactatatacacaaagacaataatacagtgtgttctacaatgtgcgccgtatatataaagagaattgtacttctataaatgagcattctacacacgctgtgcggtgtcagatatgccacacatattatagtctgtctccgcctaataaaaatgctccccacactggtgtggggcgaacacagcaccatcttatgatattacaacgagacagaccaaaaagacatatgcaggtgtacacaacgagcggggggggggaacacaatctggggtcgacaagagtgataaaaacacaactccgagtaacgacaaaacacggcgggcggggcggtgaacggaggaaacaacataccaccacgcagactcatcatcacatcataacaggggaacaacccacagcaggggggattagccataagaacgcccgcaaagaagatcgatcgacgtcacaaatcactgacgggcgtccaattataacaaacgagggcgaagtacacaggtgggcaacccacccattaacgacgacacgacagcaactcactcatcacgagagcacacctaatcaagaggcggataaggaggcagccaccaccgaactagatagtgtggtatatacagattcgccgcattgatatagtgggatggagcatcccacagacgtgtgagatagaatgaatagacacagcaatagccgcaccagactagtgggtgtgacgaaaaacaagcgtgcggaaacaacaacaggagagggagactacaccggtcaggtgcccccacttagtggatagaacactcatgacgacatagacacgaggaacacaaacaagcggggcgaccgcaccagcaagccaccaccacagagcaagggtgtctcaccagtggaaccaagcgagcacaaccagtgcgaaagcacaagactgttgagcggacaacaccaccagtatgttataaccaggggagacccagccaagaaagctgactagcccaatgtaaccagaacaaacggctcacatatgaggacacacactagtagatagatagtggacgcacaccatacgaaacacgggagcggacgcctccaacaaatacaaacttacgcagaagccaaacgcggcggcccaccacgggtgagtccgtacggcaggagaaaagcatcggaatccaaccaacccagcggcagaacgacaacaaccgcaggggtaacaaacgagcgaacggcccggcccatccacaagagagacagtagagggagcacaccaaggaggccaaaacaaaccaaagcacacgaagaggcaaatagcaggactaaccataagataacccagtcacgtggggaacaacaaggcacgcggccgccactcgctcaccaatcagagaacgacacacgaaataatgaaatatgataatacaaaatgaaggn

SEQ ID NO: 573119 - DNA, 279 bp, Homo sapiens
ttccttctttcagtagttttttctccctttctgatagtccaagattccttatttaatcatttcctttacattttaagaacttcctttagccattctttagagtagttatgtgggtgacagattctctaagtgttccttcatctgagaatgtctagatctcccctccatttctgaagtatacttttgctggatattgaattttggttagacagttcttttctttcagctctagcaacatgtgccacttctttctggcctatagtagcgattagggttagt

SEQ ID NO: 573120 - DNA, 116 bp, Homo sapiens
gctgccggaggcgtataatagaaatgacatgagggcagtccgcccctccccggcccagctagcccagtgagttcgtggggtagaggtgtaaaagctttcccccctgtcgtcgtctt

SEQ ID NO: 573121 - DNA, 383 bp, Homo sapiens
cccctggcttgctcaggtctgctgcctgcgcaggtctctgtggcctaaaaaggctgttcttttttatttttttggaacagagtctcgtactgttgcccagcctggagtgcaggggtgcaatctcggctcactgcaacctctgccccctgggttcaagcaattctgccccaacctcctgagtagctgggtttacaggcacaggccaccatgctcggctaatttttgtatttttagtagagacagggtttcaccttattggccaggctggtctcgaactcctgacctcaagtgatccacccgcctcggcctcccaaagtgctgggattacaggcgtgagccactgcacccggcctcaaaggctgggagggaatgcagtgactctg

SEQ ID NO: 573122 - DNA, 185 bp, Homo sapiens
acaacctagggtcagcttttgcatgtggtaagccatttaccaagatagttgtaggtaaagaagggcagatttattagagaaattagtgaaaatatgttagcagtagagcagctcagcagagaaggggctacctgcaaagaggcaagggctggcaggaaagttttatagagagtcctgcatgaagg

SEQ ID NO: 573123 - DNA, 441 bp, Homo sapiens
  misc_feature (33)..(33): n is a, c, g, or t
  misc_feature (41)..(41): n is a, c, g, or t
  misc_feature (57)..(57): n is a, c, g, or t
  misc_feature (78)..(78): n is a, c, g, or t
  misc_feature (90)..(90): n is a, c, g, or t
  misc_feature (128)..(128): n is a, c, g, or t
  misc_feature (160)..(160): n is a, c, g, or t
  misc_feature (193)..(193): n is a, c, g, or t
  misc_feature (392)..(392): n is a, c, g, or t
gttcttggatctcatacaggaaggaattcaagncgagtcgnaaagtacagtgcaaanagagtttattgaaagctactntgggccagcatnatggcttgggcctgtggtctaagcactttgggaggccnaggtgggaggatcacttgaggtcaggagtttnagaccagcctgggcaatatggcgaaaccccatntcttccaaaaataacaaaaattagccgggtgtggtggcctgcacctgtagtcccaggtactcgggaggctggatgggacagtcgcttgaacccgggaggcagaggttgcagcccagctgaggacacgccactgcactgcagcttgggtaacagagtgagaccccatctcaaaaaacaaaaacaaaacaaacaaacaagncagagttcaagaccaacgtggccaacacagtgagaccctgtctctattt

SEQ ID NO: 573124 - DNA, 174 bp, Homo sapiens
  misc_feature (3)..(3): n is a, c, g, or t
ggnagagagaactggcaagtggttacttcctccaattcactctaataggctctcagtaactcggacaccgtgattccattggaaataagtgtagccatgaccagctaatccttccccttaatcatctagggaaacccgaaagacatctcatgcaacaaaggactgctctatggg

SEQ ID NO: 573125 - DNA, 236 bp, Homo sapiens
aggttggaagaatagacaaaagtggagctagccgttatctagcacccatgatgatacctacctatgtgcaaagaaaagtagaagttcgtgggattgtgacaaacgtaagtattagtaggaggggatccttgagctccagcaggatccttgagctccagcaggatccttgagctccagcaggatccttgagctccagcaggatccttgagctccagcaggatccttgagctccagca

SEQ ID NO: 573126 - DNA, 715 bp, Homo sapiens
  misc_feature (4)..(4): n is a, c, g, or t
  misc_feature (98)..(98): n is a, c, g, or t
  misc_feature (162)..(162): n is a, c, g, or t
  misc_feature (243)..(243): n is a, c, g, or t
  misc_feature (249)..(249): n is a, c, g, or t
  misc_feature (251)..(251): n is a, c, g, or t
  misc_feature (261)..(261): n is a, c, g, or t
  misc_feature (278)..(278): n is a, c, g, or t
  misc_feature (283)..(283): n is a, c, g, or t
  misc_feature (299)..(300): n is a, c, g, or t
  misc_feature (303)..(304): n is a, c, g, or t
  misc_feature (316)..(316): n is a, c, g, or t
  misc_feature (319)..(319): n is a, c, g, or t
  misc_feature (324)..(324): n is a, c, g, or t
  misc_feature (331)..(331): n is a, c, g, or t
  misc_feature (343)..(346): n is a, c, g, or t
  misc_feature (354)..(354): n is a, c, g, or t
  misc_feature (358)..(358): n is a, c, g, or t
  misc_feature (361)..(361): n is a, c, g, or t
  misc_feature (367)..(368): n is a, c, g, or t
  misc_feature (375)..(375): n is a, c, g, or t
  misc_feature (391)..(391): n is a, c, g, or t
  misc_feature (448)..(448): n is a, c, g, or t
  misc_feature (484)..(484): n is a, c, g, or t
  misc_feature (500)..(500): n is a, c, g, or t
  misc_feature (695)..(695): n is a, c, g, or t
  misc_feature (707)..(709): n is a, c, g, or t
  misc_feature (711)..(711): n is a, c, g, or t
cgcnccttcaaaacagtcttaattaactttcatattggcagattaaactagcagagcaggttcaagggaaattaaatgatatggaccctaatttgtancattctgagttgattgtgtggtttattcattctggaaacatgttgaaactaacagtcagccacngcttttgataagtgatattgattaggttgaatcttcttgtaaatagtatttaccagttagcaaagtctgtgttttcagaanaacagngngcacagaggngttcaaaaaagtggaantgagncccacccggtaagagnngcnnaaacttgacacngtngacanttgggcnggaaaaaacccnnnngggggggnctgngcngggcanngcagganggggagcagcgccccncccatgtgacccccacagttatgccggatgttgccagatgcccctaggggacagagncaacccccaactgaggaccactgtcctacagagtcnggaaatattgtagggngaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttntttcttgcaaannnanaaaa

SEQ ID NO: 573127 - DNA, 465 bp, Homo sapiens
  misc_feature (5)..(5): n is a, c, g, or t
  misc_feature (14)..(14): n is a, c, g, or t
  misc_feature (32)..(32): n is a, c, g, or t
  misc_feature (47)..(47): n is a, c, g, or t
  misc_feature (94)..(94): n is a, c, g, or t
  misc_feature (126)..(126): n is a, c, g, or t
  misc_feature (198)..(198): n is a, c, g, or t
  misc_feature (234)..(234): n is a, c, g, or t
  misc_feature (250)..(250): n is a, c, g, or t
  misc_feature (445)..(445): n is a, c, g, or t
  misc_feature (457)..(459): n is a, c, g, or t
  misc_feature (461)..(461): n is a, c, g, or t
cactnggtaaaaanttccccttaaaaacttgnaccactgttgaacanttggggccctgggataaaaaaccccccctgtggtgggggtcctgtgncctgtgccattggccaggatgggtgaagccanccgtccccctccccatgtgaacaccccccacagttatgccggatgttgccagatgcccctaggggacagagncaacccccaactgaggaccactgtcctacagagtcnggaaatattgtagggngaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttntttcttgcaaannnanaaaa

SEQ ID NO: 573128 - DNA, 1161 bp, Homo sapiens
agcggagttgcattcctgcattgcaggcccgtgagaacactaaccgcctcctcgagaagcccaggtccagagccgaatccgtgcactgacccccccaggccatgcgcacagcctatctccccagcgctagcaactggcactggataccactgcaccgactatgcgcgaatggaccctcggcaggagcactgcaggcgaagggctgaccaggttggctgatgacgtcgctggaaagcgcccgatcggtatgcttgcaacatgagttgaagagcagtacatcgaactcctaggtatcaggcactttggttactgttggcatgaatcgacggagtaagcaagcgtggtaagcggcagttgacggcaagggatgtgcccccataattcagtttacggacctgtgaagagtatagcagtaacagaggatatgtttagaacggaacctaggtgaaaaaaattcttgccggcgactttggtggtggtgttccctgttaacccgacgcttaaactcaacgtagaatgacttcatctgactagaacgctcttggtggccactccaaatcgagcgaacgacactttggtcgtgtcctagcgcaaagcgcttgcttccgttgtatgtgaggtaccggaaactgggagcagccgaaatcgcgcaccatgcaaatttgggccgagcctttctattcaccgccagcgttgaactttattgatgtcccgtatgaatatcgaaacgtaagcattgcacataaaccttgagaagtcacggatagacgccgagcgtgttcattcaggtgaaaccatctcggtcctgcaatttgcgccttggactattggtggccattgccagcatccgattaccgcaagagaattcggcgccaggaatttccgaccatggatttccctggcactactcgcgggtgatgttcccaaaacaaattaaagccaataccattcgacttgaggggctaaagctcaacggttgcgaactaccagagtgcctggggacacgtgggtaatacgcctggtgcccaaccctgtgttcatccttccaaaatgtctggttggtcgcaacgaactaggcttgccttcattgccttggctccatggagtattatacgtacgtaagggcaggcaccatcattaacaccacttcaggtccccctc

SEQ ID NO: 573129 - DNA, 357 bp, Homo sapiens
  misc_feature (83)..(83): n is a, c, g, or t
  misc_feature (135)..(135): n is a, c, g, or t
  misc_feature (155)..(155): n is a, c, g, or t
  misc_feature (195)..(195): n is a, c, g, or t
  misc_feature (222)..(222): n is a, c, g, or t
  misc_feature (306)..(306): n is a, c, g, or t
gtctgtggggaagcacgggagaaatccacgtaacctttgctttctttttaagggaagcggttccgcgtgaacttggaaccctnagctccgggtgttctcggcagaagggcagctggaagggacacagtggggcangctttggggttgctccctgntctgcccgaggccggggacgcaaggcagccacgccttcgngggcttcattctgtagcattgcagcgntctcttcacgctctaacaatcttcgcttttcctcacttacgtggtgtgaactgtccgctctgcttcattttaattttaagccanggtccctctgaccggtgcccttaattaatgctgtaaggtggctggtggtct

SEQ ID NO: 573130 - DNA, 680 bp, Homo sapiens
taaggtgggacgggaagtaaaatttatggggggagtattaaaaggggggcagcacttgggaagccctcatgattgcgggcccgccattggtccagagggcccgagggggatgtcttgaccccacagccatcggggatgagccgcttttcagccaccaggtcttcaaattcatcagcatggaactgggtgaagccccacttcttggagatgtgggatcttctggggggccaggaaacttgaactgggccctgcgcaggcctcaatcacatgctcctggtctggcagctgggtcgcggatgggacattgataactgggccaatggtgaacccgggccacaggtgcccgtggggcttccaaaggcacctcgaatgcctgttgggagccttgtcagccccagcacaggacaacattctgggtgatgcggatgacgtggaaggggtggaagccgacccggatatggaagccatcttggccaacaacttttaccaggtacttattgggcacaaatctcgggcagccctccagggctccagaggacagcgtgcctcaatatcactctagaccccatgtgtggccacaaaggggaaacatcatccacgtttggcctttttccgccccaggtcaaaacggcgactctgggcctcggtaccctcggacaaagcgaaatggggtacggacg

SEQ ID NO: 573131 - DNA, 356 bp, Homo sapiens
  misc_feature (124)..(124): n is a, c, g, or t
  misc_feature (204)..(204): n is a, c, g, or t
  misc_feature (207)..(207): n is a, c, g, or t
  misc_feature (313)..(313): n is a, c, g, or t
  misc_feature (345)..(346): n is a, c, g, or t
  misc_feature (356)..(356): n is a, c, g, or t
ggggaagccccatattaaaccatcaaatctcatgagaactcactcactatcatgtgaacagcatgagggcaactgcctccatgattaaatgacctcttacctcctactgggttcctcccacaanacgtggggattatgggaactacaattcaagatgagatttgggtagggacacagccaaaccataccagatggggacactanggnctcttaataaactgatgggaaagctgaaaagtggctgggtacggtggctcatgcctgtaatctcagcactttgagaggcgctttgagctcaagagtttgagaccancctgggcaacatggcaaaaccccgtctctacnnaaaaaattan

SEQ ID NO: 573132 - DNA, 375 bp, Homo sapiens
cagatggtctacggagggaaagtcatgatgtgaataacaaaacaattaagcttgatggaagaaggcttttcctagtgcccatactttgggaatcccactctgtgtggtccgaatggacaacacctgtcgtgtcttgagccagcgagagatgcagtggaagtgaaaagcatggttacggactccccatgcgacagtacactctgctgaagtagcggacgccgggttagcttgacattcgtatgcaaagatcacataatgtggttcctgcgagatggcgcagttgtcaaccacaatatcccagggccagagggctactgcattccactttttcacttcaaagcgcttctggcccgcgccgccgttaggccgatctga

SEQ ID NO: 573133 - DNA, 838 bp, Homo sapiens
gtataacacctaatcctgacttccctaataccccgcatccttaccaccctcgttaaccctaagaaaaagaaatcatacgccccattatgtaaaatccatgtcgcatccacctgttatatcagtgctcttccccacagaatattcatgtgcctagaccaatgaagttattatctcgaatctgacactgagccacaacccaaaataccagtcctccctaagcgttcaaggctagacgacttctccataatattcatcccggtggcattgtgcgtgtacatggtccatcatagaatactcactggattataccaaacccagctacgcaaaatcttagcatactgcctcaattacccgacagttaggatgaataatgagcgagttctaccgtacaaccctaacatgaaccattcttaatttaagctatctatattatcctaactactaccgcattcctactactcaagtgtaaactccagcaccacgagcctactactatctcgcacctgaaacaagctaacatgactagcacaccttaattccatccaccgctcctctccctaggaggccctgcccccgctaaccggctttttgcccaaatgggtcattatcgaagaatgtcaggaaataaacaatagcctcatcatacccgcacatcatagcaacatcatcctccttagctctagttgtacctacgcctaatctatccacctcaatgatatactccccatatgtagcaacgttacattttacacatgacaggttgaaccatacaaaacccactcgttccttcccaaatcatgcctgaacacgtgggtctaacatatttcccttgtatata

SEQ ID NO: 573134 - DNA, 393 bp, Homo sapiens
cagtacaatgatgatcaagaccattgatcatacagagtgcaaggactcggtccagatcgaagcctccatccggacctagctgatcgaccttaaacatgagtgccatcatacgcatgagtatgacgagagccgtcctgtcatctgtcactctatatgctgctacgaggactacaacttagctgctgacaccatatgtagcgcaacctaacttgcgccaaaccctcgatgccattgccatggctatacttgacagtgatcgatagtttacactactggcccacacagcaactaatggaaagctttctggttgaacaaagcttttgctggacccccaaggagactttcgtctccggggcctccaactataaggccagaaccccgtcaacctccgcg

SEQ ID NO: 573135 - DNA, 114 bp, Homo sapiens
tcataggttcgcaggtaagagtgcttactagaagtgtgaaaacgtatgcttgtgattaagtgcgacagcaatatctaggatagtcagtagaattagaatagtgaagatagataa

SEQ ID NO: 573136 - DNA, 933 bp, Homo sapiens
ggccggagccaacatatctccgagtctgggttggcctggcggccgtggagtttgtgacatacgaggtgaaacacccatcgagatcacattaccgcttcaacgtccagactggtagcgccatgccttggcctgtagggattcgatatctgacagaccattacgacaccgaatccatagaccatgcagaggaccagtgaacctcacaagcctgcagcgacgccacacaagccacacacgtcagccaagcacatggcgccacgtcaagcacatccacaagccgggacacaagcacagcaccatgccccacgaatagcgagacaccccgggaccaagcaggactatccttagaccagaacacacgaagcccactgaacaccatcccgacaaatagtaactcagacaccccacgatgagaagagctgtgccgagttcctacccacgacactagacaaccacacacaataaaccaatccccaactaacattcaccttattcaattatccattcactatccatccatggaacaatctgctgcccagcaggccgccaatgcgatgacagacatatataccaccaggagttaaaacggaccacattgagtaacacacaaacccaacagggcacggcaccccttccccgcgcgcacagacgacacgaaacgacaaggataggcgaggatagcgagacaacaaaagttaaagagacaacagaaaaagtaataaaggagaaattccatggcaaaaattacaaagggaggaacacataattagagaggaacattatccgtatgggagcgtaagagacaaacggaacacaatttccgatatttcccttgggccaattagactatgactttagcgccgcttagggagtgggaacatagataaaggaaataggacggacagaggggggttaggaggaagcaggacaata

SEQ ID NO: 573137 - DNA, 171 bp, Homo sapiens
gctgtgagtactgtgtgaggtggtctcggatgctggcaatcacagaatctagacctgggagtactgtgtgagcgtggtcttggatggtggcgatcacaacaggtgaatcttgggcaggactggattgaggctggtcttaggaggctgtgcgattgacagaaccagaagcca

SEQ ID NO: 573138 - DNA, 339 bp, Homo sapiens
aggtgaggtgatctagaggatcccagtcgacggagactctcaacaattaaacgtggttggtttaattgtgagaggtcacgttttttccattcttgctctcgagggaaagttgcagcttcctagagacttgttgaatggttgtgaccaaagtgctgatagtgatatggacagtgaagtccaggctgagttggtctcagatgggagatgagaatcttattccgaactggagtgaaggtcactcttggctgtgctttagcaaagagagtggtggcattgtgcccctgctctagagatctgtgaactctgaactcgagagtctccgtcgaactgggtaccgag

SEQ ID NO: 573139 - DNA, 309 bp, Homo sapiens
agggagccaggcagttatctgtagtaacaaacaataacatccataataatcggctccaaatggcaagagcttggttagtaactgacactttccctaatttatgttcccccttgcaacttaggaccaaccagggaaagccaaatatgcacccctaaccaagcacactggatgtcccccttttagttagcccacaggcagcttccccacaccagcagtttccaatcagggcacacctgaagccttccctttcctcagctataaagctgtcgcccttgggtcagaataaataaccattgcttttttcattta

SEQ ID NO: 573140 - DNA, 643 bp, Homo sapiens
gagagtatcccgtggcactcaccgtgtgtagttggcatctccgcgcgtacggacatccgatcccagaatccctgtcctgctggactgtacgtgttcacactcgcgtcctgcagctgtgcgaggcgctcctagcgtggaaggcatgaggttcccggtgatctgtagctgagtggacggcggcacacggtcggactatgcgctggtagaagaaggcgcgcatacgaaggctcacatccgagcccgtgcgtcgggctccatgtaaagcgtggaatttcgatgtgtgctactcaattcaggagatgagaagacaaattgaacgttccggcacaaaacttctgaaatctgatatccaatacgctgatgctcaggaacctgactgacatcacaacacttgcatgacggggactccttccagatgagttctctcaggaggtgcactgtatcatcaaattggaagcacagactgcagtttgtaattgagaggaatgtgaaggtgcacttcatgggatgcccttggtaaacggcaacgatggaattacatcaaaggtgaatttctgtcgaagtttttcccagaattatcatcttttgcggatgcagagaacagttataaaaaccactcttgtaaatttacaaacgcgagaat

SEQ ID NO: 573141 - DNA, 677 bp, Homo sapiens
ttggatgccactcggccccctgactggaggccatgtgccagccttctaggaagagccccccactgcagacatgacccgagtaacttcctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactacctgaagccgttactacatcacgaaggctattgaccgagggcttcccaggtgcctcacaccttgacgagttctgttaagacagtatatcatgtgctagcgaatctttacccattgtctcgggaccagtagcgtttacccaattattaatagggccactgatgctcagcgtattgaaatgttttgagtgttatttcagagagcaaatggcaaagactggatccaaacccatcttcctggacctgaagttcatgctcccagccaccccacccctgagctgaataaagatgatttaagcataaaaa

SEQ ID NO: 573142 - DNA, 611 bp, Homo sapiens
ggacaggaaggcttcgcggaaccctacgacccacccgacgcgtaacgccacagtaccgttttatatatattactatatttctacttttcggctttattatatagttagtatagtatctactatactatatatgtactatatataatatatatatctattagaagacggaggtactagctaatgttaggccaggctggtctcgaatccccgggctcaagacagatcctacccgcctcagcctccgcgaaaagtgggactacaggcgcagcatcgccgaacccggccaatccctgttttaatctcttattccttaaaaattgcaaaagtggtgtcattttatcctgcagatggaccctccctgatacaggcaggagaaaacagagacagacacagggaggagagcactgcacgcagctgaaggcagcagattggaatgacacctactgcaagccaaggaacacggagacatagcatgggaaccaccggaagaagccagaagacaggcctggagctggcattaccctcacagccgcagaaggaaaccaacctggtgccaccttgattatcggacttctggccttcagaactgggcagagactaaatttctgatg

SEQ ID NO: 573143 - DNA, 539 bp, Homo sapiens
tggaccggtgcgacagttgacagtgagctggggttgctcagtctataagtagcatctggatgcaaataatcaccgcttgaggttttcgagcgcgggtatgtggacagctctgtgctctactctcactctcgtggctctcctttgtggactcccttgctatggtgtcctcagcttcccagcctcaaaacctggagggatcggggctccagcctctaatatagcctcctctctccccacactcaggcctaaagggagctcactcgcgcccatggtgtgaaatgtgctcccctggggagacttcccctcctagtaaatgcacaactcggttcttcagttccgagggcgaaaactggggaatcctcctcgattcctgttgctcttgtaccaccatctaatccatgagcaaatcctccaggcttatcctgacagtggcttgccccttcctctacggcgattatcctcttgtcgggatattgcaataggctcctaattatccctgctcccaccctcttctccctataaggcctgttctccactca

SEQ ID NO: 573144 - DNA, 575 bp, Homo sapiens
gtacacagtggcctgaatgcatggtatctgatgtacgaccacatgcccatatgtgcgagagaggtatggtcgatactaggagagctcctggacgttgcgcatagagcgactcgattcacaccctgcgtccatccgtagtcacgccatggggcctaggcaaaacactctgacggcatatgcctgcaccgtacttttgcgcagaacgtcttggctagacgacatggaagccttactaggtgcctgaggctgaacagagtgctgtgctcaaaatattgggtcaacttcacaagcatactcagttaacatatgaggaaactgaggctgtgtggaacacgccaatagcttatggtcaatgaaacagaccctcggagtgcgaggatcaaaagagtatctataggacgcatgtagagcgcacatattgtatcctccagcgatcgtcgccagagcattttgctcatagccaaactggagctgttcgataacgtggcgtaccgtaatgggaaactagagctggccaaagagagctgttcattgggcgtccgctgatgtgcaactagttcttggccaagttcgcc

SEQ ID NO: 573145 - DNA, 462 bp, Homo sapiens
cttttcctcctcggtaggactagtttcaaacaggccctatatcaagtctgctgctgccctctcatcagacctccgcaccctcaccccaccatcacttacactactttaatccagttccttcaaagtgatacccccacaggtaagccctcagacatcctgaatacatcatccgcagcccttggaaccttttccttcgtgacgagccacaggaatactgacacactagtaggtcacacaggctaaacgtttctcgaatgaaagtgggagtcatatcagtccatgactcttccgttctcttgagctccctcgaatcttccgcttcctccccaccgagttcagcgtgtccacactcacagctccctccagaagcatgcaagagattttaacagttcctggtctgaaccctctcaccagtcaatacatcgtctaccctgagcagaatgactccctcctaaactttag

SEQ ID NO: 573146 - DNA, 583 bp, Homo sapiens
gcagttacacaccagatttcacttccacagcaggctttatatgttctgctcgtctggtgacctagcaggtgaccctggacaaggttacttctcattatgtccggcaaggactgtaaactctgccttgctgggtcagggtcatggaggggatgaaacgtgatacacgaggaatcagccggtgcttcagagtcagcagatcctggtcaggtcccagctcagtgtgtgggaaccttggtcaccgaacgtccctgagtgaatttgttaccatcaatttaaagttgggggttaattgatagcagtccaaaccccacaggagtaccctgaggacagagtgagacgaggtttagagaagtgcttactatggcatctggcacaaggaggatcctgatcaatctaatactcatttatcattgtggtaacctgtttaagggactccgcatgcagatgaggcttgggatgtgtatgagatctatctattagcaacctcttttattggtctgtgtcgagattcccctcccaaagctgggggcagggttgggctttataaaacttgagcccctctggggactgggttctcagcaag

SEQ ID NO: 573147 - DNA, 972 bp, Homo sapiens
ttccggtcgtaaaaatcggggtgtacacccatgcttcacatgtcttgccaattggggcattatccctatgcgccttgaatccatcagtcgtacaacgtgtgactaaacctgctactgttcaaccatattcctgtgatcggttacttttcttccgtaccaaccaacgaaagtcctcccagtggtacccccactccacgtccgctctaaatgcgctcaagggaatgggccccttctgtattcgccaatcgcctcaatgcaaggcgcctacatcgccggagtcagcagtcccatggtactcagactagagtggacaacgttccttggcggtcccaccgccagacagcacgcccgctccgtggccccacgacaaccgcacggcacagggggccgtccggcaacagggtcagacgtaggacccagctacacttgtgcagtgcgacagatcccatggccatgcgtcacgtccagcgatgtaacacgtacatcaacagttacatctctgaaatctgcctctgtctcgtaatcttgctctgtcgtacacggcacttccactagtcactactactgccggtagttgtcccttgctccggacgagtgagggagggtccttcaacccccaagtcccacactcccttgtcactcagcatacgtgcagttcactgagcttacgctctctgcgtgtctttcctccagggtctgcggtccactgtgaggagggaacggacttgtctcccgaaggggaagcctcccagaccacttgtcgggtcaatggtctagtgagaggataggtcaggaatggggaccctcaccccccaagcagcaatagtgccctctggccgcacatgtgagatggccgtggtgtctgggtgtggccttaggggctccatctgcaaggggcctctcgtcggcagccacagcaagggtggaggcttcaggtctccagcttaaatgccttcggagctgcaaatctcc

SEQ ID NO: 573148 - DNA, 382 bp, Homo sapiens
  misc_feature (125)..(125): n is a, c, g, or t
  misc_feature (222)..(222): n is a, c, g, or t
  misc_feature (236)..(237): n is a, c, g, or t
  misc_feature (314)..(314): n is a, c, g, or t
  misc_feature (333)..(333): n is a, c, g, or t
ggggatttatggccgcccccagtgttccgcgtccgggggtttgtgggagttgccttgacctgctgctccgcgcccgcggccccgccttctgccctcagcagcagacgctctgtcccgcccgggcngctctgcgaggctgcggctggtgagggaaccatggggtctgtgctcgcccggtgtttggagcctcttccatcaagtggtcctggttttggaggattnggagaagaagctgnntttgttgtagttgagcctggtgcttagcaggaaattcttgacaacaaagatgtggttgctcaacatgttcattttgntggacttggaaggtctgangatgctctcatcatttgtgaaattggagatgttttcaaggcccaaaacc

SEQ ID NO: 573149 - DNA, 1346 bp, Homo sapiens
  misc_feature (204)..(204): n is a, c, g, or t
  misc_feature (237)..(237): n is a, c, g, or t
  misc_feature (709)..(709): n is a, c, g, or t
  misc_feature (1346)..(1346): n is a, c, g, or t
ggagagaactagttctcgagttccctgacttgtagttcttttacatttggccatcctaaaccccctccatgatggttcttgcatcgctaactgcgggtccagaccgtgaacaaggggctctgatcggcggtaacttgcgtggatgctgctcagcagtctgctgggtgcactcgcacaagaggttctatggtgcgagtacgaacntacgctatagggcgatgggactgcgcagcgagngtgcctcggcgatataacggtgggacagcgatgttgtctttccgtaggccacaagtattgcgtaataacacatcctgtcgcagagtaatttcgctgggggacatatacggagcacgccgcaaggttgttgtgtgaagataacgcgggagctggggagggaactagggacgccatgaaagtgtctggggcgttcgcatggatggcacgctaacctcgcgcatattaagaccccaggagaaggcgagggaggtgcgcgtggcgtatagacgccacgcaaaggacagagagctcaggctcgcccgtgtgagcccaggagaaatggctgacaaaaaagcgaggaaactctacaacgaaaagcctggtgtgacggagagacctccaatggaagcccagtgactatgtgcgaccccgtggggtcccacaacgcgttagtggggcgtcggaaactaggctttatcgtgtggcgcatccncacgaggaaaaagcagccgcgtgcccccttagtgaaacagtgttggaacgccgtaggggaagcccctggttgttggtggggattcgtgggactcgtaggggtttgccaacggggaggcagtttgtggccgtaaacacacaaaagcggcgagggagaagtgctgcgaaaagaatgcgcggaatatcgcgctcgcgacttggaaaattcgctgagcaagctggaacggcgcacaacaccctagggggctgagggggggcgttcccgggtggctccatcaagatgaaaaactccttatgaaaataccccgctcagcacgttggggagagtagcacctaccggcggcagacactttttgccccccaaggggaaattaacccccgtgggggggctgccacccacggacgtttgcaggaaccacaaattatggaaaagcgccgccaaacaccaacggcgctagtggtgcgggcaacggaaaagtggtagttgggtacaccaagagccaataggcccccaaaaggtgtgggtgggcgcgtggccacagcaaacccccaagcgccaccattgggaaagtaaaggaccccccaggcgccgaccccccgtatgtaggaaaggttgggcaaaagcgggccaacaagan

SEQ ID NO: 573150 - DNA, 624 bp, Homo sapiens
ttctagaagcgtttgttggcagcgcacggttgtcgatgtcgacgctcccgcgcggttgcaatgtggaggaaatgttggtatcgcgtctgttcacagccattgtatgacacagacacggggttgcttctatgggcatgcacgagcctttcttcgcaccccctttgttatagtacttctatgtctccccacctatactagtcttactcgacgcggtatgctctattgatagtgggcaccccggatagatgattttaggggtgatatattcatcaaatccacctatcgagggacatagtaatcgaagaccccgcttctctcggaagtgtgtgtctctgatttatcgcgatggattcgttcttcctctacgagagagtcgtttctattggtatagctctcgatagatcacctctatcgatttgtgcgccactctctcccacgagattatttcttgtcgcgcaccgcgcacgagtaacttcctcttcattataagcactcttttgtatttcctccgtctcataatgaatcctctcaatcccacattcgtattactcgacttcccaccactgacgcctaaaataaaaaatttcccacaactgtctgtatctcatcaaaagaacaagaaaa

SEQ ID NO: 573151 - DNA, 186 bp, Homo sapiens
caagtcgttcactagtatcacagtcgtttgaacattcgtttcaccaatccactataccaacatgaagttcctttccgtcctcgctttgggtggtgccgtctccgccgttgcgctccctggcgacgattggaagacatggcagtcctgcgcaaaagagacacaatatgtcaccgtcaccgtcacccc

SEQ ID NO: 573152 - DNA, 1115 bp, Homo sapiens
  misc_feature (4)..(4): n is a, c, g, or t
  misc_feature (244)..(244): n is a, c, g, or t
  misc_feature (269)..(269): n is a, c, g, or t
  misc_feature (326)..(326): n is a, c, g, or t
  misc_feature (349)..(349): n is a, c, g, or t
  misc_feature (369)..(369): n is a, c, g, or t
  misc_feature (439)..(439): n is a, c, g, or t
  misc_feature (532)..(532): n is a, c, g, or t
  misc_feature (568)..(568): n is a, c, g, or t
  misc_feature (570)..(570): n is a, c, g, or t
  misc_feature (626)..(626): n is a, c, g, or t
  misc_feature (636)..(636): n is a, c, g, or t
  misc_feature (681)..(681): n is a, c, g, or t
  misc_feature (686)..(686): n is a, c, g, or t
  misc_feature (715)..(715): n is a, c, g, or t
  misc_feature (756)..(756): n is a, c, g, or t
  misc_feature (798)..(798): n is a, c, g, or t
  misc_feature (873)..(873): n is a, c, g, or t
  misc_feature (928)..(928): n is a, c, g, or t
  misc_feature (941)..(941): n is a, c, g, or t
  misc_feature (953)..(953): n is a, c, g, or t
  misc_feature (966)..(966): n is a, c, g, or t
  misc_feature (983)..(983): n is a, c, g, or t
  misc_feature (994)..(994): n is a, c, g, or t
  misc_feature (997)..(997): n is a, c, g, or t
  misc_feature (1005)..(1005): n is a, c, g, or t
  misc_feature (1032)..(1032): n is a, c, g, or t
  misc_feature (1038)..(1038): n is a, c, g, or t
  misc_feature (1041)..(1041): n is a, c, g, or t
  misc_feature (1045)..(1045): n is a, c, g, or t
  misc_feature (1050)..(1050): n is a, c, g, or t
  misc_feature (1053)..(1053): n is a, c, g, or t
  misc_feature (1098)..(1098): n is a, c, g, or t
tagngggtaaaaccatttttattaactgaccaaagcacatcattttgttttctgatttgaggtaaaatcataaaacacagttcacaagaaaatacaatgactatttaaccacaattacaagtttgaaatctcactaggtgttcatatacttttacaaattcatacaactgtatagtctacttaagcttagtgttaaccaaaagagcaatatcaaagacctagacacttgactactacttttgcngtgggtatagttttataacaacagnataactgttaccttatgaatatactttactttaaaaaccacttgactagcgactgtnctgtttcctcgtggttcaggggngtgcatgaaggctcttaggngagcaaacacctgttcctattctgtatgtccctccctcatttcaaatgagagtgaccaattgagtaaaanaaccaaataaccattgccccaccatgaacatggggcttgggaagacagtcctacaatcttcatcatatatttaggtttttaggccagccagcnctttttttccaaagctttcttttgaatgttcagatncnattttaatcctaactatagactactgtgtttgtgagggtgtctgagtgtctatgtnagggcaaggncaacagttcagttcagaaacacagaaaatatgcttttttgcagcngagcnctgttttgagatttcattttgttactggncagcgcttaatccataccaaagtctttggaacactgcaganttgctttagaggtagataaaacagaaatcatgcagttaagtnaattgagaaaaaaaaagggatttgttgtctttacagaacatcatgactaaaagttgatcctttgctcttggtgcncatttaagatttttacctgttttggggaatccccagtcttccttgtctctcaggnaaaacacatttanattcatcctgtnctaactacagatnggagaaaaacagttttnacatgtgtatntcngcactgcngttcactttctgggtttgtggcacacnaacacntcntgcnttctnagnagttattttttttagtgtcactagtggtgttatttaaacactttngccgtgcccacacttcc

SEQ ID NO: 573153 - DNA, 382 bp, Homo sapiens
actctcatggatgtgacacaggcaagtattatgcatatttttagaaataaagtactttattagaactacagatctccactctagtggtcctatcatagaattcattatctatctatctatctatctatctatctatctatctatctatcttgagatggagtctcactttgttgcccaggctgggagtgcagtggcgtgatcttggctcactgcaacctctgcctcccgagttcaagtgattctcctgcttcagcctcccgagtagctgggattacagatgcccaccaccatacctggctaatttttgtatttttaacagagacagggtttcaccatgttggccaggctggtctcgaactcctgacctcaggtgattctcaca

SEQ ID NO: 573154 - DNA, 356 bp, Homo sapiens
  misc_feature (30)..(32): n is a, c, g, or t
gacccagaggcaaggaaagccagtagcgtnnnacctctggcctcctatgtggttcattccactttagcaaactctttgctggggctgctagctagagtcccactggggaaacgagagcttgatccctagtcctcagactccaaagctcgtgctccttcaaatacaccagtgggtctaatcccctgtgattagaggacttagacaatttcatcctacctacctgggcatgagaatatagtggagaagtggatgcctacaagaatctctggagcaaatgttaggtaaacaaaaattggaccaaagacccacttcaattgaaccaacatggtctgcatgaattagatcagattttggct

SEQ ID NO: 573155 - DNA, 870 bp, Homo sapiens
gatggctgtgaggttcggtgctggtgccgggtaagtgggagaggcagaagtgcctgaataaatataagctcagaggtaaagggcaaggtcacagctaggagtccaagcattggtgatgtgtggctcgtaatatcccaaggtgagcccgtggtagcagtcagaacgcaggacattatgggataacgatagtgtagacgaaacagtttcattctatatccgtgcactggttggcacctaacattctctcggttgatgagatcatgcgagctggaatcttctctgaagaaggttgaattgaagcttcctctgtatctgagtcttgaagactctgcaaagtgatcctgaagaatacagctgtggaattttgtccaagcttcaaatgagtttcaagggaattttcccatgtgaaaaaaggagagaacactggcatctgttgaaattcggaagttctgaaattataattacagtatttgttaaaaattgcactgaagtgtacacagataaagcaggtctttcacccagtgaacaggatgtttgctttagcagcagtgacataaaattccatgttaaataagcatatattactaccttattaaatattccttgaaaaagcagattttaatggtttaattttatgtggacatatgtgaattattcagagtacctattgtaagcatctggtttaaaattttatggtaatataaataaggttagtattaaaattggagcatccggtagggaaattctgagaaatattgggcaggggggttaagcttgaaaagttgggaaaggccccacaagttgggaggggaagggacaaagagggtgaaacggggggtgggaaggcggaaggaaaaatgggggataaaa

SEQ ID NO: 573156 - DNA, 685 bp, Homo sapiens
ggccaacacggagaggacggggaccccggatcgactacccagacagagccggtgaatgggtttgtggtgaccatggatgatgatatcgccgcgctcgtcgtcgacaacggctccggcatagtgcaatggccagggctatctgcaggtgctgacagatagccaccaccagagagtcgtcatttaccacactcccagacagatagaagagcagccacacaatgtacccaagaggctgtagactagagttggggacattgtgagtccaagaaaaggacttaccatagtagtaggagcgaccggaagagcaccaagaagcaaaggaagaagtgcatcacatcaagccacttgtaaaagttaaccaccaatacaggaagccaccgggcagctcaggttaaaccgcaaacttgtgagaacaggagcatagggaatgaacacacatcttagagcgaccccagcaccattaacgttaacaaattgaagacccttgagcgatgtctggggcatcccccggaagcgtgtagtccatctacccggaaggcactgaagttgagacaccgcatagaacaccccccacgtggaaacacacccaagaggggaccaagaaccggagggagaaaaaggaattggaacaccctaaggaagtccatggattatgcagagaagcttacaaaaggtagcaccccag

SEQ ID NO: 573157 - DNA, 456 bp, Homo sapiens
  misc_feature (221)..(221): n is a, c, g, or t
ctgtttggagagaacaataacattaatagccaagatcaacatgtacctgacatcacgcgtcctgtacgccttgtgccgcctgggtgtggagaagggctatatccctgcgctcaagtgggacccgttccccttgcacactgcggtgatttgggggctcgtgctgtggctttttgagtaccaccggcccactctgcagccctccctacagtcctccatgaccntactctacgaggacagcaacgtgtggcacgacctctcagacttcctcatcttcaacaagagccacccctccaagtaacacagtccaaggtgcttcaggaactcctccgcccagacagcttccaggcagcagcccaccttccaggcagctgctcagggtatggttctgttggcataccctcgtggaggagcctgccttctcaaagtcataatcctcacactccaacttgtattaac

SEQ ID NO: 573158 - DNA, 179 bp, Homo sapiens
tgtcacgcaccagccaacttggggtgcaaaaagacatgagcgctcctcttactcgggagcaagtcagacacaggtgacagggtcaggaagatgacgctacagacaccaagtcctacgccagaccttccagccctggaaggctcatgatgtgcaggctcttgacacccaagtgcttgccc

SEQ ID NO: 573159 - DNA, 569 bp, Homo sapiens
  misc_feature (569)..(569): n is a, c, g, or t
tttttaaggttcatccgagcattttggttacaaatagggagatagttggtattaagattaggattgctgtgaagtttattacggatgctacttgtccaatgatggaaaaaggggagcttactggctgtcctccgattcaggttagaatgagggggtctgtggctaggagtcaataaagcgattggcttagtgggcgaaaaattatgctttgttggttggatatatgggggatggggattattgcgaggatgaggatggatagttctttggcaaggacgccttatatttttgtaagggcccctcggagaattgttcacgctgataggaagagtcaatctggactcgttgtgggaggggactttaaaggtttgctatgtctaagttattttttaaacaacacaaaattaaagattaccccaaattcttattagaaaaagagacccactacctggatgcccttaggatcctccgccgtttctaaaacttttttttcccttagaaaaaaaggagaaaatctggctttttttccggtctggggaacaatctaaggcgttctctcatttagaggn

SEQ ID NO: 573160 - DNA, 655 bp, Homo sapiens
gttcacagtgaggagggattccctgactttgacacacatggtcaccttgggacaaacagccttgtggtatgagagaaaaacccaattcgtttttatgtcctctgctcccttctccatctttcagcatagactataatcccttgaagcccagacatctgtctgggacctgacccctagtcattggttaccagtgtgtcaggcaatctggacttcccagtagatgccactgagatggagaccgtgtcagaaagtagcagtggttccatttctagattgtggatcttccgtataaattctgccattttcatttcacttcctgaaagtcagggtacgggatgagagaagttgataaacaacgatgctaaatgtgaaatgtccagcctcactctaaacttgccctgttcagagcatcagatgaacacttcattgggttctataggtggctttctgattgctggtagatccattgaagcacggagtcctgagagtcgttgtatactgtgtaacgagtggtctggccatgtcctgctgaaataccatgattgtttatggcaaaggtctcttttacaaaagctggatacaggatggttgggaagaaagccaaacccatgggtaaagtaaagggggggcgcaaaaagattcccccggaagggcc

SEQ ID NO: 573161 - DNA, 272 bp, Homo sapiens
tgagacagagtctcgctctgtcacccatgctagagtgcagtggtgtgatctcagcccactgcaacctccatctcatgggcccaggcgatcctcccgcctcagcctcccaagcagctgagattaccatgccaccatgcccagcctggccaacatggctaaaaccccctttactaaaaattcaaaaacttgttgggtgtggtggtggatgccctttacccccccttctcctgaggttgtggcccggactttctcccttgcccttgacgtgtctg

SEQ ID NO: 573162 - DNA, 266 bp, Homo sapiens
aagatcctgctctgggaggtcccggcagtgcctctgtatgaacagcgttagtaacagtgaccttgacgatggggcattcgctgttctacctcaggcatcaactctctaaagcactgagccatgacgaggccaggggaatggaggaccatcccgcacgcactctgtacccagaggtccaggtcatgccgtaagacacaccccctctgcacctcagttcctgatttataaaacaatggccattcctgttccacttgcttgttccgctg

SEQ ID NO: 573163 - DNA, 339 bp, Homo sapiens
tgcccatgtgccaaagacaaaacttccagacaaattctgatgccatccagtttagttcttacaaactgcatattaaaaaaaaaaaaaaaaatcttcaaggtcctaaaggtgatgtgctcagggcgaagcatataagagcgggacgtgacatttatgtccttgaaaagcctcgattatccaggtcctttacctggtaatatcctgaccagccaatggttctgggggtatatgcttcctccaggacatcaagctcaaagtctttattcccaatctcagcatttgggacagggtcaaagccgggaggacgctgggattctggtgtaaacctggtccaaaggc

SEQ ID NO: 573164 - DNA, 140 bp, Homo sapiens
agacacgatatttattttgaagttccaaatgacattagcagaattgggattataatgaaaacatgacctgagactggggtgtttctggggttctaaaacactttactagatcatcctccccctacagtagacgcttatgc

SEQ ID NO: 573165 - DNA, 252 bp, Homo sapiens
acaggtcgacagcttcctgatcttttacacaccacagctcagatgagaggattctttcccagggagagcaagagaatcaggaaatgaggctggagaaagagaggggctaggtcatggagggtctcacattagagtgtggaaacttcacacgagtggtcccaccttgggcatcccacgtaactactctctgtcccagcttccctactggtgaaataaagggctgatgtagggatggactgagatagtgtgtgc

SEQ ID NO: 573166 - DNA, 224 bp, Homo sapiens
aggaggaagaagaagaagaggaagatcaggactattacctaggaggcttgagacctgagcctgagaattgatgtctaccgagaacgaagaaatactggaagcatacgatgaggactaagataaagagctgtatcctgacattcacccgcctccttccttgcctccttccagggcagttcgacctgcccccctagtgccgaaagagctttacacgtcgcatcttt

SEQ ID NO: 573167 - DNA, 454 bp, Homo sapiens
tgagggaagaaagatgcatagggaatgttgcatgtggttatttctatttctctcaagtgcacattatccatcaagaagatttaaatcattttgaaatattaatataatgatcaaaaattaacttttatacatgttattaggcagaacccacagaaaacaataaagcacgagagaaaagaggatggcagtttacccaggaaacataggttgtgcaaagctttgcaatgatactttcaattcagagcaatgaagaacagaatgctgttttcccataatgagggctttcaattttcattagctttccaggactccaaaaattttttcaagacccggtagggttcagcaaaggccattgccaattttgaaaaggtttgccaggggaaaataaaggttcagttacccaaattacgttgttgacccagggccagaaataaaatctgatggcccaactcca

SEQ ID NO: 573168 - DNA, 578 bp, Homo sapiens
  misc_feature (386)..(386): n is a, c, g, or t
tgaataaggattacagaatgacagaggaacagtgcataacaatttaagacccaaagaattggtgtcaggctggtgcagcggtaaatattgttcagtgcactggattctgttccagagaaggacaatctgtgtggttcccaaggtaatcatttcccacccctcaattccattcctttccttttttctcctggtctctctctctgttcgctggcttctccacactctttcactcccatatcaaagccttcaaactctgagtaacagcccttatgatgtcattagactcccctttgctgacagcacattgggctgaagaagctatgcactcctgagttcatccctttggatggatcacaagacaactcttgtgtgacatcactttgaanactgggggggaacaagtttatttctctgaagtgcgcacaaaaaccacaactaacaaaactcacaaattcctttcagtcaaaaaatggaaactggcacgtgtaaaaattccattttagctaaggtcgcgaaagtaaaatataccaggagactgaagtaatatttaaacctattagtttacccataattgctca

SEQ ID NO: 573169 - DNA, 444 bp, Homo sapiens
  misc_feature (251)..(251): n is a, c, g, or t
  misc_feature (329)..(329): n is a, c, g, or t
aaattggggaacacattgggggcgggggttcccttggttgccccgcggtgggaggagtgggcctttaaaagtgtggtatcctctagggggcggggggggggttttgcccccagggatggtgtggttttgtgggtcggggggttccaggatttcccccccggaaggttccttatttggggtttcgggggggggcccagggaggggccccccccttttgttgggccaagataatgggggggggcacccagggnttggaaaaagggggccccttttttctgaggggtggggccaggggcccttcgggggggctttttaaaaaaaaacctttnccgggtggggggggaaacccccccaggttaaggggttgggggtttgggggggggggggggggcccggtttttgggggggggggggggcccccccccgggataaattccggggtcc

SEQ ID NO: 573170 - DNA, 561 bp, Homo sapiens
  misc_feature (168)..(168): n is a, c, g, or t
  misc_feature (203)..(203): n is a, c, g, or t
  misc_feature (212)..(212): n is a, c, g, or t
  misc_feature (216)..(216): n is a, c, g, or t
  misc_feature (224)..(224): n is a, c, g, or t
  misc_feature (231)..(231): n is a, c, g, or t
  misc_feature (236)..(237): n is a, c, g, or t
  misc_feature (244)..(244): n is a, c, g, or t
  misc_feature (247)..(247): n is a, c, g, or t
  misc_feature (264)..(264): n is a, c, g, or t
  misc_feature (276)..(276): n is a, c, g, or t
  misc_feature (282)..(282): n is a, c, g, or t
  misc_feature (296)..(296): n is a, c, g, or t
  misc_feature (305)..(305): n is a, c, g, or t
  misc_feature (307)..(307): n is a, c, g, or t
  misc_feature (318)..(318): n is a, c, g, or t
  misc_feature (329)..(329): n is a, c, g, or t
  misc_feature (332)..(332): n is a, c, g, or t
  misc_feature (334)..(334): n is a, c, g, or t
  misc_feature (340)..(340): n is a, c, g, or t
  misc_feature (343)..(343): n is a, c, g, or t
  misc_feature (346)..(346): n is a, c, g, or t
  misc_feature (350)..(351): n is a, c, g, or t
  misc_feature (425)..(425): n is a, c, g, or t
  misc_feature (452)..(452): n is a, c, g, or t
  misc_feature (460)..(460): n is a, c, g, or t
gaattccgatacctgagaatgaggcctggaacgaattctccctgacgacctgctgccaacgtcatgctctactggacaacaggcaccatcatctcctcccagcattctacaaggagaacctgggacagggctgatgacccagaagcatgagcggatgaaggtctatgntgccaatggcttctctgcctttccttttaatgtantgcaccgcntganaagtgggngaggttnaaganncaaagtnatntcctattcctacatggntcgtggggccantttgcngcctttgaggagcnggagtgctngnccaggacatcngcagttctgtnggngngggagnggnaangatnnacccttttccccccgcctgccacctccccccacaagtgccctccaggctttttttggggaagataccccttttntgaggaatgagtttgcctccgtccccngcccatgntgggagcccacgctcaccccctcacccctccaagctcactccccaacccccaactccgtgtggtaagcaacatggctttgatgataaacgactttactcta

SEQ ID NO: 573171 - DNA, 163 bp, Homo sapiens
gctatgatcatactagacaatctttttaaccatttatcatgccaacaatcacttcttaaaaatcaatgttgtggatatatatcattatatatttgtctaaacccttagaatgtacaacacgaatagtgaaccctaaggtaaaccggtaatatctatgctgctg

SEQ ID NO: 573172 - DNA, 861 bp, Homo sapiens
  misc_feature (109)..(109): n is a, c, g, or t
  misc_feature (128)..(128): n is a, c, g, or t
  misc_feature (130)..(130): n is a, c, g, or t
  misc_feature (146)..(146): n is a, c, g, or t
  misc_feature (187)..(187): n is a, c, g, or t
  misc_feature (190)..(190): n is a, c, g, or t
  misc_feature (196)..(196): n is a, c, g, or t
  misc_feature (198)..(198): n is a, c, g, or t
  misc_feature (205)..(205): n is a, c, g, or t
  misc_feature (212)..(212): n is a, c, g, or t
  misc_feature (232)..(232): n is a, c, g, or t
  misc_feature (263)..(263): n is a, c, g, or t
  misc_feature (269)..(269): n is a, c, g, or t
  misc_feature (277)..(277): n is a, c, g, or t
  misc_feature (286)..(286): n is a, c, g, or t
  misc_feature (292)..(292): n is a, c, g, or t
  misc_feature (307)..(308): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (340)..(340): n is a, c, g, or t
  misc_feature (352)..(352): n is a, c, g, or t
  misc_feature (356)..(356): n is a, c, g, or t
  misc_feature (360)..(360): n is a, c, g, or t
  misc_feature (387)..(387): n is a, c, g, or t
  misc_feature (391)..(391): n is a, c, g, or t
  misc_feature (400)..(400): n is a, c, g, or t
  misc_feature (412)..(412): n is a, c, g, or t
  misc_feature (430)..(430): n is a, c, g, or t
  misc_feature (432)..(432): n is a, c, g, or t
  misc_feature (440)..(440): n is a, c, g, or t
  misc_feature (445)..(446): n is a, c, g, or t
  misc_feature (457)..(457): n is a, c, g, or t
  misc_feature (496)..(496): n is a, c, g, or t
  misc_feature (498)..(498): n is a, c, g, or t
  misc_feature (522)..(522): n is a, c, g, or t
  misc_feature (529)..(529): n is a, c, g, or t
  misc_feature (606)..(607): n is a, c, g, or t
  misc_feature (618)..(618): n is a, c, g, or t
  misc_feature (620)..(620): n is a, c, g, or t
  misc_feature (835)..(835): n is a, c, g, or t
gggccaggggtctccggacagcatgagcgtgggcttcatcggcgctggccagctggcttttgccctggccaagggcttcacagcagcaggcgtcttggctgcccacaanataatggctagctccccananatggacctggccacantttctgctctcaggaagatgggggtgaagttgacaccccanaanaaggananggtgcancacagtnatgtgctcttcctggctgtnaagccacacatcatccccttcatcctggatnaaatangcgccganattgagganaaaaanattgtggtgtcctgnncggccggcgtcaccatcancnccattnaaaanaagctgtcaacntttnggcnagcccccagggtcatccgctgcatgancaanactccagtngtggtgcggganggggccaccgtgtatgcnanaggcacgnacgcnnaggtggaggangggaggctcatggagcagctgctgagcagcgtgggcttntncacggaggtggaaaaagacctgantaaagcngtcacggggctcagtggcagcagcaccgcctacacattcacagccctggatgccctggctgatgggggtgtgaagannggacttccaangngcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcggcaaggattgacacgtcctgcctgaccancatcctgccaccaccttctcttctct

SEQ ID NO: 573173 - DNA, 1498 bp, Homo sapiens
  misc_feature (330)..(330): n is a, c, g, or t
  misc_feature (380)..(380): n is a, c, g, or t
tatgggcattggtttcttttttggaaaatatttgtcttttgtggtttataaacacaagcatttggtggcatgtggcaaaaactttgactgtagttcacattctgtgtatattctgtgcgtggaatatactttattataaatgtggattagagataactctccttataggccagtgtgttcagcattgtgggtgtcattcccagagacctatacactttggtgtctccacaatttcaagagtgtatgaaagaagagtctccacgagttgagaacagaagtgtggtgtgtggtcacttcactctccgagaacaagcgacagctgtgtccaantgtgtgcggtgagagcaaaatatctctcgagagtctgtggggttacgcgncctgtgatatctcccgagatttgagccccgaggtgtaagaagtgtgtccgcggttcacagagacaccccgagacaagagaacacgagcgttagtgtgagagtatagaattagtggacgtctctcgagacctctctctcccagagagtcttgtggcgtgaaactcaagtgaaaagagagctgtgtggcgcgagagaaatagcccagcgtggatctctcccgcgaatatagaattagagagacaagagtctccgagagagagaactcttctccaggcgagagagtgtgcaacaccgtgtgtaggctattctcacggggaagagggaaagaggggccaatgtggaccggtggggaacccagagacagaaaaaatcctcccgaggaggcggaacaggtgggtgtctccattctctccacggtgtgtccacaacaagggttttacgcggggaaaattttctcccgcgatatattttcttccagtgtgttacaccgcgtggtgttcaccaaattaggggcccccagaagggggagaaaaaaaaacgccacgcttatcatataccacagatgatcggttgctggtacacacatttcgggacgacactatgaaacaggctcttggcgtcggacacaccaaggttgctccaccaggggttaacccccttgtagttaggggttcgccaaaagaacccggaaagaaggaccaacacacacacggggggattcatctggaggggatctttcttttccaccccatgaaaagtaatatggccactttagttgcaacggccatcttttgggggaccttccccaaggattatttttcccaccccaacggaaacggaacaagacatcacaatggcggcccaagagaaggtatgtgggcacaccaagtgttcgccccaagagggagattttcgggagacagcaaggtttcctctagtgtgacccacaaccaagagttaacatcatgtgagcaccccagcgaccgaccaaacgaaaaaatttttcttcgggagaacaatttctccggagggaggacgaagagggcgggagacgacacaacgaatcacgacaccgatgacatgcagcaacaagaagcaacaacaaacaacatgcacaa

SEQ ID NO: 573174 - DNA, 610 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggacacaaaaaaacaaaaaaaaaaaaaaccaaggacacaaacaaacaaaaaaaaacaacataataagggcggtaactttccccctcaaagggccaaaaaaaaaaaacaaaaaaaaacaaatcgtggtgggcggcgcgcggcccccggcggcccacggagaaaaaacttcttcacaacacctattcgtgggtgggcggcggggggcgcccccgttgtggtgtggtgagaaaacgtgggcgcccaaaagggggtccccagagaaggaaaaatccgcggggccgagaccacaacgggcggcgggggttctccctccccaattaataaaaaaaagcgccgcggggggacacacccagggcggttgctggtagaaacaaacccgcggagagggggatgcgcgaggcgagcacgaatcgcggggcgactcatcacaccagggggggacctcccaggaggcgaacacgcaaatataaaaaatagtgctcc

SEQ ID NO: 573175 - DNA, 690 bp, Homo sapiens
cgagcagagggaaggggaagaggtcggggagcgagggcgggagcggtcgcggtcgcgatcgagcaagcaagcgggcgagaggacgccctcccctgtgcctccagtgcgccgcttccctcgccgccgccccgccagcatgcccggcgtggcccgcctgccgctgctgctcgggctgctgctgctcccgcgtcccggccggccgctggacttggccgactacacctattacctggcggaggaggacgaattcggaggcccccttcaacttaccaaggaacccctgtgccaaggcgggtgggcctttccttgtgcgcggaccttttgccccttgggaccggaaaggaaggggacccttgagtggggcccttccccagggttccaggccaagggccttggttgggaattcttcaaggaaccggggcaaccaacaaggctccgttaaggggttccttcccaattcaaaaaggccttgccaaggttccccggggaaaaaacaactttcttaacccccccaaggctttgccaaggaaggccacccagccggggcaaggccttcaaggaggggggaggccttgttggggacgaattggaggaagggtaggatcccctgtagcccgggcgggggccgggcgaacgttccctgaaccaggaggcgttgttgttggccccggattggggtcatccccctta

SEQ ID NO: 573176 - DNA, 382 bp, Homo sapiens
ccattttactctttttattctgctcattaatgatctgaaaaaaaaaaatggggaaaaggggattcccccacaaggctccaaaaaaccaaaagtgcaaatcagcccatttcactttcactgtctgaaatagggtctttaaaacccaggatccaagggtggaatgtacctatttggactcgatttgcttccggaccttttccaaagcctttttgtccaattgtccctgaccaatgatgaccagacaagccaaaatcagggccacacacacgaaagcccctttgaacttccaaaataagcgttgttccatcaaagctgagcggcagtttttgaactcatttcttttaaatgacctgcatgggattttctctacatatcctggggg

SEQ ID NO: 573177 - DNA, 268 bp, Homo sapiens
  misc_feature (3)..(3): n is a, c, g, or t
  misc_feature (11)..(12): n is a, c, g, or t
  misc_feature (30)..(31): n is a, c, g, or t
  misc_feature (36)..(36): n is a, c, g, or t
  misc_feature (53)..(53): n is a, c, g, or t
  misc_feature (81)..(81): n is a, c, g, or t
  misc_feature (106)..(106): n is a, c, g, or t
  misc_feature (162)..(162): n is a, c, g, or t
  misc_feature (182)..(182): n is a, c, g, or t
  misc_feature (246)..(246): n is a, c, g, or t
  misc_feature (257)..(257): n is a, c, g, or t
ttncaaagacnntacacgggcagagtcacnngggtntatcatcaaactagagnaagaacggggaggtagtgaacaagccgntgatgggaggaagtctttctaatgngcggggagatgttatcgattattcatcatccggggtttccaccaacgatgcttccnccccggatcctatcactgangaagatgaaaaatcagatcagtcaggcagtaagcttctcccggcaaggaatcttccgaacggtnaagctcttccngacagatttga

SEQ ID NO: 573178 - DNA, 384 bp, Homo sapiens
cgtccggctgtgctctactattcgggtagttaattcctcgagagagggacaccgaactgatctatgggagcttgttgtgcctcgctctctgcaggccattccagaggcgtatgcttcgatgcacccatggcttccacaggaacaatcaggcccatccagagacacaacaaggtggcccagttctgcagcacagaaggagcttccgtggatcaattcatgctgatggataattccaccaccgattcctacagcgagggatagaaatcactgagggtgctttacctgaaacagaaaactatgatatcacaacgcctcatctatttagcagagcttaggcatgtgagggtctatagatacttctttagacagctgaagcccactagg

SEQ ID NO: 573179 - DNA, 90 bp, Homo sapiens
tgtgcgagagtcccgcccccgtccacttactatcgttcagggagttatattgactactggggccagggaaccctggtcaccgtctcctct

SEQ ID NO: 573180 - DNA, 219 bp, Homo sapiens
agacggtccgcatcagtgtaaccagtgataacctgatctgtgtgtttaacagattattaccaagtgaaaaattcagactgattagcaattttaactaacatgctatataaaagtgtaaagtctgatgcggtgaaggcaatctagtgctatatatatacctcctcatgggtcttacttatgggcacggtgggattatgatgagtacctggaggggttaga

SEQ ID NO: 573181 - DNA, 309 bp, Homo sapiens
tcgagctcggtaccgacgctctctctgtggggcagcacagagagggggccactccatgtccgtggctgcccacacaccccaaattagctgaattctgcgtgtggcataggtgaggaaaaggaggctagatacgtgggactgtggcaatggcctcacataggaaacagggtcttcctggagatttggtgatggagatgtcaagcaggtggcctctggacgtcaccgttgccctgcatggtggccccagagcagcctctatgaatcaacctcgtttccaaaccatcagcccgcagtagctgagtgtccatg

SEQ ID NO: 573182 - DNA, 1347 bp, Homo sapiens
  misc_feature (17)..(17): n is a, c, g, or t
  misc_feature (122)..(122): n is a, c, g, or t
  misc_feature (130)..(130): n is a, c, g, or t
  misc_feature (145)..(145): n is a, c, g, or t
  misc_feature (255)..(255): n is a, c, g, or t
  misc_feature (257)..(257): n is a, c, g, or t
  misc_feature (263)..(263): n is a, c, g, or t
  misc_feature (288)..(288): n is a, c, g, or t
  misc_feature (292)..(292): n is a, c, g, or t
  misc_feature (328)..(328): n is a, c, g, or t
  misc_feature (330)..(330): n is a, c, g, or t
  misc_feature (332)..(332): n is a, c, g, or t
  misc_feature (334)..(334): n is a, c, g, or t
  misc_feature (366)..(366): n is a, c, g, or t
  misc_feature (397)..(397): n is a, c, g, or t
  misc_feature (404)..(404): n is a, c, g, or t
  misc_feature (408)..(408): n is a, c, g, or t
  misc_feature (420)..(422): n is a, c, g, or t
  misc_feature (428)..(428): n is a, c, g, or t
  misc_feature (434)..(434): n is a, c, g, or t
  misc_feature (438)..(438): n is a, c, g, or t
  misc_feature (442)..(442): n is a, c, g, or t
  misc_feature (457)..(457): n is a, c, g, or t
  misc_feature (459)..(459): n is a, c, g, or t
  misc_feature (466)..(467): n is a, c, g, or t
  misc_feature (491)..(491): n is a, c, g, or t
  misc_feature (496)..(496): n is a, c, g, or t
  misc_feature (498)..(498): n is a, c, g, or t
  misc_feature (529)..(529): n is a, c, g, or t
  misc_feature (544)..(544): n is a, c, g, or t
  misc_feature (576)..(576): n is a, c, g, or t
  misc_feature (583)..(583): n is a, c, g, or t
  misc_feature (655)..(655): n is a, c, g, or t
  misc_feature (657)..(657): n is a, c, g, or t
  misc_feature (667)..(667): n is a, c, g, or t
  misc_feature (674)..(677): n is a, c, g, or t
  misc_feature (782)..(782): n is a, c, g, or t
  misc_feature (893)..(893): n is a, c, g, or t
  misc_feature (1233)..(1233): n is a, c, g, or t
ctcgcccggccccgttngcgtctttccgctccccctggcttggcccctcgctgccggcgctctctcccgggcgctccttgctgctctcttcccgcgctctggccctgcctcccctccctgtnccgcgccntgtcgcgcgccgctntcctctctctcccgccgctctgctcccgtctccgccccgtcctgccggtcccgccccttcttctgcttcctctgggtccccccccctcccccggctcgcccttcccctgngnctgtcncccctccctccttgctctttcaagncacngatttgggttcattccatgatctgctccgtagagancnantntgcgcatgcaggagggagaggggcattctcanctctgcctgaacaggctgcagctggaggctnttcatcnggtncgtttcagcccnnncctgcnctcctntggntggntggtatctggggaanantcagggnnggttcgaatccattttgtccgtgnactcncntccccactgggccaccgtatgcagcttgaangccgagcccacttcnatgctatgttccaaccatcctcccccactacncgccctngcttctctccaaccagccatcgccttctgccaactccctagccttggcccacaccagatccttggagtgaantnggtaaagaanaaatggnnnntatgcaaagagccataggaactgggggccttccctggacagtgatcatgccaggcctggacctttaggcctgcctccccaggactccttagatcccactctttcnacagacttctgtgatcacagccctgcgggcaggggggctctccctccaccaactctcaaggctcctcagcctaagactatggctcatgagaaacactcaggcctgacctangcttgggagtcaaactgctcatattagtagcatatgtgttcacacgtggggtaaagcctaagtagaaggtactgggtgtatgtgtgaccacttgtgtaatgggtgtcatggagaactgaaaagggtatctgcatgaagggctccgtgtcatgactatgtccgaggatccaactattactgccgttctgaaacttcctcatttagggtaaccatcatgtatgcccacgtagggtgatagtaattcgtgagactgaagttgcttagagtacttctttgaccagaggaataccgactagagctacctcgtaccgactagaagcagtggctcagatcttacttngctcctgcttacgaagtattcccaatcactggtcatctgaccctagttgaagcactcctgaacagtcatgtgtttcaacaatcttcctttatatcaagtcgagagagtatactt

SEQ ID NO: 573183 - DNA, 2011 bp, Homo sapiens
cggcacgcgtgggtcgaccacgcgtccgcactatgcctatcatatagtaaaacccagcccatgacccctaacaggggccctctcagccctcctaatgacctccggacctagccatgtgatctcacttccactccataagctcctcatactaggcctactaaccaacacactaaccatataccaatgatggcgcgatgtaacacgagaaaagcacataccaaggccaccaacacccactgtccaaaaaggccttcgatacgggatcatcctatatattacctcagaagttattgtatcttcgcaggatttatctgagccttttaccactccagacatagcccataaccaccaactaggagtggcacatgggcccacaagaggcatacacccgcataaatcccctagaagtccaactcctaaacacatcagtattactcgcatcaggagtatcaatcacctgagctcaccatagtctaatagaaaacaaacgaaacacattaatacaagcactgcttataacaactttcactgggtactctattcgaccctcctacaagcctcagaggtaatatagagtctccctacaccatataccgacggcactataccgcatcaccatttatagtagacgcaggcttccaagagaattccggtagtaatgggcacaacatatactaagaaaatggataaacgacactataatttcgacttacctaccaactcaatgggaatcaaacggagcctgaacgggaatcggacaccgtcatgacgaaagcgaaggacacacagcaaacgcactaaaaagacaccacacaccaccatacagatggggcaacccatcgcgccacccacactataccgaacacaaacgagaaataaaaagacagcagtggacaatagcaggaatcacgccagacgcagacaatagctactagcaccatacacaaacgacagactacagcaacgcaccacaactagcgaaagcacagagaagcacgaaatcacgacgcagaagacagcaaaaaggaaacagacaacagaacagcaacaagaccacgacgacacggagacaagccagacacacacaagacaacaacactgagaacaaagaaacccacacaagaaagagacgcagcaaagagaacaagagacaaaaaagaacagcaagcagaaccaaaagaaggagcagaagaaagagaaacaaacgaaggacaaccaacacacaggacaaaggaaagagaacgaccaactagagaaaagcagagacacaaagcaaacacaagaaagcagacaaacacgaaacccacaccaccggacaggacaaaaataagaaagacgcgcgacaacgagaacaaggagacgcgacgagaaaggagacggacagaagagacgaaagaacggacagcaagagagacaggaagaagcgagacgagacgaatgacccaagaagagaagagcaagcgaaccaagcaaagcaaggagagagaagaagcagaaacaaacgagcagacaggggagcagacgacaaagcatcacagagagagccgcgacgcggagcaagcaacaagacgacagcgtgacggaagagcagggaagcagcgagcgaagagagacgaaagaagcagagagaacgagacacacgaccgagacaggcagaagagacagaacagaaccgacagcacgaacagaccgagagagagacagcgagccagaagcagacgagcacggcgactcaaacgagcacgggcgcaagcagaacacgaccacggcacacagagcaacaacacagcgagaagagaaccgaacagacgagacgcagcgacagggcacacgaagaggagccgacaacgagagaccgaaccgacacggagaatacgagacgacaagaaagagcaacgacaaacgaagcaacaaggaaagagaagacgaacaaaccaaaaacgcaagacagacgagagagagagaacaaacagacagacgcagagacaacagcagcgcagcagcagaacgc

SEQ ID NO: 573184 - DNA, 879 bp, Homo sapiens
gagtctaaggaaatcatggctctgaagtatcacgtctttccagtaccctgagttctctatagagtggcctaacacaggcagaatgggccagctacttgtctgcaatggtatcttcaagaataccctggcatcccttgtgactgaccgtcaagtctcttgggaaagcctggcatctcctcacataagacctctgaccaatgggagggtgcagcctgtgagaccatccaatcccaaataaaatgcaccccaataaaaatggacccaagaaatttatcgtcaagtaaaggtcccaaacaagtgaaagagattatgctcagaagatggttctcatcaccaagtagcctgtgttggatgctgtggagccttagtggagatttcagcatttcctaccttgtgcttagtttcagatatggatgatcacattgtgatgacttatatgagggcagatccaagagccagcaggtccaaaaaggcaacaaaccataagcagccagaccaaaaggccaggtcctgtgctatcacaggtcaccctctttaacagtcagaaaaccagcggagggcaaagaatcccatccctttcctgagtcatgctcaaaaatcaggcaccagtgctcaatcaaatcatagattcgagcaaagggctctccctgggcagaaactatggacgccagtgtggcactgtgcgaccttgaaagctgcaattccaggcagggtcaccagcccggaggcctggaagggtgctcccagcacggaggccgaaaaggaccccaaggcaaggctcaacgaacagagctcgggccagtagcaccaggaacacggcgggggagaccccggacaaacacagagagagcctatacgggaggagcacgggaacacgca

SEQ ID NO: 573185 - DNA, 264 bp, Homo sapiens
gggccccccccccccgggggtgggcccggccttggggtccccggaaaaaaaaaattttccccccgggcttagggggggggggggcgggcccccccccctttggcccaccccggggcgggggtcccttcccccctggggttggggggggcgggggccccccccccccccccgggggggattggggggggggccccttccctttttttttttttccgggggccaaaattggttttttttttaaaaaaactttttttttccccccga

SEQ ID NO: 573186 - DNA, 630 bp, Homo sapiens
acctgtgcttcccaggttcaaatgattctcctgcctcggcttcctgagtagctgggattacaggcacctgccaccacgcccagctaatttttatgtttttactagagacggggtttcatcactgttggccagctggtctcaaactcctgacctcaggtgatccacctgcctcggcctcccaaagtgctgggattacaggtgtgagccactgcgcctggcctccatgtgcatttgatgcatactgcatgcatttccagtgggactagctatgttaaatgtgcccagtagctatgtatggctggaggctatcatattggatagtctattagtagaaaaatatattaagacagccttggagatagctccttatgccgggacccagagtttggaacgatatatataaaaataattattatggtttcagttaacaacaggggactgtacaatgtagtgggttccaggttgagagtgctagaaagaaccatagctattgtatctaagattcagcgccctatccccatttttatcggtggagggatgtatgcttcaacaacatgtgtgtggtcacccagaggagtcactggcatcgtcaagactcaaaccgagtgatcttctggtacgtcgtttgtg

SEQ ID NO: 573187 - DNA, 140 bp, Homo sapiens
tgagtaacagccttcttcatccaccctcgtctcctaggaggttgccctcggctagacctggttcttgccaagtgggcattatcgaggagttcacaaaaaacaatagcctcatcatccccaccatcatagccaccatcact

SEQ ID NO: 573188 - DNA, 194 bp, Homo sapiens
ccctttactccccaacggatagcatttgtaaatactctaggtatctgtaacccctctgatgaagtctgtatagtgtgactaacccccaggcaggttggtttccattaatttttttttttttgaatgggatgtcctatggaaacctatttccccagagttttaaaaataaaaagggtattgttttgtcttctgta

SEQ ID NO: 573189 - DNA, 232 bp, Homo sapiens
tagtgactccccaaggaattaatttttacctagaaatccatgcctgagcaacatagtgaaagtccatctctacaaaaattacaaaaattagccaggtatggtgcctgtagtctcagctatttgggaggcagaagtgggaggattgctggagcctgggaggttgaggcagcagtgagctatgattgtacccctgcactccaacttgggcgacagcgcgaaacccagtcttaaa

SEQ ID NO: 573190 - DNA, 198 bp, Homo sapiens
cacaaggggaaactccacctctcggattcaaggcatcctcctggcttatactcctgagtaactgggacgacaggtgtgtgggaccacacacaggtaattttttttggaattttagtgtagacgaggtttcacctgttaatcatcaaggtcttgatctcctgacctcgtgtattacccgcctcattctcccaaatggca

SEQ ID NO: 573191 - DNA, 725 bp, Homo sapiens
tgggctctagcagggggtaaagggggtgctactagggtaaatacgggccctatttcaaagattttaaggggaattaattctaggacgatgggctaatgaaatccgggggttggctccacagatttcagagcattgaccggtagtatacccccggtcgtgtagcggtgaaaggtggttgggtttagacgtccgggaatggcatctgtttttaagcctaatgtggggacagctcatgagtgcaagacgtctggtgatgtaattattatacgaatgggggctcaatcgggagtactactcgatggtcaacgtcaaggagtcgcaggtcgccgggttctaggaataaggggggaagtatgtacggagttgaagcattagatccgccggagtcggggtactcgtaggtctcagtaccatggggggccaagtggattcggacgggtaagggagggatcgtgacctcgtcggtatgtaaaggatgcgtagcggcatggcgcagggcagatgagcgactaggatgatggcgggcacggatagcttcagacggttttctattctcctgagcgtctgacatggttcgtataaagtaagatatggcgcgacgagtgttacgcgaacgggcctacagggacatggaagccgtataggaacattgcattatgagggcgttgaccatgcaacggtgactaagctcctctatgatggcggaagttacgttttgtagacca

SEQ ID NO: 573192 - DNA, 183 bp, Homo sapiens
gcccgttagaatgacagtaccaaaagacagtaacatatgctgacgagattgcagaggcaagggaccgtttaacactgttagtgggatgtagacttgtacagccgttattgagaagagtattgaggttctgacaactaaaatagactacatatgattcagcagtccactactgggtatatatcc

SEQ ID NO: 573193 - DNA, 465 bp, Homo sapiens
caaataactttattcttaaatttaacaagctattattccatgtgcttcgcgatcagtggaatcaaaagggcgtggttacgcgcactggactcgtgcgagtcactagggaggtcacacatcgggtgtacgcaactttctgtgaattgttcacgaattatgactactacttactcacatgggtcaatgtgggacactgagacgataatttctggaacttccctaaaaatgggcaatttatccataggagttctatgcccatgctcgctagatagttattcaacggatgtttatctaggtgcgacatctattagatcaccatgtttccgagcttacacgttctcacccttcaagctgttaaggatcggatcctcagccccatctccagttgtttgagcattatacggggagtggtgtacagcgcgaactaatcttccatcctgcactttctaagaaataggagttctg

SEQ ID NO: 573194 - DNA, 403 bp, Homo sapiens
ttcttagaaagaggtcgcgtatcttttaatggattgagagaagcccattggtatccccgaatcatggagaaaagcaccagatacaatggacagtcacacttttaaaaatcaaacagtcactaccttcagcccacacctccacacccgcatctggcctccccaagggcggtcagtccgggtaaagtcaccctctccttctactcgggtattaccacgagattggaaattttaaacgcagaaaaaaaaagacgtcacgtaacaaataattgagtgggcgaacccagggaagcccttggactatgattcccaattttctgtccactccacactggcagagatacagggataacccaccatttgggtccccacgtataatccaagaactcatacaaaattttccaga

SEQ ID NO: 573195 - DNA, 163 bp, Homo sapiens
aggtatccccacaagccgggctatagtcttcaaagtcctgatcactttgtgtgagaaatgatccgggtcctccctggagcactggccatgcttcgaaaacgggcgatgacatgctcctggtataaagtgcaaagaagtatatatggggtgtgaatgctgtgtg

SEQ ID NO: 573196 - DNA, 193 bp, Homo sapiens
ttgtacgatgtgcggtagctgggggtatcatatagtcactcccggtttatggagtgttcttctactattaggacttttcgcttcgaagcgaaggcttctcacaatccatgaaaattattaatattacctgctgttcagagacaatgaatgaagcctacagggggtaccgcagctcgcaattccgtaaatcatg

SEQ ID NO: 573197 - DNA, 373 bp, Homo sapiens
agaggtaattacttcaaatatttaagggaaaatattaaagccacatggaaagagaatttggataggaaattctaatttcctgagattcagtaatcctgttgtatcctgcccctgtggttagctgaaaaaagttatcattcaaaggtctaatatccagaacctataaggaacttaaattaacaagcaaaaaaacaaataacctctttaaaaagtgggcaaagaacatgaatagacacttttcaaaagaagacatatacatggctaacagacatatgaaaaaatactcaactttactaataattagagaaatacatatcaaaactacagtgaaatgccctcttacatcagtcagaatgactattattaaaaagta

SEQ ID NO: 573198 - DNA, 788 bp, Homo sapiens
ataccttgggtaaatttgtgttaccaaaaaaaaaaaaaaaaagggaggtgtattgtcgacacacaaaaaaagcaaatcagggtggtaggcttaaggtacaattccaagggtcatttaccaacagcggggttttttttaatacttaaaaaaactttatgctacattattcatggccatttccatattggggggtgggcaactctaatacgagggaactcagggaaattgtcttccagccattgattggccattatttattttctaaaaggtttctaagatgacggttatcactatttggttaatctccatgctgactttggaaacgagggtactagtatccctttagcaagatggctaagttttccgtgggcgtaattcacaccaacggtgggtcctaacgggaaaggtaaaggctagggaccctaaattcagaatcatagtggccggcatatttggtaccagggtccgtgtgctttcggttccacagtggctgagtgacgaggtgagaagacattttttgggacatcttcctgtgggtggattagaagacacctttcttgtggtcttagggttagggagggatactacggatcctgggtgtatcctatctaaggtggcggccgtatacgcgagcaggacgacgggggctgtggtcttccggttttttccctaagggtgtttggcgcggtctttcctttcccttttgtgttgttgacctttttcttggtccaggaccttgcttctcgcttgccctctgtttttagccccccgttgcttcccgggtggtc

SEQ ID NO: 573199 - DNA, 230 bp, Homo sapiens
ggcttttagtccagaaggacctcatttttgcacctcttacttgaggagcaagaggagggaagggagaaagggatgttggaataagaggatgtggggcactgccatgggcaaggtcaaaaattagggctgtatttgacttgggccgggacccggggggccttcagcaggtgaaaattgttggttttttgttggaaagggggcgaagacattagcccaggaacttttacttc

SEQ ID NO: 573200 - DNA, 322 bp, Homo sapiens
actaagtattaattgtgttgtacatttgttcttcgcatatattaaagttgtgacccaaatgtgttaaagctcactctctcccatgtaaatttcccagaagttcttgagctcaaatgtatcctacatccagctgtagaaatttgtcagaaattgtctaaattgtgtatgtaattgtactgtctatctctagccactgcgctgaacagtacttgagtccccatatcatatggatttacccaaggaaatgtgtggcctttgttttgtattctttcagtgtagaagttcctgtgtcatatttaattaaacttgttcgtaaacttga

SEQ ID NO: 573201 - DNA, 498 bp, Homo sapiens
aatgcatatagacaatacagtatttagtaagctgtatacatacactaaattataagagattcaatattagagtttatatattgtatctttaaccactacagagtgcaactcaggttcttcacaacagattgaatattgagcagttctttaaagaaagagggggcagaaaaaaagcccaagtgaataacacattgaaactattccccttcgaaaatgaattctaaaatgatgtggaatgtgaaataaggttttaacatacggtgatccaagtttatagttagaaacaaaaagaagtccttcatgaaataaaggttacaagaacacgttgcctgttttcccccattataaactgagaaggtgggtaaagacgatgtttacagtacgaaaataggtgactacaggatcagcgcttcatctcacatgctgtacccaaagccaggctgtggctgtccatacggtggtgcggtataaccataaccaaaaggaccatgtagagaa

SEQ ID NO: 573202 - DNA, 1172 bp, Homo sapiens
  misc_feature (755)..(755): n is a, c, g, or t
ttgtcaaggagctgccccccaggggttctatcggaggtccccctttgcccgcggcagtcttggggggagctgttgcacggaatgttcccaaccccagtgccagcggattcccccggtgattcgggggatgtattctcccccatggggcctctctgcctcaggagggttttttcccccaaaggctcgtggtgtaccgtaggtgcgctctcttggcggagatttgccctctccttgcgttcaaaaggtccgacaccccggaatttgggcctccccgttggacccggggtgtctttcttttcacgggcgggtgccacaagagtggggcccccaggggccccaatttggttttgggggccgctccactcgggtgttttctccatccgcgttccgggcgggggagacctcgtcgaggaagttaccccctggcatgtcgcgctggcacccccgcgtttttcggggcgccttttggcccccttggggcaccgatttcacaagagctcgggtggcgccccctcttgggccccagtttttcgacgccgcccttttgggcccccacggtagtcaccccctcccggctttccctttccccgagatttgtggaagagagggagcctctgggggcccacccaagggcttctcaaattttttgcccggcacggaaactttccacgggaaaccccccccttgggccccaagtataagcttctgttgggcacagggcacaaagccccttttcgggtgtcacaccccttgtnggcgtacacaccacagagacgccctctcgcccctctcctgttttacacagctctcacaggcacagctctgaaggcgcccccgagcccaccaaatttgcacggggggtctccctgcgtatagttatgcggccccaccccgcccggtggagagttctgtatcccgcgttctccttatgaacacttttcaccagagaagcccaagcgtcccctggaggcgccctgttggcaagcttctagctttgccgtcgctgtaattgggccccagtcacttgttttttctcgccctccaccttttccccccagtgttctagagttcactgtgagcccttcgtgtcactttcccgcgggtggccacccgggttagattccccgcgtggttttgttggtccaaattaaaagcctcagtgacccctgaga

SEQ ID NO: 573203 - DNA, 182 bp, Homo sapiens
gtcaagatagcagcagcagtgtgtcagggctcaagacaccaccccctccagcttactggggcccagtgagcctctcccttgctacaggtggtgtgggtggtccatgctcagccagggtagtgtggttggtatcacggtctatgtcacgcctacactacaggtgtgaacttgcctactgtggc

SEQ ID NO: 573204 - DNA, 331 bp, Homo sapiens
  misc_feature (331)..(331): n is a, c, g, or t
tgtggagacggggtctgattttacatagcttcatagattggttcaatcaggtatgacatttacatagtatgtggggaaggctggtcgccccaccctaatcttcttatgcaaatgagctttccagttgatcagtgtcttgtctgcccctttacagtacatgtgactggaagagaatggaagatggagctgccatcttgaaaatgtctagtcctgagccagcatggtggttcatgcctgtaaccccagcactttgggaggccgaggcaggcagatcacgaggtcaagagattgagatcatcctggccaacatggtgagaccccgtctccacan

SEQ ID NO: 573205 - DNA, 148 bp, Homo sapiens
gcgtacatcctacagtaggattacatcgataacatgtgacactagatgatagacacccatacatattaatactactaatgcaacaaacacagacatcatgaaacacgcacatatactaaacacaagcaaccacacaagtctatctcaa

SEQ ID NO: 573206 - DNA, 622 bp, Homo sapiens
ctgtaaacaggctgatgccagtgctttaggggtggcctggctgagaggatgtgcaggactcgcatgcacacaccatggctgtactaccacaggagcaactgggaaccccagcagctctctcaaggagtgtgttggcatttctttttcctattggttttggctagtaacttggagccatttagaaatttatatttcttcggtacagaaaggaattatacatgaatacagaatactgcttgtttcttattagttcatttcatggttctctttttcctttctaataagaaaactcatgaaatgttccacataatttattagattccggcaggaattttaaagtcaaactcagttgtttacagcctaatgcacaatgccctttcagctttactgtactttttttttggagatggagtcttgctctgtggcccaggctggagtgcattggcgtgacctcggtttgcagcaacctcctcctcctggatacaagcaattctcctgcctcagcctcctaagtagctgggatttgcaggtgcccaccactgtgcccggataatttattttgtattataagaagagacaggttccatcatgtgggcgaggctggtctcaaacgcctgaacta

SEQ ID NO: 573207 - DNA, 349 bp, Homo sapiens
ccacagtctgtactggggggatgggccagagggcatggggcggaggcaaacgcggacaccgctggtaaagccatcagatcttgggagacttacttttgggaaagacctgctgcttgattcaattacctccccctgggtccctcccacaacacttgggaattctgggagatacaattcaagttgagatttcagtgcggacacagtcaaaccatatcagcaccagtggatggacagacccaggatgcatttcttttcttttcttttctttttttggaaacggagtcccacactgtcgcccaggcttggagtgcagtggctccatctctgcccactgcagcctccccctccc

SEQ ID NO: 573208 - DNA, 159 bp, Homo sapiens
  misc_feature (1)..(1): n is a, c, g, or t
ncgtgttgatgttcttagggtttaaattatttcaaacactggaataatgtcatggattatcgctggtattttactaaaacagataagtttaggtcagcttaagcaacttaagatgtaagtctgggccaggcacagtggctcacgcctgtaatcctagca

SEQ ID NO: 573209 - DNA, 596 bp, Homo sapiens
  misc_feature (584)..(584): n is a, c, g, or t
tcatcgagctcggtaccttacgctcctagacggagaacacttcagagaaacagaacttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcagcatgttttttattttgatgaagtctttggtgaggcgtgcaccaatcaggatgtatacatgaagactactcacccacttattcagcatattttcaatggaggcaatgccacttgctttgcttatggacagacaggtgctggaaagacctacaccatgataggaactcatgagaacccaggattgtatgctctagctgccaaagatatcttcaggcaactagaagtgtcccagccaagaaagcacctctttgtgtggatcagcttctatgaaatttactgtggacagctttatgacctcctaaatagaagaaaaaggctctttgcaagagaagatagcaagcacatggtgcagattgtgggactgcnagagcttcaggt

SEQ ID NO: 573210 - DNA, 180 bp, Homo sapiens
attcagtagctgaaagataaaatatcccttttaagaaagaacccaattaaatttttggaactgaaaaatttacttccagatctccccaatagaatttgaagcctcagcagcagaaaaattaagatgaagaaagaatttttgagctggaagaccagcttatacaatcaactcagtcagcca

SEQ ID NO: 573211 - DNA, 1007 bp, Homo sapiens
agcgggctcgcggcgcccaacggaccaggctggggccgtgaggtaactgttgcagaccagtcggaggtgggaggcgacactgagtctccatgttccctgagatggtgccctgagggaaaaggaggcggcagcataaactggtcctggagagaagccccttctcgcaccctctcctctagccgagcatgtcccaggactccgctctgctcctcagtccgcgctggtgtgggaccccggtgcccgtgggcgtgacacggacggcaagcaccttggaccgagtgttagctgatagccaagggtggtcgacaccctggaaagcggcagaggggggttggaggtactgagggaagacgacgaagtcgggcacgactgacggttaacccgatggcgggagtgttgatgactagaagtacccagtgggccaacccccctgggcgcccaggccaatgacgcgagggaacgaagcgaagacggccaaaggccatgcgagtccctgcaagcgcgcctggaatggcgtgccaggcttcgcaccccgcgaagaatgtcatgagagaacagcgcgtacgtgaaagaagctgcgtgaggcgccccctttgcgggctagggaaccactgcctggcggcagggcgtgtcctttcctttcgcaacctacttggccgagctttcgtgcgaaatcgctgaggaagacctagagagatcggtctgctcgggggccatcatccgcccaggcaaggccgcggggcggcttggcgtcccgcccctttcctgacccggggggcggccggcccttccctccgtgcctgtggggcgccccccttggggcattggacccttttggtttcccttcggtcccccttggctggcctgggggcggcctgtgagaccccctggaagaagaccgtggggctttggcacctgggggggcccgccctttgggacttgtcgtggactgcctggctggaagccggttgtttgttaccaggcaccagggttttgaagcgcacccc

SEQ ID NO: 573212 - DNA, 329 bp, Homo sapiens
tagattggcgtcgttaaaactatgtccttcctgactccctactctgtatgggggatctgagatcccccatacagagtagaaggatggttaccacaggctgggaagggtagtgggtggttggggtggaagtactgatggttagcaggtacaaatatatagttggaatgaataaaaactagtaattgctagcacaacagggtgactacgcgtcaacaaataattaaaaattgtatatttttaaataactaagagtataaatggatttatagtatcacaaaggataaatgtttgaggtgatagatatccatttatactgggtaccgagctcg

SEQ ID NO: 573213 - DNA, 387 bp, Homo sapiens
  misc_feature (103)..(103): n is a, c, g, or t
  misc_feature (137)..(137): n is a, c, g, or t
  misc_feature (139)..(139): n is a, c, g, or t
ccgtttcttagaaggggggggtgtgtcttcttcttggggagggggggtgggcgccccggcccctctccctctagagaggggggggcgccgtcccttcctaganagggggttgtggttctccccccccctttccttananagggggggggggggcccacccccttttctctttagaattagggggggggccccccccccccccttttccccaacccagggggggggggggccgccccccccccccttaaacccgggggggaaatcccccttatttttccctgggcccgggggcccccttggggggggttgcccccccccccccggggggttttttttttttttccccttccccccggccccccaatttggtttttggggggggggcca

SEQ ID NO: 573214 - DNA, 637 bp, Homo sapiens
  misc_feature (4)..(4): n is a, c, g, or t
  misc_feature (313)..(313): n is a, c, g, or t
  misc_feature (322)..(322): n is a, c, g, or t
  misc_feature (334)..(334): n is a, c, g, or t
  misc_feature (339)..(339): n is a, c, g, or t
  misc_feature (350)..(350): n is a, c, g, or t
  misc_feature (389)..(389): n is a, c, g, or t
  misc_feature (394)..(395): n is a, c, g, or t
  misc_feature (504)..(504): n is a, c, g, or t
  misc_feature (539)..(539): n is a, c, g, or t
tttnatctttttaccccatcaaaccgctgtctcttcaccagcttcattgtgtcacagtagctccctttgggaggatgatgtgaaagaacacccagagagagggagggagaagagagatagtgggtatgcctccctagccccccaccccccaggcccaccccttgaccccctgttcccccaaacccgagcacatcacgccaggccccttggccgccaggacagcatcagcccaccccccagcaataacctagggtatgggggaaggccagggctgtggtaaggaaaagaatcaaagaggggagtgatacggggngggggcacntggccgcccgcnaaacntggacattaantttatatcatgacccccttttaagccagtgagctgggcntcagnntttcccaggccatgcacatttaatttatttcagagaaactctaattgtattttcactgcagtatcttgtattttttatttgtgatttaagaaatgtgaagagaaaatanacagacacaataatggctaacattgtttctttcantccttgttctagagctaaccactctaaaattgtttggtaatgtcacttagtgtaattaattgtaacatattcttttaaataaattgatttattgatca

SEQ ID NO: 573215 - DNA, 320 bp, Homo sapiens
ggataagggcagtggggggcagggccgaggggggagaaagcccaaatgtagtcttagctccactgatttgtgtcgggacccaaaaggctgtctccgtgtacaggaccagtaaccaagcttacgggagcagagcccccaccgtgcacaagatgcctaaagtattttatccaaattcgaataattttttccaacagctagcagcgggtggaatgcatccgcgacaatactctcaatgtttacctggagagaagcatctagactggccacgagtactgcatcacctgctgtgaccggatcaactttcaccccagttacaacat

SEQ ID NO: 573216 - DNA, 160 bp, Homo sapiens
gttggcaagacaagcgccttacgaaaggcggcaaaaagggagccaagaagaaagtggttgttccattttactaagaaagattggtatgatgtgaaagaagctactatgttcaatataagacatattggaaagacgctcgtcaacaggatccacggaccaa

SEQ ID NO: 573217 - DNA, 348 bp, Homo sapiens
ccctaccctcagtttaatgatccactccaccttcaatcctctaactttcataatggctatcttactcttctaggagtataaaatgtagcccatttcttgccatctcatgcgctacatcttgacctaacgtttttacgtcgtcttcttgcgcttcctttgtagcgttcatcagggttcgctgatacatgcgtgtatatatgctgtccaagaggttggtcaagttgttcggggtttatcgattactgaacaggctcctctagagggatatcaccactgccaggtcctttcagtttgtggcttgttggctcgtactgttctggcaaggatttttgttgcttactccttcac

SEQ ID NO: 573218 - DNA, 844 bp, Homo sapiens
ttcccgccgcgccgccgtcatcatgagggaaatcgtgcacttgcaggccgtgggcagtgcggcatccaaatctggcgaccaagtatggggatggtgatcacgtgatgagcacggcatctatccccacgggcacctaccacggggacagcgaactgtcagctggaacgcatcaacgtgtactacaatgaggccaccggcggcaagtacgtgccccgcgccgtgctcgttggatctggtagacccggcaccatgtgactccgatgacgctcggggcccttcgggcagatcttccggccggacaatcttcgttttcggtcatattggtgctgggaacgagattgggcttctaaggggctactacacagaaggcgcggagctggtggactcggatgctgtgatgtcagtgagcaagatggaagtgctgagaggctgtgactgtcactgacagtggtgttccaagactagagcccacgttccctgaggatggcgggcgactggagtctggtgatgggtaccctcctcattcaggcaagatccggggacggatgtaccccatgaccaaggaaatcgtgacccacgtttaagtgtagggttggccccttgttcgggccccgaaattagattggtactagaaatcggaccaggatcgggttgggactcgccccgtaagcggagaattggactccaactcgcgttacgttacaagggttcgcaatccccaagggcttccggttaaggaaagaaaccgaccatggaaccggaaagagacccttaacctggggcaatttttggcatttaaacctcgagaggcctacctccttaaatcggggaaacccaattattt

SEQ ID NO: 573219 - DNA, 136 bp, Homo sapiens
ggagtgagccgccagaacacaagtgtcgtgaatactacccctacgagccaaaatgggaaaggaaagatgactacatatcaccattgctcgtcatatggacgactgtagattcgggcaagtgccagccactagctgg

SEQ ID NO: 573220 - DNA, 243 bp, Homo sapiens
tatcccctggcggaaccccgtatcttaaaataaaataaatttaaaagaaaaacaatgaaatatccatagcatgcttacaccaataatcagtttcattttttctcatgtgatagaagtctggaagtccaggactgctgcaggcactcccagaggccacagtgagtaggccagcgttcgctcgtgacgctttctgcatgtcacttctcttacaactgtgagttttcactatagcacgagtctgtt

SEQ ID NO: 573221 - DNA, 143 bp, Homo sapiens
gccttggggcccccccttcccccttttttgtcccccaacttgaaaggtatgaaggcttttggtttccctgggagtgggggggggcacccaggggtttcctgtcccctgactttagacccgttgaataaaagggccccccttta

SEQ ID NO: 573222 - DNA, 1221 bp, Homo sapiens
  misc_feature (326)..(326): n is a, c, g, or t
  misc_feature (384)..(384): n is a, c, g, or t
  misc_feature (432)..(432): n is a, c, g, or t
  misc_feature (456)..(456): n is a, c, g, or t
ggtactggcaatgcacatatggatactacggagctgggaatgtccctaattcgtatcggatagctcgtgtagcctagcaacaagaagaatctttaacacactaggaaaggtcagcagtgtgggaccacggtgatcactgtattcatagcgctacagtgtcatgcgatcacttacatacgcataatggccttcacccaggttcggtctcaatctagttacaacattaagaaacgtacgacgcaatgcgtccgagaaggtggagagaacaactaatgtatcctgtggttaatcccgcgcctcggatggttggcgaaaataaccggagnctgacttggagcgcttgcgctggacaggaagaccagtgaggacacttcatttctgcancggcattcgttcacagagcgtaaggggaagtgcagccagtcgcgaacnagagcacttccgtgtccagtccgnacacgtagcgtgactcccgcaccaggatggtgtgcgaactgttcaggactgccgtgtctcgagttgccgaacgggcctgggccgttggtgatgagttggagtcggtgccaccgctgggcatggaggtggattgccccacttccggcaacctggcatgggtgcgggccccgtgtctttagggactgctcctatactcccacatgcggctcgggggtcggcagacatcagagtggatcagttggtagccctctaacgtccctaccttcgttcctatcaatggtcggattgccccttgggaatcgtacacgaggtccttggcctaaagttgttgacattggttccatggaagccatcaagcgcgaattagaaaagctcctatctaaattttattggcttatccggtaattcgaatcgcaacaccgcattaatcctctaacggaagcttacagtgttacctaaggtagcaatgttgtgtagcgtatcactgagttgttggagcgcaagcacgattatgacagaagaattctggattgttagaattgacacgaggcgtatagttgctatctggtgggctttagagatcgtaggttgacttggttgagtgcgatgtctgtgtggcttgagtagaaagatggttggacctttgagtcaaggaaggctgattcaaattatgaaaatttagtgcgacattacttggtctaatatctgggagactgagaggatgggagaagtctagtaaaccaaaaggttggccagaaattggaa

SEQ ID NO: 573223 - DNA, 391 bp, Homo sapiens
tactgaggaacagaaagtctctacacaaacagactactgaaattacacctcagaggaaagctgtagtccaagaggaaatacccacaaagccctaaggtctgaagaaattaagatgtcagaggcaaaatctcaagaacagttagccctcaaagaggaagcttccaaaggttctgatttctgaagaagtcaagaactccagcaagcaacctccctggcacacaatccattgtccactgaggaaatcactaaaacatcacaggccatcagcaagcacagtcagaactcatgctgagattcaaagcataatctactcagatgagcataaacgcaggtcaacgactggttttaaaagccaacattgctggtgccaatgatgtgaaatgggtactgc

SEQ ID NO: 573224 - DNA, 772 bp, Homo sapiens
gtttccaggaagaaaacagttccagcgttgtcttgacaacttgaataatcaatgataacagaatgttcacaattaaagtctccttcttcttatattgtatcctctagttcatttcctccagatattggatcatgacaattcatccatttgattctctatctccagagcccaaagatcaagcattagctatggttacgcacgagtgtatcaaattttacgccaatggcctccttcagtggggacactgggtcttcaatagactttgtcctataagaggcaatgggccataattaatgcacatatttcaaagaactcgaacatgatttgatcagtcttcttggatgactctatcggctgcgaggaccgagctgcaaatcaagagaagaagacaaggaactgagagagaactaccatataaacttatgaagtcaaacagtgaaagtagtgtatacatggcaatatgatcatgttgaagactcaatgtcatgatacttgagagcctcctagaagaaggaattctgacgttctacactaaaccagtggaagatatttggaatgacgctaggtaactaacttaattcggaggatcaaccttgaaagctccagaacacctcaagaacgtaactttcacgttgaagggacttttggtagatctaatcaaggataatatgcgttccatagacctttcttccagacccgtggaaagaccgaatatacatccaattaataccaacagcatagttcgaataaactgaaatagaggactcaggtc

SEQ ID NO: 573225 - DNA, 858 bp, Homo sapiens
gttttaaacctttgatatttgacaaactttccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaattggctacagcctaaaatctgcttgttcaaaaaaaaaaaaaaaaattccatggaaagggccctgaaagcacacacacttaaaccccagttttctgataaccttgggaattcaccccgtgggactagtttaaaactcttctaaacataattttttaaaatctagttaaacttattgaagatggctaatccaacatcaagcgaataagtgaatttactgggggctgaactgatttaaatgccaaataattttttcaatcaccctttttggggttgagacattgctgatactttcatgtttgtcttgcccaagcaaaaaactggtcttttcctttgaagctgtcaatgctacagtatcacataaataccctttgtgaaacatgaaacattactttcttaactgatttc

SEQ ID NO: 573226 - DNA, 249 bp, Homo sapiens
ggagaaaggttctacctgatacccccagctagaggtgagtgccggcttgcctgttaatttaatattaaatagctgatgggcatctagaggaacaagctattcaggggatgatttctcagcctctcagcctgtacatgagaggctgagggcccggtgccatcaccagtcatagcggcggtactgtcggaaaggggagtcctcaagtccctggatgtccatgcgtggagagcactccgaccttcgtgcccc

SEQ ID NO: 573227 - DNA, 786 bp, Homo sapiens
ctattcagaacataaagaggccataccctggagagcccaacatatggaaaccagcaatatggaccaaacagccagttccccacccagccaggccagtacccagacaaaaaaaaagagaaaacaaaacacacaaaaaaccacaggaaagaggaagagacaaacacgcagagagacaaagagagaacacgaaacaaacacagacaccaatgaaaaggaaaacaagacaacaaaaaaaaaaatgaacaacaataaacaaacacaaaaaaaacagaaagagaaaacaaaaagacaagaacagaaaaaaagtaaaacacaagtaatgtgcaaagatgagaaagaaaaatgaaaaaaagctaaaaaaaagaaaaacaaaaaaaaaaaagaacagaaaaagagaatacgaaaaacaaaaaaatataaaaaacaaaaatgaaagacgaataaaaaataaaataaaatatgacagagaaagcagacgggaagagatacaaatagataagaagatgatgacatcatgaagaaacagatataacaagatacatcactaagcgaaacagtaagaaaatagtgaaagaaaatgagtgaataaaataaaaaaaaaaacagaaaaaacaaaagcacaataaaggcagagcggataggaccgaccggcacacgagcacgaaacaccacacagaaagaagaacaagaagaaaaacaacaggaaaagcagagaaaagcaacaaaaaaaacagaaaccacaagcgagaagaaaagaacgcaaaaaaggacacagccgacacaaga

SEQ ID NO: 573228 - DNA, 770 bp, Homo sapiens
  misc_feature (770)..(770): n is a, c, g, or t
agcggaatgggggacacttggaagcgttcacagccttggaggggctagtggcccctgcggcatctactagagtgccccgtgctccacgcttgtccctgctgccagccacagtcacgaatccccgcagcgcctatgcgtttctgcgtgtgctgaaaccgcgcgccgcggcccggcctcctccccggcgtctccgtgtgctgaaaccgcgaaccgcggcccggcctcgtcccgggcaggcgagcgtctgggacactgactggaccagcctcccgcactttctgggtggctttgggcaggtcagccagagctttgcgtgtgtcctgtggtgaccggaggccccagtcctgccgggagccccagggagcgcgctgtggcctctccgctgagcagtgaggctggagggctcctacgtcctcccatgactgagccgtcgctctcgcggtgctgactgctgagcccccgtgccagccctcccaggacacttggaggcttctcctgccgagctgccggcgactccacagagcatctgcacgtttctgtggccccgctccgcccctctggcttctgctccacagcctgcttcaccaggtcatcctctcagctccacgcaggtcctctccccgcctcactcccctccccagaccagctcctgagaccaggccacagggacccttggccttgcctccagacccagatgcccagacccctgttgacattccgcagaggtgtcctcggggctgacaaggactgaggagcccttacaaggacan

SEQ ID NO: 573229 - DNA, 337 bp, Homo sapiens
atatggatttggtatgatatgcaagcaatttccggaggttgtgccaagctactatgattgtgggaattacaacaatcagtcttcaaattttgtgacccattaagggaggagattttggaggcagaagctctggcccctatagtggtggagtgccaatactttgcaaaaccacgaaaccgaggtggctatagtggttccagcagcagcagtagctatagctagtggccgaagattttacttaggatacaaagcttagcaggagaggagagccagagaatgtgacagggaagctacaggttacaacagatttgtgaactcagcctcgccccagctgcgg

SEQ ID NO: 573230 - DNA, 382 bp, Homo sapiens
atccttccctctctacgatccttccctcttatctatacaacatttcttcaaaatctctacttctaaaaaataataatttgcaacaagacaaagcaattatcttctgtgggcatctgcatattgtcacaatagctagttaattaatactggtcaattaaaaacacacaccaggctgggcacagtggctcacgcctgtaatcccagcacttagagaggccgaggcgggtggatcacgaggtcaggagatcaagaccatcctggctcacacggtgaaaccccgtctctactaaaaatacaaaaaaattagccatgcatggtggtgggctcctgtagtcccagctactcgggaggctgaggcaggagaatggcatgaacccgggag

SEQ ID NO: 573231 - DNA, 793 bp, Homo sapiens
  misc_feature (37)..(37): n is a, c, g, or t
  misc_feature (39)..(39): n is a, c, g, or t
  misc_feature (227)..(227): n is a, c, g, or t
  misc_feature (231)..(231): n is a, c, g, or t
  misc_feature (338)..(338): n is a, c, g, or t
  misc_feature (389)..(389): n is a, c, g, or t
  misc_feature (418)..(418): n is a, c, g, or t
cgcgcgctgccggtctgcgctgcccagcgggaggggntngaccccgcgttcctcctccctgccggtcccatccttaaagcgagagtctggacgccccgcctgtgggagagagcgccgggatcggacggggagcaaccggtggcaggccgtgccggctgaggaggtcctgaggctcagagctgccgcggctggcacacgagcgcctcggcactaaccgagtgttcgcngggngctgtgaggggagggccccgggcgccattgctggcggtgggagcgccgccggtctcagcccgccctcggctgctctcctcctccggctgggagtgggccgtagctcngtgggccgtcgccagccccggcccgggctcgagaatcaatggtgcctcggncgctgtccctgcaggctcagtccatctgncctttgcctgggcagcccgggcagagaccatgtttgacaatggacgcggattgccagtacgtggacctcgatgtgctctgcagatgtagctaggatggatttgccttaagcaaatacttaattcaaaggcatacccccttccaaaagaggagtattcttgtaatgatgagtaccatcaagtacacacttacaaagaagacacataacactaatgcgataaataaagagaggaataatacattccaatacagaaataatcagaaatacatacgtgcgagaaaacacgtgacagataagacagtaaacataatagagtaaaaataacaaaaatcaggaagtaacaagaaagacataatcaaaaaagacatggcaacg

SEQ ID NO: 573232 - DNA, 363 bp, Homo sapiens
  misc_feature (180)..(180): n is a, c, g, or t
  misc_feature (261)..(262): n is a, c, g, or t
  misc_feature (324)..(325): n is a, c, g, or t
aggcaattggccttggtgagatggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactcatagtcagnttttgtctccaagaaccttaggctttgtgtattttttaattttttaattctcacgtgttaactcctatatatgtttttttnntatttaaagatgtgtgaaaaacagcagagaggtgaggttgtggccctcaaattattgcaaannaatagtaacacataaaggttctctccaaaatatagaga

SEQ ID NO: 573233 - DNA, 1108 bp, Homo sapiens
  misc_feature (761)..(761): n is a, c, g, or t
caaacccactccaccttactaccagacaatcttagcctaaccatttacccaaataaatgtataggcgatagaaattgaaacctggcgcaagtagagtactagtacctgcagagggggaagacgatgaatgaaagttaataagccaacgcagtaacgattagcaagggacttaaccgccgtactacctttcgtgcataagtgaatttaatctaggaaataactttgcaacggagaggccagaagctatagacacccgcgataaccatgacgtatgctaccttaagaacagcataaaagagcacacccgtctatgtagcaaaatagtgggaggatttataggtagaggcgacaaatctaccgagcctggtgatagctgggttgtccaggatagaatcttagttcaatctttagacatttgcccatcagaaccctctgataatcccctggtaagtttaactgttagtccaaacgaggaatcgagctcttgggcacgactaggagaaaaaccttgtagaggagagtaaagcaatttaacacccatagtaggcctaaaagcagcctagccaattgaagaaagcgtacaagctcaacacccattacctaagtaaatcccagaacatatagctgaactcctcacacccaatgggagcaatctatcagcctatagaagaactaatgttcgtataagtaacgtgaaaccattctcctccgcataagactgggtctggattaagaacagtgaactgacaaattaagaggcncaatgatctaccggtcaatcaacaaagtcattattaccctcaatggttaaccaacataggctgctcataaggcaaggtaaacaaaatttcacgggacatccggaattttacaccggctgtttccagaaaatttacctctaggtcgccagttttaaggaccgccgcaccgtggaacagtgttacagggccggaacccaaacacgtcaaagaggggaaagcacgtggcctcaaagagacggaagaagaacaaagagataacaaggtaataacagagaatgcgacgcagagggctacagagacaaacatagggataatacagaacaagcagaaaacataaatataagagg

SEQ ID NO: 573234 - DNA, 220 bp, Homo sapiens
gagcagcagagaagtatatctggagaaaggctattatactcgttaaacgaagtttattctctctggatacatttcttcatcttcttcatgatttagattcacgttatcactagaatattacttttctagctatgctatcaaatgagctacttagaaacttccctcctttacaaactttctattccttaccgtctccctctctgtcgtgtcccgctgggat

SEQ ID NO: 573235 - DNA, 366 bp, Homo sapiens
  misc_feature (131)..(131): n is a, c, g, or t
  misc_feature (136)..(136): n is a, c, g, or t
  misc_feature (227)..(227): n is a, c, g, or t
gagccgccgtaggatgtacgagatctgtgagacatctcgcgatcaatcgacaggtatcagagcacagatttgttggttaatcactgggttagagactgatgcagtgagactgctgtgatgcacagatccancccancagcccttttcaaagcactttatccgtgagtctcaagggaggagtctgagtgtgggggtaacaggtcctgtgtgcagccacagtatttcangtccatttcatgaagcttgggcttttgttcatattcactttctgcacaatgggaataataatatctatcttgtgggctcattgtgagatgtgaagcaccctttgggtgctggagagtagtgaattccttttcttcctct

SEQ ID NO: 573236 - DNA, 395 bp, Homo sapiens
cgtagctagaacaagtatatttactgtcggggggctgggagacgtacagcctacgctagagtataaaaaaagtttttttaaattaattttttgtacggcaagtacgggtatctgtcatttctggtggtcaacgataagacaaacttgaaatatgtgagtttgccttatgtttggtctgtagatatctatgtggggtagagcaattaaatcagatcttttaaacttcaatcttctcacttacagaatggtgatttaacttaagcgaaatgtctatcccacaaaaagaactaagtacgggcttcttttctcttccattcttccattctttatatacttaggtatataacacgagcggaaagtcactttttttatactattacgcgggaagggaatgg

SEQ ID NO: 573237 - DNA, 376 bp, Homo sapiens
  misc_feature (346)..(346): n is a, c, g, or t
  misc_feature (371)..(371): n is a, c, g, or t
agtgcagtagcaagacaagcctttttcttgccaatagtgtttcctcccctcacccttccataatctgctgccacctctccccaggagctccaagcctctgttcatttctgcatagtataaaaacttctgtcctctggtccttcaagtctcatattttgtgtggctcccatgcatttgcacataaataaatttatatgctttttcttctgttaaaagaagaagaaaagagaaaaagaaagatcaatatatataaaaaaagctgaccccagagaaaacaaagataaatcagataactaacagaagctaacttggaaaggtaaatctctttaaggaaaggttccaaggnttaagcctgggggtaatttaaattntccag

SEQ ID NO: 573238 - DNA, 103 bp, Homo sapiens
cacccggccactctagtcagctcagattcccaagattacaaaaggaaattcagctaattatagcttgatagaaattatagttctgccgattcctgattgacag

SEQ ID NO: 573239 - DNA, 283 bp, Homo sapiens
  misc_feature (28)..(28): n is a, c, g, or t
  misc_feature (60)..(60): n is a, c, g, or t
  misc_feature (72)..(72): n is a, c, g, or t
  misc_feature (96)..(96): n is a, c, g, or t
  misc_feature (103)..(103): n is a, c, g, or t
  misc_feature (166)..(166): n is a, c, g, or t
  misc_feature (185)..(185): n is a, c, g, or t
  misc_feature (274)..(274): n is a, c, g, or t
tggggggggggaaaaaggagtttaatanggaatataagaatttttctaatttaaaaacangagagagatacnacaatctaaaataacataatattngcgaagnctaaaagggggacaattaatttccaaaagagacttaagagagacttaaccaaggagaaggggnccaaatcaaaaaaagaganacacacacacccacacacacaaatatatactcttataagagagacagagggagggcaaaaaattaaaacccctccctaatagagagagnacaaactta

SEQ ID NO: 573240 - DNA, 391 bp, Homo sapiens
ggggctgctgatcaccattgagaccacctgaagatgggccatcaaaggctcaaatgaggccaagggactggagcccagaacttaggtgggcagctgtcaatcagcatgtgctaattggatctgagttcccgcccaccggttcaggggagccccaaggctttggtattgaaggaagcaggtgactcatctttctcctttttaaaaaaatttttagaaacagggtctggagtgagtgacgagatcatcgttcactacagcctcaaactcctgggctcaagcaatcctcctacctcagcctgcccagcatggcaaaaccgtgtctctactaaaaataccaaaattagccgggcgtggtggtgggcacctgtagtccccgcttcttgggaggctg

SEQ ID NO: 573241 - DNA, 331 bp, Homo sapiens
  misc_feature (12)..(12): n is a, c, g, or t
ctcacagtctgntaatccagcactttgggcgcccaggcaggtggatcatgaggtcaggagtttgagaccagtctggccaacatggtgaaaccccgtctctactacaaatataaaattagctgggtgtggtgtcaggcgcctgtaatcccagctactcaagaggttgaggcaggagaatcagttgaacctgggaggtggagattgcagtgagccgagatcatgccattgcactccagcctgggtgacaagagcaaaactccatcccccctgcccaaaaaaaaaatttaattttcacagaaaattaatagcataggttttattatcctcattt

SEQ ID NO: 573242 - DNA, 377 bp, Homo sapiens
tcgacgtcacttctgtacactgaagatgttcaaagaggtgccatggctttgaagaacctctgggatagtgaaaggggcttgtaaatgtccttggacattctacttagacccagcacccatctcatttccttttccatctcctcaactcttgtatttctttttctttcttactcagtgaagactgggggctttcagatcagatctggttgcagaagcttttataagtcacataggagtttagatcccagcttttctgagcttagtgaccttggtcaagttatataacctgaggatttcttaccttttcaggtaatctaatgaaagaaatgatccctcaccccagaagaatgctcatgaatgcacatgcacaaaaaaaa

SEQ ID NO: 573243 - DNA, 212 bp, Homo sapiens
  misc_feature (48)..(48): n is a, c, g, or t
gggggggaaaaaacccccaaaaagggggggggggggggtttccccccnttttatccccccccttttggggggtggggggggggggtccctttttccccccgggtttttcccccccctgggcccccatgggggcccctttttttttttaaagggggaaaatcccttggggcccggggggggggccgggggtccccccccctttttttttttca

SEQ ID NO: 573244 - DNA, 1140 bp, Homo sapiens
  misc_feature (247)..(247): n is a, c, g, or t
  misc_feature (268)..(268): n is a, c, g, or t
  misc_feature (298)..(298): n is a, c, g, or t
gggagcgcgcgggcacggggtgcggctggaccgaggcgtgcaaagattccagaatcggaggacatgatgaagactcgtgctgctgttttagtgcgggtctgctggctgacctggggagaagtgggcgaggtcgtgggggcatcagacggtgctcagacgatatgcatgctccgaggcaaatgtgccagtcagggtgaaggtaggtacgtcaataacgcggaagttcacatagatgcctggggcaagncgcgcggctgacatatcacgnagtgagaggaaccctcgtcagtaggtacanatacatacctatacatcgcaaagaggacgcaagacgagcgaacgttgctcgaggcgagagccgtagaaaagcacaggccggagagagaagaaagaggatgcccgtaaggtgagaggagggcaactgagagacgaagcttgataggagactccgaggagtgtgcggttgagagctattgattgggccgtcttggggaaaagtgtaagcacctgccgtgaaaccagatccttgcattgtaagggttctagcagcacgcggtctgcagcaacgtggactctagcgcggggcttggctcgtccagccttgagggagatgcctgaaccaggagcctcgctccgtttctacctctctgggatagagatgggtggagcggtagtctgaggtcgcctgcgtgggagaacggaccggacagaagagcgcacatgctgggatgttcatgcgaggaccatgttcatgccgtgcgtcactagcatcatagagcgagctcttccaggacaggttctttcacccggggaggccccaggatacctatcaataacgtggccttcaagctggcccaaccggaggctcaattcttcctttgcccagtccggatcgccggagatggagtccttcgtaacggtaagagacccgtgagttccaggcaaggttcaagcctgccttgagagtgatacgggaaggcaaaagggggcgtgacatcacgtccaaaagcggcttcaagaccggccaagagtactaacgaaggcgcgaactacggacgatgtacgcggaaacacacaacaccaggagttgacaaaagagacaagtaagcacaggacagtgtaagtagaggacaaacacag

SEQ ID NO: 573245 - DNA, 818 bp, Homo sapiens
acgtcgggtctccgcggcccgggttattgtacgaaccatccggacccgcgtaatcgtaggaactatcggccccgcgtaatcgtatggtctgcgcgggtcccggcctcccatcagagctgggactccccgcccccaattggcgggcgatagagtctcctcgccccagagtcatcttcgggagcgcccagggcccgggtgattttgggctcgccgtggccccgggtgattgtttcatctccgtggcccgcggtggtctgtagcgtctccgacgagccgcggactcccgtagggtccccgtggccccgagttgtagtctggggacaccccggccgcgggtgatcgtcgggtctccacgcgcccggtgtcgctgacgcggatcctggcctcggtcgccttctcaggggctgccctgcataagtgcccgcatggagcaggattgaacattctggcacccgtgcggaagggtgatcgtgtcctggtgcgtgagtcttgacccaggtgcctgaaggaaaggaggccgctttgcgacgggcagcaaatgatttccacccccgcgtcaccgtgcgcctggcaggagcaccggataggcacccgtgggatttaccgatctccaaggtcattgtggtggggggacctgtcggtggggaagacttgcctcattaataggttctgcaaagacacctttgataagaattacaaggccaccattggagtggacttcgagatggaacgatttgaggtgctgggcatccccttcagtttgcagctttgggatacgctgggcaggaagaggttcaatgccttgctcactactataa

SEQ ID NO: 573246 - DNA, 868 bp, Homo sapiens
gcctcatctgtacccattctaatcgcaatggcattcctaatgcttaccgaacgaaaaattctacgctatatacaactacgcaaaggccccaacgttgtaggcccctacgggcctactacaacccttcgctgacgccagttagaactcttcaccaaggagcccctaaaacccgcacatctatcatcaccctctacatcactcgtcccgacttagctctcatcatcgctcttctagtatgaacccccctccccatagccaaacactctggtcaatgtcaaactaggcctcctattaattctagccagctctagcctaggcgttgtactcaatcctcgtgatcagggtgacgccatcaaatctcaaatctaacgccctgatcggcgaccacgtgcgagcagtagccataagcaatctcatatgaagtcagcctagacagtcattcctacgttaatcacacattagtaataagtggctcctttaacctctccacccttagcacaacacaagaacagctctgattactccaggcatcatgacccttggccataatatgattgatctccacacctagcagagatcaagcgaaaccccttcgaccttgccgaaggggagtgcgaactagtctcaagcgtcacatcgaatacgcgaggtcccttcgacctatgctgcatagcgaatatacgaacatgattattaatatgcacctcagcataaatcttctaggacaaatgtgaggctcttcgccggaatgactcacatattggcccgagacctactttaacgcctgtggttatcgacagtagccaatcgcaggaattttacctcataaagtcacttgcctattatagatgtcctcgatcgggccccg

SEQ ID NO: 573247 - DNA, 447 bp, Homo sapiens
agcaatatccagaagctattttttgaacgtattaatgtgttcagccctgtggagttcaacaaggtgtgggtgttgcccggctttatcaaaatcagcctaaaaacgctgttggagtgtgtggggctgggcccctttgggggttttgggttccaacaggggaaaatggactccccctttttgcagttttacctgtggggttttttggcccacaaaaaatttgtgccctttttgttggaaaaaatggtggctttttttgccctgcgttgcccaaaccctttgcccatgaaaccccagttggtttagtgttttttgggaggggggttaggggcaccccttcccatgccccggtttttccctgccccccatggcccccaggttttggttttggtggtctttccccccaggcaggtgttagggccggcctaataaaaatgtgtggcctcctca

SEQ ID NO: 573248 - DNA, 711 bp, Homo sapiens
ataccaggagctggaacgacgatgcagcgcctgatcccgcccttccgcgaggattcggccaagctcaccacgctggtggatgccgacgccgaggacttcatcggctacctggaggcattgaagctcctcaagacacacctgaggagacaggcgctcagtgggcctacacgagggtctgatgcgcgcagtctctgtgccactgacgctgtcgtagacacacggcctcactgtgagcgaccctgcatgaactgtaccggtgtgtgaacatggcctgccggtcagacctacatgtggcggcaaagccctggagatacgcgtgtttgacgcatatttcaacgggctcatcaacctgagggacatgacagacgaggcatttaatgaccagatccaccatcgagtttacagcctcttgcacgaagccaagacacagactgcactggtgctggactgtttgtagaccccgcatgagtgacggtgcgggaggcctctccgagctctgtggcctctccctcgcccatacccagagggcagagctgtgacctcagtgaggacacaaatagttcatatgatgcccggaagatatgttgtcactctagagagcatctcctgagaatggaggcgctatcagggacaattttagcataatgggatgagtttttgggacatctcgaggggtggcccgtgcccagactccctttgtgagactgtgac

SEQ ID NO: 573249 - DNA, 152 bp, Homo sapiens
cctcgtgagtctacccaccttggttgcccaaaatgtgggattacaggtgtgagccactgcgccaggcaaacggggatcttttagtggtgcctcttctctctttggacttacggatgttgtcccttaaggaaacctggaggctactactgtga

SEQ ID NO: 573250 - DNA, 440 bp, Homo sapiens
  misc_feature (325)..(325): n is a, c, g, or t
acacatgcacacgtatgtttattgcggcactattcacaatagcaaagacttggaaccaacccaaatgtccaacaatgatagactggattaagaaaatgtggcacacgtacaccatggaatactatgcagccataaaaaatgatgagttcatgtcctttgtagggacatggatgaaattggaaatcatcattctcagtaaactatcacaggaacaaaaaaccaaacaccacatattctcactcatagggagaattgaacaatgagaacacatggacacaggaagggaaacatcacactctggggactgttgtggggtggggcatcntctctacttattaaggctctgatttttactcacatgtatcgatgatctttgtctgtctgctcatcaatatcgcttgtatatgccttccttgtttctgtcgtttgtcatttttgct

SEQ ID NO: 573251 - DNA, 152 bp, Homo sapiens
tgtagcttcgggaggctgtagacgcacgggaacgaaagggatcataccagttaccccggaaaagacactaaaataacccagcttccagagctaaggaaatttatgtgccgaaaagcgaaacaagaagataggaagagcgagaggcgaatgcg

SEQ ID NO: 573252 - DNA, 1391 bp, Homo sapiens
tttgtatgtttgtttttcttgttttgtgtttttgttttttctttctttctttttttgtaggctgttcgctttttgtttctgtttttttctttgttggttttgcttttgttttgtctttgtgtgtgcgttcttttgtggttcttgttctcttttgttgttttgctccttttctctttttcttttcgctttctattccggttgggtgttgctgttttttttgttctttgtttctctcctgttctttttgtgtttttcttgtcgtttttttcgttcttccttgtttcttctctgtaacgtgtggcatatcttagtttttttttttatacaccggtgtctgggattatcaattacattttttgtctgttggtgactccatgtgttgctccccttttgcgaatgttttcaatgttcacatatattctcatatatacatattgtgttgttcacaatatatcttccctggtactcgtgtaatcacgctgttttttgtaaggtttcttactcggtaatccctgttggtgcgcctattggtggtatcccccgtcgagttgtgtgcgttttgcggagaatttctgcccgttcccgagtgtttctttctttgtctcctcctcttgtttggtgtgctgcttccctgtgcgtactctgtttcgcgcagtccccttctctcgtgttttttttgttgccgtcacttctgtacgcctgggggtatctgtagctcattccaactttttcagcaacgttggatgaaccccgagctgtagccacccccttttgagcccattagtttccaaaggtcacacagacattatccgcagcacacaatggttatggtccactattcattcccttggagccccggccaagaacgggtttgcatgatattttccctcgcgggataaactcatctttgggcaacaacttggggtttccaaccgcttatgtcctgtggtaccggacaatttctcgaggttatacgaagtctctactccttgcaatcgcatggggtcgctttcggtctctctaagagtgtagcgagaatgcaagaatctttctgtggaaagatccctgatcttggtatagatccactcaccccttcgaaggtggaggcccacgtgacacccactcgaggaaatgtcaacggcaaaagagtcccaagaattaaggaaggcacatccctctcctgagtcacgccacagagggttgatctttgctgggaaacacgctggaagagtggacgcacccctgtctgactacacacactccacgaaagagtccacctctgcaccttggtcctgcgcttgagggggggtgtcctaaagtttccccttttaaaggtttcaaaccaatttcattgcactttcctttcaaataaaggtgttgcattccccaca

SEQ ID NO: 573253 - DNA, 137 bp, Homo sapiens
ttatgcattagggtgatggattgtggccattttataggattagtgtagtcaaggaaaatggggggttgttctctggcaggcaggagatgggggtcacaacgtgctcagtaggggagcttttgagccacggatgagca

SEQ ID NO: 573254 - DNA, 185 bp, Homo sapiens
gttttagggcctcggtccataaaaaaccccccccccctggcccggtggaagggtttttttgtccctccccccaactgtcctccctggggcaggtggcctggccccccccctggttttggggcgggcccgggtgggcccggttgggggctccgtttggggggttataaaaaccgccccccccccca

SEQ ID NO: 573255 - DNA, 807 bp, Homo sapiens
ggagtgacccttacaagtccttcttgatcctgaactgggttaggtgccgctgttgctgctcgtgtgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggcagaaatgtgtaaaggcccgggagcggtagagctcttgtgaatgagcgtgtatcctctcgatcacatacagaagaggattgcaccggagaagctctttgacttcttgcatgcgagggaccattgcgtgtccccaaaaattctttaacaatttgaaataaatgtgtggaacttaattacaccccagtcttcatcatctgggcatcagaaatatttccttatggtttgatgtcccattgtgtctatattgtgtaactggtaagttcactatgaacctcatgggttggctaaggctggtacgcttctatgtaatttccggcaattgattcccattcttaaattaacaagttcctatgattctgcagaaaaaaacgaagaagcgacgtaaaataaaacgttgtgacgccactcggcctggagaagttctaaaccacatggtgggcgcagggcccataggacggacgtggcctacggtccaagaacctgcccggaaggcgggtccacaaacagcggggaccgagtgaaaaccaggggttgggtacggctaagggcaggacatacccgcggataacaataagacaccaactcggcagagagcaac

SEQ ID NO: 573256 - DNA, 113 bp, Homo sapiens
atatcattgaaataggcagttgctagctcgccacctccagcacatccttgtgaactgtgtcattgtagactcgactggaaagatgacctgtattcaatcttttcaactgttta

SEQ ID NO: 573257 - DNA, 1083 bp, Homo sapiens
gcctgagccgtgcgggtgactgcttcagtggcttctccgctgactgggacctgggctgcccgtcggaaagcactgccctccattctgcacttgctttgtttgggctcatcattgaacgcgctatggggcctcctgtgcaaggcgggaaacatgcctgtgttgtgtaattgttgacaggagtgtgacacaccgacgggagccatttccttccaaaacaggggatgcattcatgccaatttacaacgtttttgggcaaacttggaagacttgtacaggtcaccacaggcactttacgattgcatgcatatattaccaatgtgcaaaattccaaacatgcaacacacatggtgcgattgcgaaccattgcttgtctacttgtttagctaaccctaattaacacgactcatgccagtaccatatgtgggcgctctgacctaagacttacgacaaacaacccaaacaaaaaccaatgcttgtcacccacacagtatttttaaccacaaattttcataccatttgcacaccactgaaaaaaccccgaacagacgaactctctcctcgggcaacaccggttctgacagggcaggaacctttcaaaagcccaggactcccgagaatgttgcttgcgaattaccccaggccaaacatgtgatgaccatgacaacgaaagttaacaacttgggaaaccccatgttggcccttgattgacacacattggggacaccatttactcttggctttggggtaaccaagggtaggagcgaaacaaacaaatcaaacacaggttaatttggtgcctgggcaatttcccttccgtgtacgcttcacaactcttagttgcaactctttgcacaacttggccccgtgtgttaccttaaagaagcaacttcagttcccttggattgatcttccctggggcacctttcttgtggccaactttatggtggcaacgtaatgccccccttttccaagagatcctcctgtacgaaagcacaaccactgtggaaactccatatagggaaccaaactattcacttggtgaaaccccaataatgtggcatatagaggaggcgccgaaaaacc

SEQ ID NO: 573258 - DNA, 563 bp, Homo sapiens
  misc_feature (517)..(517): n is a, c, g, or t
  misc_feature (536)..(536): n is a, c, g, or t
  misc_feature (546)..(546): n is a, c, g, or t
gaaaatattaagaaagaaaagaagatttcagccaaaatttatatgaataaatttcagttctgccacttactaaatgatcttgggaaagttacgtaaccctctgagtctcatttttcttatttttaaaattgagatgcagtaataataatgtttatctcacatgaacactattttaaataaaatgatttatgttaaaacacctagcaatggatggcaatgaatgagtaatccataaataagaatctacttaaaattgcaactattagcttccactagcaatgcaaagggcatttatatatcaataataaagaacgaatgttgcctgccaaagataatcgacaaactccaggaatcatctctgtgcagcagggtttatttttggcaggatttggggaccatttgggaataaaagacccaaaaggtacctcaacaccagacctggcacagggtttggtcaacatcttattggaaatcccatgggaggaaatcccattaggattggaggaccatttagggngtggttttatgggtattcnatacgggaanttatggcccggggcttg

SEQ ID NO: 573259 - DNA, 645 bp, Homo sapiens
agcggaacggggatcgagcctggtgctgctgcatggctgagggctgcggctagaagggctggtcgagtgctgcgctgctgcgtgaggacgtgacaagtcaccgtactttagctccagttcccctgatggatcttcatagagacacattgtttgcagcagtgctcctggcaggctcacagcagttcatctatcttggtgtactggtttccatatttgtgatttctatcatggaaaactcgatctaatggcgtaacagtcaacctttgaatgaaccgacacattgtcaggtaccacgtgaattcgtcttccattcacatgccatgttcccttcactattgaaccgaactcattactacccacggactacctatgaaatcacgatcgaaacgcattttgccaagagtcaacgaccgaactacgtccaggaaaataagttggaatgagaaatgaggtttcaaagagagttttctagaagacgtggggagagtttgcgagtgaaacaaattttgtagctcaatgaaagacttttgcgttcggaagagggaatgcgcacagatgtgactcacttagggaaacactttggcgtatctttggtttgtatattgactctggaactaacgtcgattgaattgttgggacaatgac

SEQ ID NO: 573260 - DNA, 151 bp, Homo sapiens
acaaaacattaaaagacccactagcacacacaaacacaaaagtgtctaatagctgtccagatgtacattccacgtgtagtgataatgcacatctagacatatcgtactgtcaattgcatctctatgcatgtctatctaatgacactataga

SEQ ID NO: 573261 - DNA, 161 bp, Homo sapiens
ttagccgggcttggtggcccatgcctgtggtctcagctccttgggggggtggggcgggagattcttttgggcccggggggtcagggctgcagtgagctttgttcgcaccttggccttccggcttgggcatcggggcaggtccccttcctccttccccccca

SEQ ID NO: 573262 - DNA, 354 bp, Homo sapiens
gtcgactcctagtcagtctccagagagaagatagaaatgcaaactgtccagtaactgtgagccatgctaagctgaatagacaggcaaaaaggaggctcactactgtgccttgggaggaaatttgtattatcagggagaatggtatgtattggttaaggtggaggtgtgatagaaacattttgagtatataggagaatttagttcacaataggagtttaaaaagataaaaaaggccgagtactgtggctcatacctgtaatcccagcactttggaaggccaaagcggagggttgacttgaggccaggagtttgaaaccaacctggacaacacagagagaccacatgtctacagaa

SEQ ID NO: 573263 - DNA, 157 bp, Homo sapiens
tggcggaaacgatctctgctattctcgaacttgtaattggagtcgaagcccggctcgctggcgtggagccgggcgctgcgattgcgagtgcctagatgggccacattattggttaacgcagcagacagtccgtgctaccgatcctcgaagttctgta

SEQ ID NO: 573264 - DNA, 175 bp, Homo sapiens
aagcgtcattgtgtgacacgtcgttggagtgctgttttataaccaacaagaggtcaatgtatagaaatacctgatgggagaagactgctcttcgtcccatcagtaagggcaattcatgatgttaaagccacagatctgggattaggtcaagtaagatttaaggcagaagtagatt

SEQ ID NO: 573265 - DNA, 705 bp, Homo sapiens
actacggctcacgcctgtattcacagcaatttgagaggctgtagcagtcgcctgactagagagcttgatcgctagccatctcgcattaaccgggatactcccatactttctcaacagtacagacatttagccccttgtggcgcaggacgcctgcagtaccagttacagactggctgtcgcaggagtaggattacaaccaggcaggtctggcatgcaacgcgtcacatatcgagctacgcacttgagcctgctcgtcggagtcagactccttgtcgtactgatatgaggcgaatgactgacaggcgatagcgtactagtctaaccacatgtactcatgaccaacgcgtactatttgatcagacttatagacaccgtcggatgactgcttcacatacctaccattagtacagtcactgtagtcaggagtgatctcttagcaagagattgacttactcatgactatacacgctagcagattcatgctgacagcgcactcacagtgagatatcaggatcatctaagtcatcagacgcaacttaccatataagatgtgacgagactagtagtagcactaacgtcgtagtacgactgatattaacctaatgacctcttaagctaggacccaggtcctagggctaagtatgactgtctactaagggtacccagctactactacaggcttatatgcctttttcccccctggcg

SEQ ID NO: 573266 - DNA, 208 bp, Homo sapiens
  misc_feature (159)..(159): n is a, c, g, or t
  misc_feature (179)..(179): n is a, c, g, or t
gaaggttcaagtcagggcctgagtccaggtctctgctttctgctggacgggccaagccctgcattttggaccctgttcatctctccagccttgtttctcacaacttcctggcagaaaccttggctgcagtcactggcccttcccagcacatgcaccttnctgcctctggactttgggtnttgccagtcctgcgcccttcggtttttcc

SEQ ID NO: 573267 - DNA, 821 bp, Homo sapiens
taaaacccagcccatgacccctaacagggccctctcagcctcctaatgacctccggctagccatgtgattgcacttccactccataacgctcctcatactaggcctactaaccaatcagccactaaccatataccaatgatggcgcgatgtaacacgagaaagcacataccaaggccaccacacaccacctgtccaagaaaggcctgtcgagtacgggataatcctatttattacctcagaagttttcttgcttcgcgaggatttttcatgagccttttaccactccagcctagcccctacccccgcaatataggagggcacatggaccccaacaggcatcaccccgtaaatccccgtagaagtcccactcctaaacacatccgtatgactcgcatcaggagtatcaagtcacctgagctgcacccgataagtctaatagaaaacaaccgaaaccaaataattgcaagacatcatgctatattacaattagactgggtctctatttgaccctcctacaagcctcagagtactgtcgagtctccgccttcagcatttccgacggcatctacggctcaacattttttgtagccacaggcttccacgggcttcacgtcattatcggtcaactttcctcacgtatctgttcatccgccaactaatatttcactttacatccaaaacatcactttggcttcgaagccgcgcctgatactggcatttcgctgaatggtggtcgctaattccggatgtctcccacctatgatggggctcttacacacaacccccgaacgggttatcaccacctaagagccaaaacaca

SEQ ID NO: 573268 - DNA, 487 bp, Homo sapiens
  misc_feature (59)..(59): n is a, c, g, or t
  misc_feature (180)..(180): n is a, c, g, or t
  misc_feature (182)..(182): n is a, c, g, or t
  misc_feature (221)..(221): n is a, c, g, or t
tggagtggtccttccaaaactcagggggggcccggggcagaggaaaaaatttccccccnatgttttccctttgtgtgctgggaataagcaaaagaaacgttttttttcaacctgtggcagagctgaagaagcaaacggattttgagcacaggattcccaaagaacagtggtgggtcaagntncggcccctcatgaaaatcctggccaagtacaaggccagntattacgtgtcggactcaggccagctggaacatgtgcagccctggagtgtttgacccagtcccgcctgcatgtgcctgcagcccccgtggactgtctgtttttgtaacacttaagttattttatcagccctttatgcccgtattattaacattaatacctaatcggggagtgcccatttgcccccccagccccagtgggtgctgtttgtggagtgtgtttcatgctttcaaatgggcatatgagcagaattaaacatttgcctcca

SEQ ID NO: 573269 - DNA, 166 bp, Homo sapiens
tactttggtgtgccaacgactggtgaccccttatgtagctttagcccttggtcaccccgatgacgtcgatcatactacatcctgcccaaacactaggttcacaggtacctgctgctcaagcctctcgcgggcccagtccagcttctcggccacagtgcctccgttc

SEQ ID NO: 573270 - DNA, 571 bp, Homo sapiens
cctcccccgcccctacgggcccattaccggcatcctccccaatttccccccaacttgttacccccaccaaaaggccccacatccctggccccatccccaagcattggtaacctcgtttccttgggaaaatttggtgacccttcacattccggaccacatctttatattttctccccctttttttctcccccaattctcccccccatattcccccctgaacttccacccggtaaaccccctcctccgggctcttctccgcaaaaaatccccaccaccaatttcttccctttaatccccgccctctcttcccagccaaattcttgtggcctaccctcggtctctttttctgcgtctccccatacagtccccccactttactgcccataactgccgttcctccgtggaaatcttttctcccccccacccccccaccactcttacctcctgccaacctacacggctaaccctctgtgcgtcctactgggcggctctcctccccaatcatcttttctccgcccacccgccctatctcccgcccgtaatcctgccctgccctctcttttatataccc

SEQ ID NO: 573271 - DNA, 227 bp, Homo sapiens
tccgtgacagctcaattcccatgacttaattcagcagacccacagtgacgaagactcacatagacgtggcacccgacttcctacattctatgggttatttgtttatctatttaacagtaatactatgatccattaagtaccactacccccaccttcatgagccgcgaacgcctacagatcggcgcggctactaccaggcaaactcagacgaccatcgcaccctcgca

SEQ ID NO: 573272 - DNA, 238 bp, Homo sapiens
gtcctacagagccatcacctaaatatcagcggctgtgactccccatgtacccccacaccaattatgaaggccaggcatgggacacactagtaattcccctctgctttatggtccagcttaaaacgctgccataagcaggaattctaactcaggtatagcacttattggaaattcccaatcctcaggagccacacaagcccagggccagcaacaacacttcggggagcggagggatgag

SEQ ID NO: 573273 - DNA, 155 bp, Homo sapiens
gctgtactttcttcatgaattcccactgatcactaaccacacaacaccatctcactgacaccatgttcaaccactgtcttttactataacaaattccaggaactggaccttaggaaatccaagtatcaacaccaaggattgtggagatattccac

SEQ ID NO: 573274 - DNA, 266 bp, Homo sapiens
gatctagagtttaccgcccgaataacctcactaaaggtttacgaatgaaatttgggagaagctcagctctgtaaaatagctcccgttttttttcttgggaccctacttaataccgtgggctcccattgtgagctgattaatttcttgcaatcagaaaccatccctatcacatcagataatttgtggtttgacctagggaagaagaggttgagcgaagaacccccaccaggtatggtttgagagtctttattgagggttaattgcgg

SEQ ID NO: 573275 - DNA, 103 bp, Homo sapiens
gtggctgtaagcatgactttattagagtttaggaggtcagaaatactgaagtcaaggtgtgggcagaggccagtcccttctgtcgtcttctcgcccccgtata

SEQ ID NO: 573276 - DNA, 179 bp, Homo sapiens
gacatctagagatcccctccgaccactggcaggcatgtattaaatattgagacaattgcgggtatgtgatacgttgagactactgctgcactcaaacgctccctaacagatccaaaatgtgtccagttcttcattcattttctttcgggcacaggcgtgagagagagagatagtggcta

SEQ ID NO: 573277 - DNA, 457 bp, Homo sapiens
tccagtccacaacactacaatccttcaatctctacagaaccttaaatccattaattcgggggggtttcaccatcactaacccccatgtgctgtttaccagattaaattttagtcaatcatgataattaatctcacataaacctatagttcccttgtctctcttattctattgtatctacttggaaaaaccataaccctgattaagtgcactctatttactcctgccctgcatatgttcagctgaaacacggctaaaataaaagataaataaaagtgggtggtctcagctgggtgtggaggctcacacctgtaatcccagcactttcggaggccaaggcgggctgatcacaaggtcaggagatcgagaccatcctggctaacacggtgaaagccagtctctactaaaaatcaaaaaaattagccaggcatggtggcgggtgcctgtagtcccagctac

SEQ ID NO: 573278 - DNA, 450 bp, Homo sapiens
  misc_feature (2)..(2): n is a, c, g, or t
antcttgagtatactagtaaatctggaaatcgcgagttagtgatgtgagttgacaggtgccagaggatttagcaagggcacgcattaaatgctatagtgtgaggcaaaatatgagttgagttatagttaataactaaatggtcaggaatagagcgaggaaagaagaaagagtaatagatagatgaaagagttaaatttttcttagctttagagtaggtagggtaatctcctgggactagggcccacaactctggagggggtggcgctttcttgactcgggtatgatgagtccatcccttttttgctgtacgaacaggggtggttagcagcacaaggtagggtccttcccaggctggctcgagtttaccttctttatcaccctttggtgagaccgtgatcttcaggctggcgctggtttaccggacattctaaggtgtggtacatgtgcta

SEQ ID NO: 573279 - DNA, 109 bp, Homo sapiens
tcggtacctgggaagcagctctttcgtggtctacaacgggcagatcacgcccatggcaccgccggcctcaactgcaccggcctcgggttatcgctgctgtcgcagaaca

SEQ ID NO: 573280 - DNA, 288 bp, Homo sapiens
  misc_feature (231)..(231): n is a, c, g, or t
gatttgcagacgacatgagctgctgattctatcactgatcggggaggataaaggctttggaattagtgttgacatcagggctcaaagtgtggggtctggggtacaggctgcagaggctgacaggagccacgtgtgtgtgcatgtgtgtgtgtgtgtgtgtgtgtattctctcgtggtggacacatatgtcttcagcaaccctggcctgcgagagctccctcctgagctggngcaggtgggcaacctctggcagctggacactgaagacctgaccatcagcaatgtgcc

SEQ ID NO: 573281 - DNA, 165 bp, Homo sapiens
gtacgaaggcaggagtatgtatgatggtccatcctggcatgagcagtggctcacccaccggccttgaacgaggtgagcttggctctctggtccccatggacttagaggggaccaggcaagaactctgcacagatgctttgtggggcctgtgcatgtgatttgcag

SEQ ID NO: 573282 - DNA, 503 bp, Homo sapiens
tgtggatgatgtgggtatgtgtgtacatatatatacataatttttaaaatattagcgagagtcatgtctttcacttttaagttcagggagcagtttgttctaaccacacaaacattctcagtgtggtatttcatggagctttagagacaaactaatgtctcattacataatgaaatatgaacataccatcgtgttatttcaatgtcttcaaatacatgatctgagggtgtatgtcacatacttgtgtaccaactcttagttgtgccttggacatttgcattgcctacctgcaaacaattactaggttaactagaattgctatgcagttctaccttgcgagtgctacacggtaattgcattttaaagtatatttgcacattttacatgctatgctatatgattgcctttgggttttgtgtacagactatttttgttgatattcaatgaaaattataggcttgaaataatactgttcctatgtgaagtaaattgctataacctaa

SEQ ID NO: 573283 - DNA, 526 bp, Homo sapiens
gaagaaaacacactgaaaaacacgaatggtttgcagtaaatcctatcgttcaggaatgtagtatgaaggagggaataccatgatcattgtattgtttcctataggaaactgacattaaaacttcagagaatctacagccgagttcgaagggagactgggagctctgtcgcactgaatgacctcgcagaggaagactacactgagaaaccatttcactcaaggaaactcacctcagtaccacgcagccagacgttgccgagaaatgttccagggaagaaagtaatgggaataaccagcaatgtaccctgtcaaggaatgaaggtagatcattgtgaaagatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgt

SEQ ID NO: 573284 - DNA, 254 bp, Homo sapiens
tagcctcgcagtgcttgcttgcacgctctactggtcagcacctgcgcatccacctggtagcctaccactgctcctactgtgataagtccttcctggcagctctcccacctccagcagcacaccagaatccacacatggcgacagaccctacaagtgcccacatcctggctgcgagaagtgtttcactcagctctccaacctccagtctcaccagtgccagcacaagaatggacaatgccctacaagttgtcccc

SEQ ID NO: 573285 - DNA, 768 bp, Homo sapiens
  misc_feature (9)..(9): n is a, c, g, or t
  misc_feature (35)..(35): n is a, c, g, or t
aggtaaacnataatctctgtaatgcagtggtatcnaataattaacaggatacaatttattacaaataacatatacaagattctatcaacatttaagcaatatgatacaattttgggatgcatattaataacagatttatcaaatacaactcaaagaaaattaaacaacatttttatttgatcagcttcctgtatgattttaatataccaaattagcctaatatgtttcttttggacttccaggggccctatttggacttccaagggctttaatgcccaaaagttagcttgaggtcgaaaacatttaagttagaattttacatttgattttggaaagtttgtcaaatatcaaaggtttaaaacacttgatcaaaataagattacaggtcactgtaagataatagttattcatttagccaaactgataattcaaaaatttcaaaaagcaaaaattttactctttgacagaggggagattcagttttccaaacaatcaaaagacataataaaaacagcattagggaaattctctcctcttattactaatattttttgcagtttactcaaaaggtaaacaaaaatcttttactatttcttattaatgtatacaaaaatcttgttcaaaagagaaatccaaattctaactttgtgccagtgtattataaatgctaaagctaattttaatacagccttataaacagatcaatccaattgcaattgttttcttttcctttttttgtttttttttgagacagggtctcactttgtc

SEQ ID NO: 573286 - DNA, 181 bp, Homo sapiens
  misc_feature (8)..(8): n is a, c, g, or t
  misc_feature (170)..(170): n is a, c, g, or t
gctgggtnatctaagatccgcagtggtgtggtaaaaactctagagagcatagatgtacatgagcatatctgaatgctccatccccgtctcttttctatcttatagctgtccttgcctctgccctggattggttggcaaactaaaggacttgatgtacataactcctgtcnttttcccttac

SEQ ID NO: 573287 - DNA, 226 bp, Homo sapiens
tagtatccaaactgtggtgatgatcgctggacgatgaggtctggggtgaggttgctggccctgtcgctctgccggaatgatgccccgttctcttgggcgtccgtggctatgggtcgggagccgtcctctgtcagagtatcagtttctgtcttgtccggtgacgcagcgatggttcaacttggagagtgaccttatggagctgcatgctgtgtaccagcgatactgg

SEQ ID NO: 573288 - DNA, 823 bp, Homo sapiens
  misc_feature (136)..(136): n is a, c, g, or t
  misc_feature (510)..(510): n is a, c, g, or t
  misc_feature (558)..(560): n is a, c, g, or t
  misc_feature (583)..(583): n is a, c, g, or t
  misc_feature (727)..(727): n is a, c, g, or t
  misc_feature (729)..(729): n is a, c, g, or t
  misc_feature (731)..(731): n is a, c, g, or t
  misc_feature (734)..(734): n is a, c, g, or t
  misc_feature (741)..(741): n is a, c, g, or t
  misc_feature (760)..(761): n is a, c, g, or t
  misc_feature (777)..(777): n is a, c, g, or t
  misc_feature (779)..(779): n is a, c, g, or t
  misc_feature (787)..(787): n is a, c, g, or t
  misc_feature (820)..(820): n is a, c, g, or t
acccccactccttcccttaatatcactatccattcgccctccaccttttcttctcacctatcatattctttccttctacatatctctccactctacatccctcccctctcctcctacaattctcactcccatcacnacatctttccctctctattaacacctctcgcctcttctagccacaaaaccctctcataaccctaagccttctttcttctctcaccttccttccacatcaatccccattaccaacccttcctccctttcttcccattttagtttctttaatattaccctcttcacaacctttcccccctacctcctttatcttctattctcattaatccctcttcccccacacccacctctctccaatctctcttttcctcactgtttctaccattcctcctttctccccaattatcccccttactctccctcacgttacttccccatcttcacaccctaaaatttttctcccttattcctcctctccacccaactctctccgcntccaattatcccctctttcttctatcctctatctaaacatttatctcnnnccccccttccactcaccctcctnctccattatccacttatttctctactctctccccctcccccctctctttttaacgccatctccactacctttcaaatcaaaaatcttttcttctcatatccacctttaataccactcctcccgacactacttatctcaacccancngnccngttccangtccattcaacctcaaacnnccccccccccgctcgngnattatctntcattatctctcaatattcacactttttcccanccc

SEQ ID NO: 573289 - DNA, 612 bp, Homo sapiens
tacttcctgtgtgtgttgtggatgaggaaatctgctcagttggatacccacactttgggcactgggaaaatttttccaaagttctcaaactatttgaaagaatatgagcatagttcctttaagaaatctggtgatattaaagtataggaaccttgcattgtctttaaaatatagttcagacagtaggctcagaggcagaaaaacaaaaggcactgagatatttacagtttcgaatgaatattaaagacatcagggagaaattaaatttagttttctaactgcaataagtatatgcaatcaaaggtggggtcggaagttgtaaaaaggaccaggacagctcacaggtaagaggagtgcagggaagacacaaaaaaatcagaagccaatactgagtaagtcagaacttgctgaatcctagtaccaaatgtgagatggaataggtatgaccaaagtctgcccaacaagcccagggcagatggacacacaggattccaggggacagcatgggccctgcagccatgtgggctggaagggcacttcatctaagggggccccagattcccagccacagccccaggacaagccagctcaggctttcttaccagggcttgg

SEQ ID NO: 573290 - DNA, 144 bp, Homo sapiens
gggtaaaaggctttccccccaggggtgggatattttgaaggggtttttccaggggggggaaggctttttttaataattaccccaaatactttcccgaaaattggccgcttttttgcccaaaataacccttttggggggctttta

SEQ ID NO: 573291 - DNA, 113 bp, Homo sapiens
cgtggacctgaatcgatattgggctatcagggtagcagcacagcaagttgaagttacaccccagctatatcagggcaatcatggaggagagcagagttgtatgagaagacgga

SEQ ID NO: 573292 - DNA, 210 bp, Homo sapiens
cacatgagagttacggaaaatgggaagctgtgcagatatacaactcaagtggtcgctggaacaacattactacattcaggtccgagcaggtgataataaatatatgcacttgaacgtactcaaaagtcttcccggacaaaatgaggacctgtggtaccttacgggactaccaggattgacaaaagagaaggactgacgacgcgtgaccgg

SEQ ID NO: 573293 - DNA, 888 bp, Homo sapiens
tacggggcgtatataattcgtgggcgagaagaaattagacacggggttaaacaaagcgtttcttcacctatatgtttagcccgcggatgtttctcgaaaaggagaatgtggtcggaaaggtcgggcataaaatatggtgacggctgcaagcggtgatgatatctagggccgcccacaacccctagcgggtcaaatataagggaaaaacaacttgaggcgttaaacataccgccgttgccagcagattgctgttatttgctaagccattggcggcacttaccggccatttggcccaccagtagtggaattattgcgcaagctatcttctcgcaaaacaaggggtctccaaaacaaggatgtgtcttaagcaggaggtaattttataagtgggaccagttctcggcaccaattgttagagcgatgtttggccgccccgccccaacgtatataaataggtggcaagcgtagtattacgcaagtactggggaagatgttacaacccccagatataggctaattcatcctacagtgggctccgccccccttctattgacgagttcatcagtaacaagagtccacacaccacactcttgtcgggagttttggaatgtagaatggggcggtccccgagacccagggttttgctatagtgaaggaccttaaatatctagggacagtgtttgttcaagatgaggccaaagggcaagtgctatagagagacatgcgctctcaggcgattggaaatgtgttccctgcatggcacgcaaggggaatacccctcgaaacagaagaattccaaggtgatcatgaagtcacccacacgagacgcttcaagaagattgacttttgtccactatcaatactgacacagactttgcgcaacatatc

SEQ ID NO: 573294 - DNA, 576 bp, Homo sapiens
acatatggtaccttgtatagttaaaatatatagaagtactagataaactgctattctagtagcaggtgcacaatatatcataatccatcaacattttagaagagtacaaacttctccacctctccactgatatttgttctttataagtaattcccattctattgggtgtaatttggtactatcaggtggttaagatttacgtttctgaaaagactaataatggaagcatctttcatagaactgttggctatttgtgtatcttctttgtagaattgtatatataagagctttgcctctttttaaaatttgcctattattgtacatatttatgtagtacatatattttcatgcatccacaaaatgtgtgataaccataaaaggataactgggatactcatcacctaatgcatttattatttgtttgtgttggaaacatttcaaatgttcttttaggtatttggaaataagcattaaattattgctaactatggtcgccctaagtatgctattgaacactagaacttactccttctgtccaactgtatttttgtagccattaaccaacctctcttcatt

SEQ ID NO: 573295 - DNA, 160 bp, Homo sapiens
ctagcggatccttatcaacatcagtgtgcccttctacaaactctttttgttttaacccaggtccctccccacctacccccttcctttgcttgcagtgaaaaaagtctcaccttattttccctgctagcaaaggcagggtacctgcagctcgaattctgta

SEQ ID NO: 573296 - DNA, 202 bp, Homo sapiens
cttgtttctctttatggcttggcttcattcagacctggggtggagccacatcaaacccactgcccactggctgtccgtctggcctaccccgcggttaccaaccacagtgatgaagcagcgcttgcagatgtacaactcgcagacaacggtcagcaatcagctgcatacagacggtgtggaggaccgaggggttgggggcctt

SEQ ID NO: 573297 - DNA, 270 bp, Homo sapiens
  misc_feature (6)..(6): n is a, c, g, or t
ccagangtccagtcaagtgccaaccattttaactttcttgatcatagctgatggccttcctgggacaacctggaaggtcaaagcaagaactcttgagattattctagctgcaactaccagtggtggctgtgtatattactgctgtgtagaaacattagtagtgttttcattttaggtccaagtaagatgtttttagtgatatacctgcagaatggctctgtcttaaaactgtgtagaaaaaccctaatctttaggagctttccctaagga

SEQ ID NO: 573298 - DNA, 115 bp, Homo sapiens
tggtcatctagaggatcccttttttttttttaattttgaagaaagggtcttactctggtcacccagggcgggagtgcagtggtgcaatcatggttcattgcagcctcaacctccc

SEQ ID NO: 573299 - DNA, 103 bp, Homo sapiens
cccataagcgaactcaccggtgaagtaatgcttgggaaatgctcaacaacttaggagccctgagcccaccataggaaaagacatgtacattttgtcacaatct

SEQ ID NO: 573300 - DNA, 159 bp, Homo sapiens
gctatcacattcactcactgcatgcatgtgttgttgccctgtgtaatccctgctccagtacgcagcaggaactgcaggtccagcacatttggtgtcatgtagcttgtgttgaggcagccaatgtgggctgcaagctcaccatcttgtgtggcattcacc

SEQ ID NO: 573301 - DNA, 876 bp, Homo sapiens
gggaaaacgtgattcttcagtctgaaataaatacttagaacacgacttggctcctacaagcaatctggactcataggtcatcagatactggagctgtctcacccgatgggccaccacggagggtacgcacacaggttcccatcccaccccgctgcatcaagacacaggaatcgcgctgcctgatggttggactcggcaactgcgcccctttttctagaagccttccccggccaatctacaggcagcgatgcggcctggcgaaaaagacaactgagaatttcatcgacaggttgcatggtccgcacggattgacggattctacgctgcgtctctctatggttccacctggctgctgtgctgtgctgtgtgcgaggacggccgccaggcacctctacactcaccattcatagaagactcgctagataacacggcaccagacacagcaagcgcgcaccccacagtgcaccacgacagagcacgcttgagacacaacagcaccacttgaaagaaagagcccttgacccaccccatcaatcatctgcacacgcactctaagcctacccaacagctcacacaggatgaccccggtgaataacatgactgctcacgcactacacatattgcagccccggcaactgcgaatcactcactgcggcccgaccgacacacgacagtcgcaacgagcgcatagcggacccaccccaaccgcccgccgcgccccaacagcgaccccgcatcgacagagagaccaccgacgccacgcaactcccatataccacagacctgcaacgcgaacaagcaaaggcatgcagcgttagataacactcagcgcaggacccggagcggaacaaacaactagagccactgaggcagagc

SEQ ID NO: 573302 - DNA, 402 bp, Homo sapiens
atttcccacctcaggagtcttgggagacacagctcattcctccctacagaagctaaatatactagaatcttgatttcctggcatccgttgaagtcaggttacaggcctagtggtagtgatttatggaaaaaaaaaaaaaaaaagcccagagcctcctttccggtgacagtgttggttgcaggcaggtggggtttccatggcagcagtagcagcagcagcggtacaaggtgaagcacgtggggctcgatgtcattgccagtttcttcagcagaccagttttgcacatgatttcaggaattgttcctggctgcacagctctgagtataattctctagccttcctgacaattctgtgaaccacgtaaaaaaccttataataaattcatttttttcgcttaaaaaa

SEQ ID NO: 573303 - DNA, 258 bp, Homo sapiens
  misc_feature (65)..(65): n is a, c, g, or t
  misc_feature (74)..(74): n is a, c, g, or t
  misc_feature (92)..(92): n is a, c, g, or t
  misc_feature (117)..(117): n is a, c, g, or t
  misc_feature (123)..(123): n is a, c, g, or t
  misc_feature (183)..(183): n is a, c, g, or t
  misc_feature (188)..(188): n is a, c, g, or t
  misc_feature (199)..(199): n is a, c, g, or t
  misc_feature (216)..(216): n is a, c, g, or t
  misc_feature (224)..(224): n is a, c, g, or t
  misc_feature (226)..(226): n is a, c, g, or t
  misc_feature (234)..(234): n is a, c, g, or t
  misc_feature (239)..(239): n is a, c, g, or t
gctaagtgttcgctacgcgggggctaccggatcggtcggaaatggcagaggtggaggagacactnaagcgactncagagccagaagggagtncagggaatcatcgtcgtgaacacanaagggnattcccatcaagaggcaccatgggacaaccccaccaccacccagtatgccaccctcatgnacagnttcatcctganggcacggagcaccgtgngtgacatngncccccagnaacgntctcaccttccttcgaatt

SEQ ID NO: 573304 - DNA, 876 bp, Homo sapiens
  misc_feature (434)..(434): n is a, c, g, or t
gctgctctaggagtacccaagtcaagaagcgggaacgtagcagagtagttggtgatcgttgcgcagcaggatgtgattgcgctaactaacagattcaggatgtctgtgtcccattaaaagcatgaattgtggtctcggcgggtctactccgagatcgctgtccgcgggtgctcgcctggaggattgaggaatgggcgtagccgcagatgatatcgaccaatgcatatcgcccggtctcagagcaagtcctgtggcagtactagtgccaattcgccagctctatctaaccaggagcgtatagaacggcagggccatgagtagttgcagtgcacgtcggttagattgtgccacgaacccatagcgtaaagcgaggggatggatggctagtactacctcacgttgccatgcctaccttgtcgtccctaggtgtcatngtagacttgttccgatgctcatcttcctggatgtacagtagtgacgttacagtgggattgcatcactaatgcccacgtagtctgatgtgcttggagtaaaaatgcggttgctagccattgggtagtgccatctgtgctcgcatactccttgatggctcagcgtgtctgtcccgctctggttcgttcctaatatgtgcgggaatacagggcctatatatctgcaatgcgtggaatcgcagacgtactatgctgtctactatgatcctgatcagacctggcgattggcgcagatccttgtggctcctcacagtccgccagggcaatgaggctcttgtcatgatccactgataaggatgttcttctcctctttgtaccaagtacctagaacaggtttcctactccattctgtacttcctatagctgcggcatgtacatgggagga

SEQ ID NO: 573305 - DNA, 173 bp, Homo sapiens
  misc_feature (6)..(6): n is a, c, g, or t
  misc_feature (78)..(78): n is a, c, g, or t
  misc_feature (151)..(151): n is a, c, g, or t
ccccangacaaatatgtttatttacaaaatccacacatcctgcctcccagcatgcactgcctggagagagtgcagtgntcaggccctcacacacctggggaccccaggggcaagcagggtgcacggtaccaaaccatggggctgggggagngctggaggccaccctggcccca

SEQ ID NO: 573306 - DNA, 222 bp, Homo sapiens
aggttagtgggatccatgcggcaattacaggagctcagcactaacagaggagccttatccaccttcatcacacagacttagatggacacacacacactctcgctcacactctcacacatgtgcacacatacacacactctctctctctctgtgctgtccacctcctctgtgctgtccacctcctctgtgctgtccagctgtccacctcctctgtgctgtcca

SEQ ID NO: 573307 - DNA, 129 bp, Homo sapiens
agaacagcaaatggggttacctggtggcttgggtaaggatatgctttgtcgttgctgtggtctgggttgctgctgtggtgatggttagattccctggccccggaacctatgcatactgtgggtgcagcc

SEQ ID NO: 573308 - DNA, 164 bp, Homo sapiens
tatgttaataagcagttagctgttctcacagataagatgattgtggtggcagccatgagtcatcagtaaaccagtgtgagcagtgcaggactgaatgtctgctgtccacttgcagtgtgggagtccatgtggagggtgctcctatcttgtttcacatttttgcg

SEQ ID NO: 573309 - DNA, 543 bp, Homo sapiens
  misc_feature (39)..(39): n is a, c, g, or t
  misc_feature (135)..(136): n is a, c, g, or t
  misc_feature (267)..(267): n is a, c, g, or t
  misc_feature (475)..(475): n is a, c, g, or t
  misc_feature (503)..(503): n is a, c, g, or t
aggcggccaaccctttgttttgaattttccaatgtattnaagccattggaatcaatattgaagcaagccctggagaaatttacccggggtttaagtgccctccacaaggcaaaagaaaaacttgcccataatganncaatggtttcaccatcccaccttttcctagcatcagacccatcacttccaagttgcctcccgatctggcatgcatcaccatcttcagcagagccaatgctgagattttgcagtacttaaagtaatggtganccttagtcccagggttcgccgccaggatttcttgctgctgtttcttgtcgtatttgtagatttcatcgatactctgagcttcctgcatgttgttggccagttcccaggttttctgggccataccgctcccggacgccgccatcgccgaggaagcggagaagttgtcgtctctacaaccaagacgcaactttacctcgctaggtttccngggtgtggccttgaccctccgcaccacngggaacaaactcttaccctagacgtcttgctcgtgcccga

SEQ ID NO: 573310 - DNA, 347 bp, Homo sapiens
ccagatagcctcggatacggaacatacggcgttgggaaagtaggtcaggagcacctaagatcagggatgcgtaccatttgcgacacttcacagtcatgaagactgagaagactgtctgcagcgtgaactaaagtcacaggcagatcactgatccagaacacttcaagaactcgtcaaacagctcgataagcctttttgactgtgtacatcggtaccgggaataacattcctaggctgaaatttccacaaagaatagaacctgtacccagttcttcaggctgatttccctgacctcttgggcatttgtatttgtagtaaagtatagcagagattcctaagtattttat

SEQ ID NO: 573311 - DNA, 171 bp, Homo sapiens
  misc_feature (122)..(122): n is a, c, g, or t
  misc_feature (166)..(166): n is a, c, g, or t
atatatatatatatttgaacagacgggggtctcactatgttgcccagttcattctccaactcctaagctcaagcaatcctctgccttggcctcccaaagtattgggattacaggtgtggagnccaggccccatttaccttgtttgttgtcttacatattagaacgnctcca

SEQ ID NO: 573312 - DNA, 479 bp, Homo sapiens
  misc_feature (300)..(302): n is a, c, g, or t
  misc_feature (307)..(307): n is a, c, g, or t
  misc_feature (324)..(324): n is a, c, g, or t
  misc_feature (330)..(331): n is a, c, g, or t
  misc_feature (336)..(336): n is a, c, g, or t
agtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataaaaaattttttttgggaaaaaaacccccccctttttggggnnnttttnccccaaaaaaataattngtgggnngcccnccacgatctcactaaaggatttctatttgctgtcagttaaaaataaagccctaaatacatttttattctttctactgagggcattgtctgttttctttgtaaatgccgtacaataaacaaattatttaataacctaaaaaaaa

SEQ ID NO: 573313 - DNA, 848 bp, Homo sapiens
ggctgttggagcccatgacgcctgtcgggatgcaaaagagaagcgctctacaaagccaagatgcagattcacctggaagttctggggcccctgaaaacttgacattcaaggaacgccagcgtcttttttcacaaggtcaagatgtatccaataaagtgaaagcttctcgtaaattaacagaactgtggagaatgaactgaacacaaagtgaaagaaaatgaggagaacactttgtatttaccccaaaatcttttcagttgtgggttagtaggtgcgagatttgaagaggaaaaagaggaagggggttatatttctaagtgatttacaaatttctgtgttcataaaattgtagggatttagaaatgttcaaattccaagaaatgtgtattgttaaatttaccatgagattgcacatatagatgtaattataaaacaatgttcatagttacttaattatctaaaaatcacacgagggtaagtaaaaggtaggattacttttaattggagtcaatgagattcaaaggggacagaacataagggcaggagaagagaatggatgtgtctatctaataccaatattaaccaatcataataggaacgaggagcacaacagaagatactgatggactgaacaatgacagaaacattttatatagctagtgaagcagagacataactagaaatatcagactatgaggaaacgtaaaggagaaacaagagcctctaccacgggaaggacctatgagaaagtctcaagtaccctgatggagcgtacaaagatctgaacctaatagaaggctagccagacagggatgaccagcgaagtaacacatccaaatggatcggta

SEQ ID NO: 573314 - DNA, 202 bp, Homo sapiens
ttgaaaagataaaggggcacctgcattcgccgaaaggctctgtatttcatgttcaaaatatggtcccgggccccaaaccttccaaaaaaagggttttatagcccaaagtgctttcccaaggacttgggctcccccttggtccctccatcctgttacgtaagaggttgttttcagtgttcttcaataatactctccacttcta

SEQ ID NO: 573315 - DNA, 188 bp, Homo sapiens
tttttttttggggaaaaaaatactccaaacccccttttcttgctttatttttcaggggtttattgctttatgaacgggttaaccccgaaatccccttggggtttttatacgggataaaaaagcaattccccttaaaacggggctcgggccccctttttttttttgccattaaaaatttttttccccta

SEQ ID NO: 573316 - DNA, 361 bp, Homo sapiens
gcatgataaatcgagtggtaccccccgatagccctgacagcatgtgtgtggcaggcagtgtacaagtgtgttgcaccctagggagctggtattgggctggaatagggagtatcaacagcgccttccagcgtcccagtagcctcccctgacgtccttctgggtcctcctcgtgagtgcatagctcgggcaggtcttctgggcacataggagatctggggggcctcccaatgatcggtctcttggcattggatcagtggtagattgcgctgtgccatgtccttcctggcatgggtagcgaagcacagtgtccacctcatagcgcagccgtgggcggcctgaacacctgtcgggctagtcgggg

SEQ ID NO: 573317 - DNA, 260 bp, Homo sapiens
  misc_feature (47)..(47): n is a, c, g, or t
gggcccccccccaaggaaaaatggttttttggggggtgagctgaggnctgacccatttaaaaaaaccccctgattccccccctggaatcccccccttttataaatgatgggggtttaaaagtaccaaaaagccccccccttccaaagtccccaaactggaaagtttattccttttttttggttttaactgaaacctgagggattttttatgggtatggttgggtattgggagggaaaaatttttttaatttcatttttta

SEQ ID NO: 573318 - DNA, 401 bp, Homo sapiens
cgccctctaaatatatacttagacctgtgaaatgcactcagactcgcgtgtttaggaatatttaactttctttcactacattggcactaaattttttctttataaagctttttgaagggcataaacacaagaccattattgatgatatgacctaatacatttcctctgtgtgtgtgtgtaacatttcaaatactttttttttcttttccactggttgtaaggtgcaacaatttaatatttttaagggactttttaagagatccttaagaaccaatttttacttcagtgcaatcctacacacggtcaacattagttttgagattagacttataggatcttccattctatttttatctgctttttgctggtaggttcctgtgcaggtttttccttttggtttt

SEQ ID NO: 573319 - DNA, 781 bp, Homo sapiens
ttggcccccggcaccccgttataacgctctttgcgagctggggcctcgctttgccccgtcttgggagcattctttggagggttttttaccccgcgtctccaatatggccttcccgatgggcccccacccagggtggtaccgccccccggtggcgcctggcccccccctatgggggtgggccccccgcggggtgccacccccacgtcgggatggcggcaccccctggtgcctagcacacccctttcgccttgggcgcgcccccatctgggcccccactccgtaagtggggtcgcaactacgccgggccccacatcttgtcttccttggtgcacacgaggatgcccccattgactcctcctcgggcgttgcttgcccccgcgctcgtcgaagacacaaatgccaccctatagcctgtgcttctctgggcgcacacacacaataaccgtccggggctgttgtcttgtgctccccgcgcggtacacatcacccgcaggctcgcaacctggtgcactccctcttgtgcctcggttgtttttgcggcgacgtgtgcattcccccgcgcggcgcgttatcatgaccagcggtcttcccgcgctctctcccaggggaggtcttctcctcttccctggcgcgcctcttgtggctccgcctctccgccccccccgttgtggcgggcggtctcacccgtcgtttctcggggagacccccggcaccccgacgctcgtacgttatcaccccgatcctcctgattatacccccgttctcagcggacaacaaaaca

SEQ ID NO: 573320 - DNA, 201 bp, Homo sapiens
gtagtctttaggctgattcacaaaagtagcgctggagagaaatctggatggtattagtatatagatggtatttacaaccaagggaaatggatgagatctcctagagaacaagtatagagtaggaggagaagaccacactccaaggaattcaagagaaaatgtaagagcttgttattagagaaaccaacataggaacatatt

SEQ ID NO: 573321 - DNA, 728 bp, Homo sapiens
  misc_feature (226)..(226): n is a, c, g, or t
  misc_feature (373)..(373): n is a, c, g, or t
gtgcccggcgtcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgcccgcccccagccccacacaagatgtcagaggatttagcaaagcagctggcaagctacaaagctcagntccagcaagttgcagctgcatatctggaaatggagaaaatgaagatttgctacagattgaagaaagatttacaacgaagttatagaactaaccacagaccttctgtcaactcaaccttctgagacgcttgcaagttcagacagtttngcttctactcaacctactcattcatggaaagtaggagacaagtgtatggcagtctggagtgaagatggacagtgttatgaagcggagattgaggagatagatgaacgaacatggcaccgctgcaatcaccttggctggtcatggcactgctgaagtgactccactgtcgaacctcaagcctgtagaagaaggaaggaaggcacaggaggacagtggcaacacgccccaatgctcaaacacaacgaaatgatgcccacgcagcgtgaatataaggacagaagaaagctttgacacacagctcagagcataaagacacttgagcaggaaagcgacgaccaagacaagtgaacatgga

SEQ ID NO: 573322 - DNA, 159 bp, Homo sapiens
gacggtgagaccaaaagtcaggcccggagaccgtgcctgtgtgctcttcagacatgtacttcatcccggtggccgaggattccgacttaccccatatcagaagctgccctacggcgtcttctcgaccagaggcgaccaaggagcgaggataggtgtggc

SEQ ID NO: 573323 - DNA, 362 bp, Homo sapiens
aacaaatatgatgaacagtaagggagcaaagtggttacggacttacaggaactataactattctggaactaaggaatagaaaccgctgaccttgggccagcaggttttataactaacttgttacttgcctttctcacccagttaatcagactctgtactatatatacccttttatgaaacaagtgtctcggttcactaattctagttttatggttgtgctaaattcatagcaggtgccttattctttgcatttaatcaaaccattccatatcaacattttccttggttaactatagatataaggctttaagttgtcgtatgtgttatttactgtacaatgttctgataaattagactgttaa

SEQ ID NO: 573324 - DNA, 114 bp, Homo sapiens
ccacaggctatacaccaaagcgtaaccctaacttaaacttggtgggactctggggtgactaatgatgttgtccggtgtagggctccatcaatttgtagcggtattgtacccact

SEQ ID NO: 573325 - DNA, 649 bp, Homo sapiens
tcttaaactataatgtctaataaacaatattctgggcacaactctctttaaggccttaccctccttccttcattgggaactccaactcccctggatacccctcttttcataccaagtttctcacggcgcaacccctctttcttccccagtaccccctccctataccccacgagcttcctctttttctctcttctaactccctataggtttctcacaaataatcccccgtaagttttcttcacaactcataagccttctttacttctcccccctattctcccctaaatcgcatattacccagcaccctcgcctacaacatgttgcaatataatgtacccatcattacccacctttctaataatcctgccgccatattattgagcacgtttctttgcgaaccgcacactttactgcaaacttctcgtatccatcagctccccgtcttttaaagatttcctcactatttccccccacctctttcacccctttctataatgaggctgtataattctcctcccacacagtacacattaataaactatattgcctgcttatgacttcctgggacacctctaagcaagccctaaccactcttaaaagggtacaccaccccactttgtatgaacctttaaagatcaagcatctcaga

SEQ ID NO: 573326 - DNA, 120 bp, Homo sapiens
gtatgctcgtcggggtgttctgaggggtctatggcttgggctctccttgcagagttatttctagttaattcattatgcagaaggtatatggggttagtccttgctatattatgcttggtt

SEQ ID NO: 573327 - DNA, 1591 bp, Homo sapiens
atgcgcggtatgcaccgcatcaagagaacaacccgttcagaactgagctcagccagagacagatggtctgacttgatcatggaggttgtaaccagctgtgtctgcaaaggcttccaaagagctgcgtacttgaaacaatgaacggcctcactagagtgtgcccatcaggagcatgcacgactctgacatgcgcgcacaatcattcacacacaatcattgcacctgggtacttgcttcttgcaatgtgccagacttccgcctctgtgagaaagcgctgtgtagcactagtggtgaccccatgctcgttatcacgaatgatgctattcgatatcagagtatcgatgtggctcatcgacttggaggctctcgacgagcattcatcatgcacgaggacaacgctaagattccacctgagacaaggctgacatcaaaatcaactgctaggagaatgccatagaaggacacgaccggacctagcacaaagcgaaaaacgagaggacatagtgaggtcgaacatttacctcgtaccatgaaatttaccaccttaggttcgtttctcccggacccaattgcgacaacggcgcaaggcaagaagcggcgtcaaccttacggacagtttccctagtagcaacgtataaatagaagggggtgacgcacgtggaaaccaaatttagaaagcaaatcgcccaggaaatatggataaacacaagatggaacgaggccgttgagctagtgcccaccatacccaattggcgcttgctagcagacagccggtcttttacgcacccagaaccccctgaactactttcacagcggcaagtgacaacgaagggcctggatgcatccttggcacccggcggtggaaacacatggtgtatctcctgggagaacgagagattcaaacttggacgcaacgcgaaaaggttgtagctccaccaacataggggccgttgtgctaccctcgaccaccgtacaaaacatactagttggccccgattgctaccccatacgtacagaaccacgaaaagtataaaatccgccagccgtgagacatatacatgacgcccgctaaatttagacgtcacaacgtcccaactggatagccagacgatttggaacatgactaaaacggccgttgccaacgcattctggacggaaaacgccgccttggcccgtaacatacattacaatacttgaaccacccataatggcttcgcattttgtgaagcactctggcgtacagtttagaccaaccgttggccacgcccgttgtgggccaacacggcaaaaattagggcggatctacactacctatggagcacaaaacaatgagcatccggaagcaccaatgaaaccaaagcaccaggagacacaaccacagggacaagaaatacccccatacggctacaataccccgctcaagatcccacattagaaaaacgcctagggagcatgccgagcacgacccgcaacaaacaatagtaaacagaacagacatcaccaaggagagagatcatcaaggaggcaccccaggacgccaacaaacgacacgcacagcggccacagcaacaacagcacagagcagaacgac

SEQ ID NO: 573328 - DNA, 393 bp, Homo sapiens
gatgcataatacctacataaaaatatggcaataatacaaagagctttcatattcccacacccacttttccctattattaacatcttatgttagcatggtacatttgtcacaattaatgaaccaatacattattattattaactaaagttcacactttattcagactcccttagtttttgcctaatgtccttttctgttctaggatcccctccaggaagccgtgctacatccgtcatcatgtctccttaggctcctcttggctgtgacagtttcccagacatcccttgcttttgatggccctgagagttttaaggagtgccagtcgtgtattttgtagggtgtccctctattgggatttgtctgctgtttttctcatgagtctaaatgcaatca

SEQ ID NO: 573329 - DNA, 336 bp, Homo sapiens
tgagcaccccccaggagacaactttaaaccggcgaggaatttgaagttttacgcacccgacctgcattactccggcctgagctcagatcacgtaggactttaatcgttgaacaaacgaacctttaatagcggctgcaccatagggttgtcctgatccaacatcgaggccgtaaaccctattgttgatatggactctagaataggattgcgctgttatccccaggttaacttgttccgttgtccaagttattggatcaattgagtatagaagttcgcttggactggtgaagtcttagcatgtactgctgggaggttgggttctgttccgagggcgcc

SEQ ID NO: 573330 - DNA, 707 bp, Homo sapiens
  misc_feature (8)..(8): n is a, c, g, or t
  misc_feature (15)..(17): n is a, c, g, or t
  misc_feature (28)..(28): n is a, c, g, or t
  misc_feature (30)..(30): n is a, c, g, or t
  misc_feature (40)..(40): n is a, c, g, or t
  misc_feature (44)..(44): n is a, c, g, or t
  misc_feature (52)..(52): n is a, c, g, or t
  misc_feature (57)..(57): n is a, c, g, or t
  misc_feature (59)..(59): n is a, c, g, or t
  misc_feature (65)..(65): n is a, c, g, or t
  misc_feature (76)..(76): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (93)..(93): n is a, c, g, or t
  misc_feature (98)..(98): n is a, c, g, or t
  misc_feature (104)..(104): n is a, c, g, or t
  misc_feature (107)..(107): n is a, c, g, or t
  misc_feature (111)..(111): n is a, c, g, or t
  misc_feature (128)..(128): n is a, c, g, or t
  misc_feature (131)..(131): n is a, c, g, or t
  misc_feature (142)..(142): n is a, c, g, or t
  misc_feature (147)..(147): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (195)..(195): n is a, c, g, or t
  misc_feature (197)..(197): n is a, c, g, or t
  misc_feature (226)..(226): n is a, c, g, or t
  misc_feature (235)..(237): n is a, c, g, or t
  misc_feature (241)..(241): n is a, c, g, or t
  misc_feature (247)..(247): n is a, c, g, or t
  misc_feature (249)..(249): n is a, c, g, or t
  misc_feature (259)..(259): n is a, c, g, or t
  misc_feature (274)..(275): n is a, c, g, or t
  misc_feature (289)..(289): n is a, c, g, or t
  misc_feature (316)..(316): n is a, c, g, or t
  misc_feature (331)..(331): n is a, c, g, or t
  misc_feature (333)..(333): n is a, c, g, or t
  misc_feature (338)..(338): n is a, c, g, or t
  misc_feature (344)..(345): n is a, c, g, or t
  misc_feature (361)..(362): n is a, c, g, or t
  misc_feature (365)..(365): n is a, c, g, or t
  misc_feature (380)..(381): n is a, c, g, or t
  misc_feature (383)..(384): n is a, c, g, or t
  misc_feature (389)..(389): n is a, c, g, or t
  misc_feature (396)..(396): n is a, c, g, or t
  misc_feature (399)..(399): n is a, c, g, or t
  misc_feature (404)..(404): n is a, c, g, or t
  misc_feature (419)..(422): n is a, c, g, or t
  misc_feature (439)..(439): n is a, c, g, or t
  misc_feature (441)..(441): n is a, c, g, or t
  misc_feature (444)..(444): n is a, c, g, or t
  misc_feature (446)..(448): n is a, c, g, or t
  misc_feature (450)..(450): n is a, c, g, or t
  misc_feature (475)..(475): n is a, c, g, or t
  misc_feature (483)..(483): n is a, c, g, or t
  misc_feature (506)..(506): n is a, c, g, or t
  misc_feature (552)..(552): n is a, c, g, or t
  misc_feature (577)..(577): n is a, c, g, or t
  misc_feature (608)..(608): n is a, c, g, or t
  misc_feature (633)..(633): n is a, c, g, or t
  misc_feature (701)..(701): n is a, c, g, or t
tgttagtnaaaaaannnaattgtaaggntnaagcaggggntatnggggaaanaaaananactganagctttgaagngttcagangcnaanttnaaaanaaatgnganaaanaccaatcagatgttcanaanacttttcaggntccanatcaacttgattatggacatagttcaanananaaggggaagagaaagngngtgtaatcaccaaaaattaaaccagaggnataattttnnnaaanaatttngngttacagaanaaattctaacttttnnaaggctaaagctanataaaactcaaagcaatctatttgggnacctgggggcaaaangnctttncttttnnctaactaaacataatnntgngcattgggggaaatnngnnttcangggggangcnttggnaaacttttccaaaannnntggggcccggctttagngnganannngnaggggacacatatatgggggggtgngggggggncaaagactaatgacaatgtatgnggttaataggcctgtaatggaaccatgatactactaataatatganataaaaagccactcatttatataangtgttcctgaatggtgcaataagaaatgggntcacagatttatgtacatatatgantcactaagagttcagaaattaagctcactttaagaaaactcagccaggcacagtggctcacgcctgtnatccca

SEQ ID NO: 573331 - DNA, 216 bp, Homo sapiens
ggctgcaaacaaaactactgtgtctaagtcatcaaaagtatgtacaggctgggcagtggctcacacttgtatcccagctactcaggaggctgaggcaggagaatcgcttgaacccaggaggcagaggttgcggtgggccgagatcgtgccattgcactccagcctgggggcaagagtgagatttcgtctcaaacaacaaaaaacaaacaacaaaaa

SEQ ID NO: 573332 - DNA, 843 bp, Homo sapiens
gagtcccagaggttaccccaaggcacccctctgagatctcggtctgcttctgctcgacatgacaaaaaactagcccccatctcaatcatataccaaatctctccctcactagacgtaagccttctcctcactctctcaatcttgtcatcatagcaggcagtcgaggtgtgatgaaacgaaacccagctacgcaaaatcttagcatactccttcagttacccacattaggatgcattatctatgcatgttcttatcgctgtatcaacccggtaatcatacccagtgcttaatccaaagctagtttatatcatacacaacctatcgtactcgcattccaacatactcatagattaaacgtcccatgcacccatgatccgtactactatctctgcacgctgaaataaatgctaccatcactaacacccttttaatttccatccaccccgtccctctccctaggagggcctgccccacgtctaaccgggtttatgcccggaatgcgcacattgtccgaagaattctgtataaaatgaatatgcctccatcattcacaacctatcatagctcagcgatcaccctccttaatctctacttcttccttacgcctgatctacatcccacctctactcacattagttccacatatcttaaccaacgtactaaaatgtgctgatcagttggaacatataaaaacgccactcctatttgctcccacaacactcatcgcccctttaccgtgctaatccttaactatctcgcctattttatactgaatgatctatatagacatcaaaatcaatggacaaacactgtgccatcaccctcccttcggtagctttcatc

SEQ ID NO: 573333 - DNA, 161 bp, Homo sapiens
tcgtgctcacgatcaccttatcgtgcagaagatcacctctagccttggaagttctgaggattgctctgaaccagccacctgccttcatggtgagagataaaggaactgctatctgggagccctgagaggtatacactgtgtaggagggaggtgatcttctg

SEQ ID NO: 573334 - DNA, 256 bp, Homo sapiens
cctcctctttgctgattctgtgtttggtctcgatgcagtgctgactgcgcatgcttgcgtgatatgctgaaacctgtcctacccagcaccacatagaagtccaggccggttaatacaatgcttgggatcatatttgatacccagatcgatgtgtcctggatcccaaaaccaaagttccagcaatctgaaagttgtttccttacctgcatactcaagaccgaacctcccaagagccccgaagactggacaagaatac

SEQ ID NO: 573335 - DNA, 115 bp, Homo sapiens
cagcaccctggctattttacgtaacaattattctatggttctatgattattcagctagtgagaggccctcagcttgtctgcacgtggcagtgactgatggcacagttaaggtggg

SEQ ID NO: 573336 - DNA, 688 bp, Homo sapiens
  misc_feature (502)..(502): n is a, c, g, or t
gttagcaagaagaggctggctgtggaagcttcccttggcaacacgtagagaattttggtctcgatccaggaaggagaaggagccagttgtggcagagacagtggaagaagtgaaaaaagaacctgttttggtgtgtccacccttacgaagccgagcatacacaccgcccagtgatctccagagtcgcttggaatctcatattaaagaagttcttggttcatctcttcctaataactggcaagatatctccctggatgatggacatatgaagttcagactcttagcaggcttagctgatggcttaggccatgcggtccctaactccaggcttcaccaaatgtgcagggtcagagatgttcttgatttctataatgttcctgttcaagacaaatctaaatttgatgaactcgttgctagtaatttacctcccaatttgaaaatcagttggagttactgagcagtctggtcagagaccacgttgggggtcattcattcttattcntcctagcgtgactgaaaagtaccagaacttttctcaaaacttcaattttgtataatttttttttttgctccttgtagaagagcacatctcccctcccccaaaggagaatcaacaaagaaaacgttttcacattttgctaaagctatttttcccccaataaaatcaagtcttgataacttaaaaaaa

SEQ ID NO: 573337 - DNA, 700 bp, Homo sapiens
tacattataccaaatggtaataaacttttagaactggccattctaactcaacatgattatatatttaccaatgttgatatgtctagaacttgtcattctttcattttagttgtgcatagtatgctgttggacagtatactattatttatctttgtataaatttgatgaagtttatatattctaggttctgtttttcagttgattatgttgaaaatattttccttcagtctgtgttgtagttttggctaaaaaattttaatagaaaaatataactcatttttcttacacattattttaactacaggaagagaaaaaaaaccccagaacattaagtaagactactgaaacaagctaaataggtgatattgcatgtaaacatacatacatctttctattcatagacaagacacaataaaaaatcttggatgaaatacttcgatttgcatatattacacattttcttttttgctggttgattaatgactgcaaagaaacttgaactcattttatgtggagaacactggtaaagaaaaagacacaagaaattctgaaaaagtacctgaaagtgaagatctaagagtgaattggatcttattaataaaagctgtgtttctattctggggattaagagtgggagtggtatatgctgtttttttcctcatacgctttaaagttatttctattatttgtaatttccctc

SEQ ID NO: 573338 - DNA, 706 bp, Homo sapiens
actctcgaatgacttggctactacatacctcttggcactgcgcgccaagccatgtaagatgaacatggacagatctgttgccgtaggtacagtcctgcgtctaatagtgcttgacctcgacagtagaaacggcgtgttggcaaaccggacggtgttctttgcaactaatccttcgatagctagtatctagaagggctattactggtgatcgtatcacctacggagtaccagatgcgatcacagaataatcgaatgttgatcattcgccctgtgcattgagaaggtacaattcacttagaattggctccataaatcatcaggacctcacaccctttagaactaaaacataaatcgcaaaaattcccatatccacataatcgatatacaatcggccgtaatggttcaatgttttcccacaacagcttctcggcactaatccgagaagggccaccgagaagtgactcggactaagccccgattgaaatagcatcacgactgaaaaccaagaagagtcaatctgtcggctcatccatggcttctaaacagccgcccacacttagtccattcgcatcattccgacgaagccatagctccacgcagaaaagtacccacaagaagaacgaaaccctccaatatacctggagctgcaatctggctgaccccaaccaacaaaataaagagacagcacaacaaataacacaacaaa

SEQ ID NO: 573339 - DNA, 917 bp, Homo sapiens
caaaagtagaagagcatgcctcccaagaccccatcgaacagggggatgaaacccccaaaacacccaaagaccagacccacactcaagataaccaaggggaagcatagggggccccaaggagacccccacccaatggaaatctttccccatgacccacaaaggacatatcagagagtggactcattcgataatgaacaagagtgggatcctacctctatgcccggggatcgtgggcactgcaggacagaagataattaaagccaagcagtggaggtgtgatataacgagaggagaccataatggagaggacagatgggcggttggagccacgaaatgacagggaaaatatccagcaagaataacggcaaaagataatcagaggcagcatagcatagggcagctggcagagtagaggaaccagaggaggaaccaagaccaaaccatcacatgcatcaccacagcaggcccagcaacttgcacagccgcagaaccaccggcagcagcagggtacagcagatatagaggcaaatcacacaagcgggaagaccgagacaagacgggggacatcagaaataccacggaacaagaagaagaaaccccaatgacgacagtgactccttgaggccttcccatatcatgaacccaactatgcacgcgaatcccgccaaaaaaccacccaaaagggaactagtgaaaaccaaactccaacacaccaagaggatcccacatctacggaagtaacccacaaaaacctacaaccaagggaggaccccacacaaacaagcataccaacgcacagccaacaccaagaacaccagaacaatcaaacaaggacaacgagaacaaaatagacagaacgaaaccattcaacaaaccaccaacacacacgtacgattaccaaacacaacgacaccaac

SEQ ID NO: 573340 - DNA, 113 bp, Homo sapiens
aaactgccccatagtgccggagtcgtggtggctcacgcctgctactccccgcactttgcgcgaggccaaggcggttcgatcactaggctcaggagactccagaccactccgtg

SEQ ID NO: 573341 - DNA, 662 bp, Homo sapiens
tgttctagaggatcctcagataagcaggagaatcgcttgaacccaggaggcagaggttgcagtgagccgagatcaccccactgcactccagcctgggggacagagtgagactctgtctcaataaaaaaaaaaaaaaaaggataaaaatgccgggtgtggtggctcatgcctgtaatcccaaaacttgggaaggctgaggtgtgtggatcgttggaggtcaggagtttccagccgtgccagcatgtgtgaaaccccgcctccactaagaaagtggaaaaatttaagtgtcggggctcagtgcctttaatcccagctactggggaggcatgaggcaagaaaatcgcttgaactctggaggcagaggttgcagtgagccgaaattgcaccacgtgcactccagtctagtgacagaaagagactctgtctcaaaaaaataaaaacaaaaacaataattgagcagagcctcagagaccgtgtgagaccaccacaagaagtgtaccacaagccgggcttgggggctcaccacctgtaatcccagcatgtggggaggctgagccagggggaacacctgaggttaggaattcaagacaagccggaccaatatggggaaacccggtctccactaaacattatataatcagccggcacagtggcgggcgcct

SEQ ID NO: 573342 - DNA, 937 bp, Homo sapiens
tggtggaggtggcgaacggccgctccctgtgtgtgtggagccgatggcggtgcaggccctccgggagcgcctgggtgtggggggccgacggtaggcgccctgccccgtggtcccggcgagaactcgctgctgggcctcccggtgctgcttgattgcccggatagagggcggcggctcttggggctgacgatcggctgcctgtgactctggtcagcgccccgctgtccagactctcggcaccacagcctggccctgagatccttcatgctgccagcaagaggaggagcttccaggatgcatgaagcgccttggagattgatggcccgggagaccgcgtcgtcaggagctcctggaggaagattacgggagggcgccaaggctgctaagaaagcaggagaactaagaagcaggcttcaggtggccagtctcaaagccatgaggccggctcgagccaggggtgccaaggaggcatgagaccatgttgattgccaggcttcgggaggaagcaggagcaagctggccccttctgttttcccaaagcaggacccttcatttgtggtttagcccccccttgcccagatcttgctctcctttgttcgagcttggccacttgccaggtgcctcgaccggtcaaggggccaggccccttggaactggcggttttccagtcctaaaagactgggccccggccggctgcctgtccaacgagctgcggccgaacaggtatctacaggaggacctcgtgcgagcggagggcttttttcctcaaggcgcggctggcgacgtcggggggactccctggttcatcctgggttagcccctctgttttaccgccattatttttcgcacgggttggcgcgtatggagccccccctccgagagcggtgtgggtgtggcgctgtaaagcgctaaaaaccgctccttttctcccccgtat

SEQ ID NO: 573343 - DNA, 272 bp, Homo sapiens
aggggggctgaggcaggaggatcgcttgaacccgggaggtggaggttgcagtgagctgagattgtaccattgcactccagcctgggcaacagagcgagagtctgtctcaaacaaacaaacaaaaaaacaaatgccacgtcaacatcaggacgttaacctttagaccctatatggtctaaaaaggggaggcatgaataatccaccccttgtttagcatatcatcaagaaataaccataaaaatgggcaaccagcagccctgccctgtctatgg

SEQ ID NO: 573344 - DNA, 101 bp, Homo sapiens
gcacgagctagacgccacgggggcccaagcaccgaatgccacatactgggaatgctattacaattcactggactgcatgctacagcgtagagactgggaaa

SEQ ID NO: 573345 - DNA, 156 bp, Homo sapiens
tctcgtgtgctgatatataaagaatactagcaatggtcccacgtgtcatcgttgcatgtaattaactaaagactaacatcgatgggaagggtgcctttctgaatgtaatatactcccaaagcacttcagagactggtattgacattcttccagtgt

SEQ ID NO: 573346 - DNA, 144 bp, Homo sapiens
acgcatggtgatgaaatggctgaggacctatcccagtctccccacagatccgtgcctttcccatgtgtgaatttgtatctagcctaaagtttccctaggcattacttatctcagcaactttcccatctcgtctcttctcttgta

SEQ ID NO: 573347 - DNA, 117 bp, Homo sapiens
attaataaggaatttagcacacacacttctaataaaaggaagctagatgcagcccttgctataaaaagctatacctgaaccaaaatgggcatgtggagtcttaggccccttgcagtc

SEQ ID NO: 573348 - DNA, 120 bp, Homo sapiens
  misc_feature (89)..(89): n is a, c, g, or t
tactgaggtcgatctatagcatcccctgaaacttaagggtcgaaggtggatttagcagtaaactgagagtagagtgcttagattgaacnaggtccctggaagactgcgtatcacaccgga

SEQ ID NO: 573349 - DNA, 139 bp, Homo sapiens
tcccaatttccttttagggcttaaaataaattagggttttatgatttttttaaaccagtttcctattgttagccatttgtttccagttttttaatattataaataaagtgaaccaatatttctttctatccccttttta

SEQ ID NO: 573350 - DNA, 140 bp, Homo sapiens
caagccagtgtgtcggaaagggggaggcccgcgtcggctatgcgacctaccaggcactcttcagcggaaatcaaataacggtcctcactccagtatgggcgccacgcctgaagttcatcccatgggcaggggtaccgagc

SEQ ID NO: 573351 - DNA, 410 bp, Homo sapiens
  misc_feature (357)..(357): n is a, c, g, or t
ggttccttgatctagaaacctgagcgtcacctttacctcctccctttcgcacagttgctgtcttccgccaattacatgcccttcttccttctcagttcctctcaaactcttatgtcacccacgccagcccttgtcctggccaccacctgctcacctgaattgttgccactgcctcccaacaggtctccctccctccagccagacggcctacaatctgccctcacctcactgccagaatgatcttctggaagcagaggtggagctgaacctgtattcaagccgtcagttggaatccaaacagttataggactgacttcaggttccatggccaggacccatgagtctttgtagccaggntccagcagcacttcctgcatcatttctgaccagttcccaaattgcgttcctga

SEQ ID NO: 573352 - DNA, 903 bp, Homo sapiens
gcgatgaccgttgaacaaagcggtcctggggtcactcatagataagtactacacgctcctgggctcgcgacttccacacgcaacgaagtcgcgtgtgcgatgagatcgcccattatccgccagacacacagatagctccgcgataagatacgcaggttatgtcgcgcttctgagtgaggcgaattccaagaggtccagtaagaggtatctccagtcaatgctgcggtgaggaggagagagatgggcggagacatagttatcttccgtgagagtctcacaccttgtgatcacgtgggattacttgagatgtagatcctgacactaacggaaatgctgaacgctatctggcacattcgtgccgttctgtccaaccttcaggtcactcatgcctacaggctgcggatgatatttcatatgccgcttcgtcgtgacctgtaatggccttttccctgtagtgctgtattattgtctcgataaaatctgtcgacgacaccacgctgtgatgaaggatcttcagcgtaaccatgcacatgacggtcttgccaagacggccgggaacaaaggccaaacccacaatgcacctagggtcccatcttgcggcgcaccagagaacggcctcaatccgttgtgttgtcaagactcccggtgtagacaccggccgggccccccgccgtaggacgaggaaaggcttggtaaataggttgcccagtgaaggagcgggtgttgacgcctgccagtgtactgtatgactccccacaaaaaattctcgggcgcagcggcgatgcaacatctcatccagacggtccctctcgcgggtagaccaaggggccacagggctacacaagggggttccccaaaaatcaggtttggcccccccaaaaaacctgtccccgaaaaaaccaa

SEQ ID NO: 573353 - DNA, 195 bp, Homo sapiens
cacgaggtggagatcaagcgcgccggcgaggacgagccggtgaagggggtcaggaactggctcgagaacaaccgggacgtggtgcagccctggatagaggcggcgaaggaggcccggcagtcctcctgacgggcgcggggtgaccgcttgaggaggatcgaccgccggaggtttcttctggggatgggatccgcc

SEQ ID NO: 573354 - DNA, 258 bp, Homo sapiens
tacaaacaatcccaaagccttccctgtttaccccacctccctcagtccgacggggcacgcccgccgaggatcccgggccaggtgcctcctagaggaatgcgtctccgcctcccccggcgggagtcccttgtttgcgacgtctcccgccccttgagtcccctcctgggcttccgagagtctgactcagccaagccggcatcgtttcgcctcctacaacacaccccgagcgcgagaagaaattacaggattgcaggggca

SEQ ID NO: 573355 - DNA, 731 bp, Homo sapiens
gggctgactctcttttcggactcagcccgctgcacccaggtgaaataaacagccttgttgctcacacaaagcctgtttggtggtctcttcacacaaacgcgcatgaaatttggtgccatgactcggatcggggtacctcccttgggagaatcaatccccagtcctcctgctctttgctccgtgagaaagatctacctagtgacctcaggtcctcagattgaccagcccaaggaacatctcacccaatttcaaatctggacccccatggaaaatcggacgtgttcaactcatctgggcagccaactcccagagcccctggaaactctggcccaagcctctcttgactgactccttcccagatcttctcgggttaagcagctgaagactggacatttgcccaatcgccttggaagccccctaagacatcacggattgccgagctttcgaagtaactctcacagtggagggaacgcgcatgaaaaaacaaaaaaagaaaaaaatttctttgtggtagcagaatacaaaaaaaaaaaaaaggcatttttcttcgtggactgaactattatttaaatctcaaaggatggacatctcacaacttctacagacgtactgtgaggtaataatgatatctcattattaaattattgaagtgaactcagattccatttatattacttttatatctataatggtctagttaaataaagagaggaaatggtcatgggcagggg

SEQ ID NO: 573356 - DNA, 398 bp, Homo sapiens
gagggggaggcgggatgggacacccaacactttttccatttcttcagagggaaactcagatgtccaaactaaaaaaaaaaaaaaaaaaaaaaaaaaaaaaattttggggccgccttggcgcccttggaaaaagtttttgtagacccatctcggtttgggccgcgggggcccaagatagtgttaacggttaccacagtggtcaatcgcggtgttcccttagagaaactcgtggcactgcactatgggtgctgggggtttcctctccacccaatataaaaaaggcccgggggggcaacaccgggaggtttctgtgacaacaactcacggagggaggttccgtgaggccacatcacggcggctctattcacgcgggggagttctcaagcgagcccggatta

SEQ ID NO: 573357 - DNA, 273 bp, Homo sapiens
cgccctaggtgccgacctcacgggctacttaaagtcccctccagggcaggtgactgaggccgtgaaggtgtccaagctcgtcgggtaccgccacatcgactgtgcccatgtgtaccagaatgagaataggtgggggtggcattcagaaaccagggacaggtgtaacgtagagcctcatcgtcagcaactgtggtcactaccatgaaaggcctggtgaaaggacctgccaaaacactcagcgacctgaagctggactacctggacctctacctt

SEQ ID NO: 573358 - DNA, 428 bp, Homo sapiens
  misc_feature (420)..(420): n is a, c, g, or t
tagtgtggtaaataggctctcatcacttcatcttccggtgggtgggcaggttgggcataaatggcgtgaagtggaaaaccaggctctccaggaagggaaaaataagtgatccccagcgtatacatttctttctcacctgggctttgggaatggcactttggcagtttcttcagacattcagaagggtagagagttatatatatcagggtcctatcagcttcattcttaatttcatagtttgggaaaaagacatgggccttgaagtaatagagggtttcatccacaatatctgtatctttggtctctcggggggcaggtccttggaatggacttcggataggcaacagtgccatgtatccgatgagtggggtatcaggatccatgagagaagaggggtaagccggaggtagagagccgggnaagggtac

SEQ ID NO: 573359 - DNA, 864 bp, Homo sapiens
  misc_feature (4)..(4): n is a, c, g, or t
  misc_feature (65)..(65): n is a, c, g, or t
  misc_feature (67)..(67): n is a, c, g, or t
  misc_feature (143)..(143): n is a, c, g, or t
  misc_feature (172)..(172): n is a, c, g, or t
  misc_feature (201)..(201): n is a, c, g, or t
  misc_feature (226)..(226): n is a, c, g, or t
  misc_feature (230)..(230): n is a, c, g, or t
  misc_feature (243)..(243): n is a, c, g, or t
  misc_feature (247)..(247): n is a, c, g, or t
  misc_feature (296)..(296): n is a, c, g, or t
  misc_feature (311)..(311): n is a, c, g, or t
  misc_feature (357)..(357): n is a, c, g, or t
  misc_feature (370)..(371): n is a, c, g, or t
  misc_feature (379)..(379): n is a, c, g, or t
  misc_feature (388)..(388): n is a, c, g, or t
  misc_feature (402)..(402): n is a, c, g, or t
  misc_feature (415)..(415): n is a, c, g, or t
  misc_feature (423)..(423): n is a, c, g, or t
  misc_feature (429)..(429): n is a, c, g, or t
  misc_feature (478)..(478): n is a, c, g, or t
  misc_feature (482)..(483): n is a, c, g, or t
  misc_feature (490)..(490): n is a, c, g, or t
  misc_feature (495)..(495): n is a, c, g, or t
  misc_feature (497)..(497): n is a, c, g, or t
  misc_feature (529)..(530): n is a, c, g, or t
  misc_feature (565)..(565): n is a, c, g, or t
  misc_feature (631)..(631): n is a, c, g, or t
  misc_feature (673)..(673): n is a, c, g, or t
  misc_feature (718)..(718): n is a, c, g, or t
  misc_feature (732)..(732): n is a, c, g, or t
  misc_feature (734)..(735): n is a, c, g, or t
  misc_feature (737)..(739): n is a, c, g, or t
  misc_feature (745)..(745): n is a, c, g, or t
  misc_feature (747)..(748): n is a, c, g, or t
  misc_feature (751)..(751): n is a, c, g, or t
aggnaaatagcactaatgaagagtaaatatgcaggcagcaaccttcaggagttgggagttggggngntacgacttcaaaactgcgataggtacttatggtgggtatctggtgattcttagttggcacaaatgccctgcctagnccccttaactgcgtcagttcacagatggngtgttttgttgttggtgttgttagtaggnaggattgccttacactggggaaganagancagcttgagtganagtncgcagtgtttttgattttgtttgtatgtcgctgttttaatgcaacaacnagctcacagtttgcnaagtggaaaaatattcagtagcatcatgtacttgtactataggtangagcttaaaatgnncatcatcnatcatggcntccacaaataagcnacctggggcattnattaattnatgtcnatcgagaagaacttaaactagagaattaagcccactttatgaagagcgntttnncggctgnttgancnattcgaatttggatttgtgttcagcactttgnnaggttcaactttttgcttctacccagattggtctnaggtctgtcttctcatccatccctttctaaagccaaagcacatttgtagcacataatccaggagangcagaagtaaatgctatgactggcggtatttcttagcctggntttgtagtttttaggcagtaagtagattatgagcgaacaaatgtnaaggttcatgtggngnnannntacctntnnatnaggtatggtcttagtcaagctcagagacaacaaagccttctaggtcattaggcaatggtgggtttctagcaccatagactgtctactgacctcatttttcttttggaatggag

SEQ ID NO: 573360 - DNA, 341 bp, Homo sapiens
tgaggatatcgagaggcagctcaaagcccttggagtggattagtgctcatgcactcacacacacacatacacaaacaaacactggtcatttgccgggcaacagaaggccacccaaacacacactaaaacacattcataccaaataacaaatacacaaacaaacagtccaaaagctcacattcacacttgcctactctgggataccgcaccacagatgacaaatgcaattttttgttcctatttatttatgacaatgagagatagctgtcaagggtgtttaagactctttcaggtgaaccactattgcttttagaaggataaaaataaagattcagtttgga

SEQ ID NO: 573361 - DNA, 968 bp, Homo sapiens
cgtaggcgcctgttcatctcaacacgcacaacaacgggttcttttggtcacccaccactggtcccatggacgtgccgatgcagcaatggactccatgtagcatacgcccaatgcgcctcttctttgaagcgggccactgatgcgtcatccttgaacatgcccaagggaacagagtatgggattgactataactcctgggaggtcgggcccaagttccggggcgtgaagatgatccctccaggcatccacttcctccactacagctctgtggacaacggctacctccgcaaggaagtaggccctcgctatgggcttcctctccttagccctgcaccagcggcgcgctgacagctgctgcgctgcgagcacactcacggccaacgcacggtagacctgtccccagccccagcagtctgacgctgcagcgccatgcagggccaacctccagcgagctggaccagttcctgccggcctcacccatactgccacccatgacagacagtggatctcactcaccaacttcactcagcgaagccacagctggacgaagctacagcccgacgcaatcgacagatctgtgccctcccccgcatgtgctacctgtgcctctccactgacgcacaccaaggcaccgcgtggggcaaaatctaccccgctgtggcctcgagctgcaaaagctaccaacaagggcctgacccggctaccagagatcgagcccacagccggcaccagacgacccgctcatcagcagctgcccacgcagactgtcccagcaagctgcctccccaacctctacattaacccaaccaccacatttaacccccacacctaatacacctgacaaacctgcccccccaccaaatccaactctccccaccacccaccaacaaatacatcaaaaaacacccccatcattccaacaccatacaatcaacattaccaaccaccacaacacctcaacccataca

SEQ ID NO: 573362 - DNA, 303 bp, Homo sapiens
ttagtgtaccgatagtccctagttgagcaacaactaagtgagcacttgttgtatgaacactaattcgatactcgcttgatcataacacaccctgtgtgtaaatattttttcccctgaaaaacgtagcacccttcagcaggaccctataaaactttcctccagcccttgcctctttgcaggtagccccttctctgctgagctgccctctgcaacatattttcacaatttctctaataaatctgcccttctttacctacaactatcttggtaaatggctttaccacctgcaaaactgaccctagg

SEQ ID NO: 573363 - DNA, 501 bp, Homo sapiens
ttgctggttctgaaagtggcaagataataatgtgaatatcaaatccaaattcatgaactttgtcccagaagatggcaccccagaggaaggcccaggtatattgcaaccatttgaaagctatggtaccccaagtcaagggagtaaaaatatgtgactatagccaagattcaaaaagcccaggaaaaaggaatggggcatctcctgcatatagtgactattcctacagagtacacaaggaatctgatgcagaaaaccaagttccatgcaacactaataatattggcaacttgggtgaagaagaacccaagtttcatgctcatgaagaaaatagaggacactcagaagtgaattttgactcttcaacagttgtcaaagaaccaggtttgaaagataacatgaatgcagagagaaagagcaaagtaggaaatacctatatcctgaaagcctccttagagccagagaatattaagtcaacacctggggttgccaacaatggctctc

SEQ ID NO: 573364 - DNA, 159 bp, Homo sapiens
atttgaaaaaaaaaaatcatttaaatgatcctttgttcccggctctccttaaagactgagggaacagttcctatttggaaatttgactaaaccttttcctaaggtatttttcaggggtcctaggtttttttatcaaaattaaaagcaaacccctttgga

SEQ ID NO: 573365 - DNA, 168 bp, Homo sapiens
aagtcagaagttatcacaagtgcagtcctcaaactcccttcttgaattcctccctcaaactccctattgcttctttgaagtcagccatgatcaaaggctgtcgagaaactccctaccccagcatactgacagatgccaccatggagaagctggcactggccaaatttg

SEQ ID NO: 573366 - DNA, 741 bp, Homo sapiens
gataacactacggctctcaggtctcattcgataacacgaacactgggtatgttcaaggccacttgtagcacacacagacggaacttggttctgttatgataaggacattgaatgggcttgtctaatattgacgcatttcaaaacgttaatatgaaattggatatctaaccaaggacatgtttgataaaattaggtctatggcttgttacaacaaaattagtttgtatcttggttattaaacagtatctgggactggtttgggcagaatattaaacttattttgttgccaattattgtttaccgagtataatgttgctatttagcaatgtgcttggttttaaacgaaattctccttgggaaaaaagtatcctcttttaattttacttcccataagcgtaaatgcctggacatagctcttgtgcaacctttaaataacatggttctgagtgtatattggagccccagacaaataatgtttaaaagttatccccttgctactttactgatacctttatcattcctgagacagttttgctaatttaaaaaatgtagcattccatttgtatatatttctctcccttgccaaaaagattttctaatactgacttgtaccagccagagacaagatccaaaaggtactcaggctctcttgcactagaggacacttttccacctacattgaactcctggactaccatcagccaaacttaacccttgggaggaagggatttgaatagccaa

SEQ ID NO: 573367 - DNA, 844 bp, Homo sapiens
tagttgccggtccggtgggtacgagatgactgaaccggtgcgcctctcccgaggacccttgaggtcaaggtggagtatgcctacagtgacaacagcctggaacccgggcttttagtagaaagcaccctgcaaggggagtgtagctgtaccatgagctaatagcatcggttccaccagtgcctcttctgtccccaaaacagatgatgagcgacagtgattaccaacaggaggcctaccaaggagtcctacaaaggaccgtgctggcggccgcgcaacaacactcaggcttgagcaagaagaaggagggacgccaatcaagagaggctatgatgacctttcagaacgcgatcgtaccccaacttggccagcaagaaaggagttctccgattgggatcccaaaagctcagcaaagcccatcgtaccatacagaaagaccattgagtaggagtcaaagtttttgcacaaggagacaggaaaaaacgcaaggcgaggaggaaggtgtcaccagctgacagcatagggaatgtcaccgacacctaaatgatcatgcaaagatgaaactaatgagcaagattggcgcaaggcacaccgggaaaaacgccccaggaaggggaaggaagcaaggtaactcgctgaaccaaggatcgtaagattacacgagatagataagagggggaattcattgggaataccgcgtggatgcaaggatacattaaaagtggcctccaatcttaaagtggtgccaagcaatcgagtgaaaaatgcacaaggatgatgtaatcagggcaggactcgaaggagcaacttgtaaagcacagtatagagcatgagcaaacatagtgat

SEQ ID NO: 573368 - DNA, 355 bp, Homo sapiens
tgagacagagtctggcactggctggatcacagttcattgcagccttgacctcctgggctcaaacgatcttccttcctcagcctcttgagtagtggggattacaggtgtgtaccaccacactcggctaattgtttattcttatttggtagagatggggtcttgcttaggttgcccaggctggtctcaaactgctggcctcaaggaatcctcccacctgggtttccaaagcatttgggattacaggcgtaagccaccacaaacggtgagcattatatttctacgggactgctttaaattcatccgtcgacgcggccgcaaatttagtagtagtagtcgacccgggaattctcggacc

SEQ ID NO: 573369 - DNA, 443 bp, Homo sapiens
tgaaggggttaacgcctgtaatcccagcatttcgggaggccaaggtggacagatcacttgaggtcaggagtttgataccagcctggccaacatgctgaaacccaatttatactaaaaatacataaaattaactggctgtggtggcaggcacctaaaataccagttactctggaggctgaggcaggagaatctcttgaacctgggaggcaaaggttgtggtgagccaagatcacgccattgcactccaacctggtcaacaggagctaaactccgtcatagaaaatagatacctaaaattaaaaaaattacaataaataagtaatacagaatggccaatgtgggcttcacaggtaggacacggatttttttggtaaggggctttttggaacccctctcctgtagggcccttcctgggcatcatgctacacacgtgttcctctcgt

SEQ ID NO: 573370 - DNA, 147 bp, Homo sapiens
tattgggattacaggcgtgagccaccgcacatggccctgagttgtcggtttgtttgttttgtagttaaattgaattaaaatgcataggagaaatatgtgaccaaacctgtgttaccagagagacttcccagaggagatgatgcctga

SEQ ID NO: 573371 - DNA, 1226 bp, Homo sapiens
  misc_feature (717)..(717): n is a, c, g, or t
  misc_feature (998)..(998): n is a, c, g, or t
cattctgtcttgttttcctgttgctcccctctccgtgtgtttcttgctcttcttcttgtggtgtgttttgtattcgtccttctggtcgtggtctcacagtctgggtttcgcgtgtttgtctggttgccgcgttttctcccactgtagggtggcggcttcttcaaggggcccaagggtatatattcttgcccccccttcgtggtgccccccgttgttcgaacggtgtggtaccccttggtcgttgtttgcccctcctctcctgttttctccccatttcctctctgcgcacctccttttttgcaccccttggccaggtcgtcccgtgacactttggttttcctgtgaaggtcttcttggcccccccatgccaatgcgcatccacctgcgcccctcccggtgagctcgtgggatgggccccctcccggggtacctgttgtgccttgattgcccccgggggctttccccgaaaccgtccattcccgtgcctctatctggcggctgtcccaggcctttgggcccaggtccatcccctgtgggctgtaaccggagagcttcactggcctggccccttccgtggtcccccccgtgcaccaacctggtcccactggttggaacctcgagacctcgccgttttatagaaaaaccctctccccaatatttgagtgaacactcccaggaaagggttgtgtgataacccacgggcgtttcgggagaggngcccccccctctccaagggggcactcccctgggctatccacctgaggccccccgcggtggtttctcccttctgaactttccaccacgcgatcaccccactctctctcccccctttgtacacctctgtgggcctggccacttgtcaccttccaacgcgcccacctttgtcacaagctcactttcctggtaatgaccaccgaaatttggctatcagccacacacagggtggtggaacctcacatggcccaccacatggcctccacaaggagagtataagaacncccctggagccacaccacgccccacgtccaagagcacccagaggaaagagagagaccctcacctgctcggggagtccctgccaccacctcacgtcccccacccaccacctgattctcccctcctcaccacgttgccacatgtatgagccccttgaagaaggggaaggggcctagggaacccccccttgtcatgtacccatccataaagtaccctgtgctccaacccca

SEQ ID NO: 573372 - DNA, 133 bp, Homo sapiens
ttaggataagtaacatgaaaacattcgcctccgcataagcctgcgcaagactaaaacactgaactgacaacaaacagcccaatacctacaagcaaccaacaagacattattaccctcactgtcaaccacgaca

SEQ ID NO: 573373 - DNA, 516 bp, Homo sapiens
  misc_feature (78)..(78): n is a, c, g, or t
  misc_feature (84)..(85): n is a, c, g, or t
  misc_feature (90)..(91): n is a, c, g, or t
  misc_feature (115)..(115): n is a, c, g, or t
  misc_feature (119)..(119): n is a, c, g, or t
  misc_feature (145)..(146): n is a, c, g, or t
  misc_feature (150)..(150): n is a, c, g, or t
  misc_feature (228)..(228): n is a, c, g, or t
  misc_feature (230)..(230): n is a, c, g, or t
  misc_feature (237)..(237): n is a, c, g, or t
  misc_feature (247)..(247): n is a, c, g, or t
  misc_feature (269)..(269): n is a, c, g, or t
  misc_feature (275)..(275): n is a, c, g, or t
  misc_feature (396)..(396): n is a, c, g, or t
  misc_feature (398)..(398): n is a, c, g, or t
  misc_feature (417)..(417): n is a, c, g, or t
  misc_feature (420)..(420): n is a, c, g, or t
  misc_feature (423)..(423): n is a, c, g, or t
  misc_feature (427)..(427): n is a, c, g, or t
  misc_feature (438)..(438): n is a, c, g, or t
  misc_feature (491)..(491): n is a, c, g, or t
  misc_feature (497)..(497): n is a, c, g, or t
tcccccacacagaatgatgacaggggccagagcattactgtgagctccgccccttgccagagcattactgtgagctcngccccnngtcannattactgtgtgagctccgcccccntcancattactgtgtgagctccgcccccgnnagancattactgagctccgccccctgccagagcattactgtgtgagctccgccccctgccagagtattactgtgtgagctcngncccctgncagagcattnctgtgtgagctccgccccctgncagagnattactgtgtgagctccgccccctgtcgagcattactgtgtgagctccgccccgtctatcattactgtgtgagctccgccccctgtcatatcattactgtgtgagctccgccccctgtcanancattactgtgtgagctccnccnccngccngagcattactntgtgagctccgccccctgccagagcattactgtgagctccgccccctgccagngcattnctgtgtgagctccacccat

SEQ ID NO: 573374 - DNA, 179 bp, Homo sapiens
gtagctgatcttgaggattccagactcggcacctgttcgatggtgctgaattgcagcagagaacaagaaaaaaagaagcctggctgaggtgctgtgtgttggtgggccctgtgtgccacagagcgcagctctagtgcctgtgtgcccagtacctaatctcctaactgctgtgcagtgca

SEQ ID NO: 573375 - DNA, 143 bp, Homo sapiens
ctacacccacagcgggctgtggtagagaactctcttccttctttccaccgtacagggcgagggctgcttcctcgcggcagccggggcgaagaaatctcgagagaactggcatgaggagttagggtcatcacaaatacacacac

SEQ ID NO: 573376 - DNA, 136 bp, Homo sapiens
agccagtgtcaacatggcgagaccagtctctacagaaaataaagtatgtgggcgtggtggcacgcgcctgtatgtcccagactgcttagagagagctgagtgtgggcagggttcactatggagctccagtgaggct

SEQ ID NO: 573377 - DNA, 139 bp, Homo sapiens
atacagaatctcatagttttggattaattagcaccaatcagtttaaacactgactgttagaatagctgcatgggtttttttttttaaactaattaagcgttggctacttagtataagtaagtataagccgaattaaggt

SEQ ID NO: 573378 - DNA, 435 bp, Homo sapiens
tccaaggacatgaaggtctgaaaaagaaacaggaaaatacagacatccccgcttaagcagggtttgtttttctttttgtttttttgagacagagtcttgctctgttgtccaggctggagtgcaatagtgcaatctcggcctcccgggttcaagtgattttcctgcctcagcctcccgagtagctgggatcacaggcatgcaccaccacgcccggctaattttttttttacttttagtaaagacagggtttctccacgttggccaggcgggtttcaaactcctgacctcaggtgatttgcctgcctcagcctcccacagtgttgggatgacaggcgtgagccggtgtgccgggcccagggtttccctttttttgcagtttcagttatccatggtcaacagagctccaaaaatattaaatggaaaattttaaaacta

SEQ ID NO: 573379 - DNA, 357 bp, Homo sapiens
agcggacctgcgcgttaagagtgggccgcgtcgctgaggggtagcgatgcgggctccggggatgaggtcgcggccggcgggtcccgcgctgttgctgtctgctgctcttcctcggagcggccgagtcggtgcgtcgggcccagcctccgcgccgctacatttttttactggtcgagcctggattctcggccgctgccggcctggttcgacgaagccaagattcggggtgttcatccactggggcgtgtacatcggtgaccgactggggcagacgagatggttctggatgggacatggacagggcgaagaggcggacgccagtaacaaagactcaagacgccgaaaaaaaacacagcc

SEQ ID NO: 573380 - DNA, 1555 bp, Homo sapiens
  misc_feature (1312)..(1312): n is a, c, g, or t
  misc_feature (1348)..(1348): n is a, c, g, or t
  misc_feature (1391)..(1391): n is a, c, g, or t
atcatcgtctaccctggtcattcctaaggaatacctcacatcacagtgagctgcatgaaatgagagcttgcaagacccgtgaccaccttctgaatcaccgtttcacacctatcatctgccttcacatccagcactgactggcttgcgtgccattggcctaccgtttacccatttagagagtcgtccttgctccacgaaccgggtctatggcaaaggtacacatggaccgggactagagtgtcccatacgtcctgccactccttcaatgtcaccccgattacacaaaggtctgaccaattgcttatgcaggcctgcatgtacatgacgatccgctgtgagcatcccatcgtactccactccgtggtcatccctcgtggtcgtcgactcatcgctgggcacaccgcgttctcacatagtctgtcaatgtatcaccataatacaactgtttgtgagccatcaatagcgtcgcaccaacgttggctcagttcccttgtcgcccttgcaaaagaccaagaatttctattacagggctcagtatttgccccaatacacaagaccattggttatggaccggattgtatgtctcttcttgtggctacatgtacgctcttccacgtttcagcttcgttaccagacgtctcaaaccgccaccggttcgctgacctacttggaactatcatgggacgcccttgatcgggttggcgtcacattcctcggtcgctacgtagacgacatgatcggagtgctgaaatgatcttgttacgactcactatacaataaagaccatgcgcttcctttgggacaccggggttgacccccccttggactagttccttgcccgacgcatgactgcaccctggatacctgacgttaccgagaaacaaaccaatctgcgtgaactatagagacatcttgctcacctgtgagtgaacttggcgaaacacccttagtgtgccaaactaggctagaacccaggcataggcatcatatacacgatggacagcacgccactcaatggcaattggttgccccttttagtacatgtggtccggtggtcctacgacgcccctcatacatcaatgtacatacaccgatggcacgcgagttgcacaccagacacttcttccatactgccctcccattctctcatcagacccatctccgcctacaagcaccaacatattcaccacacaaacataccacactcatcaaccatgcccacacccacaactcctacaatcatacacgtcgccaatcccaacacctaccattccacaactccgataacgtactaactaatctttcatttctntctttctttcttctaatccctctcatccttttaccngtacgctccatgcatacctactcacacctgacacgcacacctnccaagccgtcaatcgacgtccatcacacagacgaacccgctacatcactaacacacgactcacaccacacctagcaacatccaccactacccgccaatctcagccgaccatcgcacgtcaagccacttgactacccaccccaacacgcactctctactcactac

SEQ ID NO: 573381 - DNA, 112 bp, Homo sapiens
tcgcgctcggtacccgttcttcccagtgatatcatacatttaatacataatgtcattatagcattaataatactgcaaccttttcttacaaagattgtgaatatcttttttg

SEQ ID NO: 573382 - DNA, 258 bp, Homo sapiens
  misc_feature (13)..(13): n is a, c, g, or t
  misc_feature (105)..(105): n is a, c, g, or t
  misc_feature (107)..(107): n is a, c, g, or t
  misc_feature (128)..(128): n is a, c, g, or t
ctagaggatcccnctgccaaaagcgataccaagcgtaaacacatgtacagtatttgacaatgacaggtgtacctgaaaatgtgtgttgcctatggcagtatatcntnatataccagaattgctaatanggatggtaaattctgtgactcttcaaagaagggagtggcaaatgttcacaggagctgataggagaggtcttgtggaagaggctgaaggtgaactctgcccagagtaatcattgggtactacgctttggca

SEQ ID NO: 573383 - DNA, 574 bp, Homo sapiens
gagcgaaatttgctcagttgcagggattccccaggactccctgggagtcaggccacacccagttgcttctgctgggctggcggtctgtctgctctggagtggggtggggtggtgaggtgcacaccacacacacacacacacacacacgcacgcacgcacgcacgcacacacggagggaggggggaaagggagatggggtaggtgaggaaactcaccgtcccagagctctcttgccccctcttcaggcaataagctctcactgctgttcctgtccaggtgaccaatttttgccataggaggccctatttttagacctcaaaacccaccaccaatgtctgggctgcaagctcagtggaccaggctgctgcacgggctgttttgtttttgttttcgtggtggcacatgcctgtaatcccagctacttgggaggctgaggcaggagactcacttgaacctgggaggctgaggttgcggtgagctgagatcgtgccattgcactccagcctaggcaacaagagcaaaactccatctcaaaaacaaaaaacaaacaaacaaaaaaaccttatgaaggaaa

SEQ ID NO: 573384 - DNA, 141 bp, Homo sapiens
taaccgatataaacattctaggtctaaatgcaatcagtctaaatgcatcagctctaaatgcaatcagtctaaatgcaatcagtctaaatgcaatcagtctaaatgcaatcagtctaaatgcaatcagtctaaatgcaatca

SEQ ID NO: 573385 - DNA, 461 bp, Homo sapiens
ggcattcatgcctctggcagctttcagttccagttttcccgtttcagggccttaaatgggctagggctactttatctttttgacctggaggctatgcagaagactacatatcttcaggttaactcacgtactccggctcataaagaaaagataaatcctttgacttgctacgggggtgctaactagccatccgacagtgcagttgtcttactgaacaagggcgagagaactcagacacgggggcattaagtgcttgactattactaggagctggtctctcgatcgcatgacgtagactgaaaaaccctgcctgaagacgatgaagagtgctgacgccagaagcatgtgcctttaacacattacacttaaggtgagtggaaacgagacatgtaagctgcatcatggaggtttagaagcgcccgttttgggactgtttgaaccccaggcaacaagacgtaagg

SEQ ID NO: 573386 - DNA, 898 bp, Homo sapiens
atcctcaccaacacttaactattttctccctctctttttcttcttaaataatagccatcctaatgggtgtgactcttattatttattggtaaaactaaactcttattttgtaataatttctaaagtgttacacaacgctgtaatacattttaatctaacattattgaaaaattctaagaacacgtgtgtattgcagaaaacaaaggtaacagagttatgtgaaagagtagacggagaatattgggcaaactaatggggcttatattggtgatatgttaggcagacttactgaccaacagtgggtcacatcgatgtccaaagaagaattcactgaaagcagcaactatgtatagtgctcaggtacaagcatgggctaaatgaaagtagtcaaatggaacagctcagcagatgatattaacctgacgagataggaaaacttggcagaagaatatgttatgactacagcttttgacacgaactatgtgatattgttgtatattccatgtgagatatcttcccttcatatgtagcgtataacagtagttaaattacgtgtacatgaacacatctggagaacatgcacctattttcacgtggaccacacatccttgcggtcagggacctgagacgtcaggcagcatgaccacggataagattgaattctacaccatacaaccttctaccggctagtcttgcaaatattggtagatcacggaacattttcttcacgcgactcacaaattttgctaggcccgcacgcacgtcgggtcatcggcctgtaatttccaaggtcacctttgggaaggcttgaagccaggcacgatccaccaggtacgggagaatccgacaaccatcctggccacctggtgaaactctgtcttacctaaacatgcaaaat

SEQ ID NO: 573387 - DNA, 109 bp, Homo sapiens
ctggattgtcatccccataaatataacaaaattacaaaaaaaagcatagttgggcaataaatacgtttagataagttaaataagcttttttatattgatgtcatagaaa

SEQ ID NO: 573388 - DNA, 157 bp, Homo sapiens
tgtacgggcctgtcctgttcatgtacataagatagtgcttaaattggaaaaagctttttggcaataggaaagactgcagcttttacaaatttggtacttttcagtcctatccaggtcagtaagaagtcatatcattggacactagtaaaggactctg

SEQ ID NO: 573389 - DNA, 971 bp, Homo sapiens
cggagggcgtgaagattccgggacgacgtactgcctgctgcaggaaggccctgaagcggcaaggagaagcgcagggcgcagcgggcagcgccggtgggagaagcgtacggccggccgtggtggagaagatgcagcagcgccaggaccggcggcggcagaacctgcgcaggaagaaggcggcccgcgccgagcgccgcctgctcagagcccgcaagaagggcctgcatcctgccgcaggacctggagcgcgcaggcctggtcctgagtctttccacacctggggccgccgtcttccgtcctaggagactccaggacaccgctctgagtccttgacgctggctctgtcccaggatctccacagaccttcggcctctccatcgtgagggggacacagctggtgactctgctagagttgtgaggcgcccagatcacagatcccatgtgatgaaagacgagagtttcagcgtcatcctctgaacgacaggatccgggaccttcagacgccagcggaaagtggtgagggagaactgggcgcctgagtactgcatttccctgggccgtgaaagcttccgccgagggttctgcagaggtcagaggaggaggaacggtgagggtgggcagtcaactgcctgttccccactgccagtcgttcgcaggagccatcgggacagaagacggtggccgtctgaatgccgggccacgttagtacagcgagcgtgcagcccgaaatcacgagcgaacaagccatcgaggctcgctcggctagtagtgggacaccgtggacactgaggagtacgggggaagcacagtccaggacgatggtgcatcactggggcagaacgccatggctcatccccgctctcttggcttacagcctgttggggtctcattcgtttctgttccccagtgcctccggggcggcagttttactgtctaagaatttatatcggagggagcagtacttccctctc

SEQ ID NO: 573390 - DNA, 108 bp, Homo sapiens
  misc_feature (2)..(2): n is a, c, g, or t
tnatatctagaggatcccgtctagctcgccagtgtacgaaacagttgtctctgcaggagtgtgtgtctggcatttttttttttgaaagggaaaacctctttccatgag

SEQ ID NO: 573391 - DNA, 1165 bp, Homo sapiens
  misc_feature (231)..(231): n is a, c, g, or t
  misc_feature (233)..(233): n is a, c, g, or t
  misc_feature (235)..(235): n is a, c, g, or t
  misc_feature (239)..(239): n is a, c, g, or t
  misc_feature (369)..(369): n is a, c, g, or t
  misc_feature (615)..(615): n is a, c, g, or t
tggttcagagcgagtgctcgtgggtcagcgttctgagtagctgggattataggcatgcggcatccgtcgaccagctaagtttgtttatatttgtggtagagacactatgttcatgcatgttggcccggctggtctcaagctccgttacgctcaagtgatctgcccgcctcagcctcgccgaagtgctgggattacaggcgtgagccactgtgcctggcagtcttttatttnanantaantacttagtcctaacctagtgaattatcaatagcatttaaaattccttctatcctgataccatgaacagtaattttcccttttaagttatgatttgactctaatttgggtcttgtatctggtctttaaacncctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctnattactgattttaataccttcatgagagtattaaggttgaaaggaatggtgaaatttgcattatcagaggtctgatatgtaatttattgtaaagaaattaaatatatagaggtcaattaaaaaataacatattctcaaactccattaccactaatatcttggggttgtcaatgatagactatatatatatatgtatgtatatgtgtatatatatatatatatcattcttctcttgacgagacggagtctatggtccggtcacccacgcttggagttacagttcacaggcaactatgctttcccaggttcaagcattctcggcttccaggcatcccgaagtcacgtggaattcagacgctgccaccagacccagctaacttttcgctcttcaacagaacggcgtctcccatgtcggcagcggatccaacctagaccaattccaaccgcagtccaagtcggctacgagataaccacccggacaacctgtacttcaagaagaccacagaccagccggcgccacaacgcaagcaagcattacaatcgatctacg

SEQ ID NO: 573392 - DNA, 386 bp, Homo sapiens
ggtatggcatacagagtataccctggtacacatatattcatttgtgagtatggatactagagcacattatctactaaccattcatgtcagttccaaaaacccatctaaatatcttgagttcctgaattttgaacaggattacctggagcctggagccactttaagttgtacttctgactaaactggaattatgagtgaggaagagtgtttactaaataaatgactggggcaagctaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaa

SEQ ID NO: 573393 - DNA, 690 bp, Homo sapiens
cgcaggaccgccaacgttctggtaaagggggaatggaaaataaccgaccccaagtccggctggacccggaatgaccatgtgtcagggtcccatgtctaaccgccctaaaaagtacgtaacgagatgacccgcccggtggtgtcccagtcaaactaagagataccccacgcgtctgcaatggcgcagagcattatctgccttatgctagtcagagtcggggcaagattcgctatgtaacatgacaagatgtacgcggcccattcagtgaaattcgtagttcacacagagatctatctacacatgatgaatctcattcatgatggaaaacagcactcgcgctgtataaactcaggacaacaaggtaaggaatctctgttccttaagtgctgagctaagtccgggtctagcaaacagtataggagtccctagataaggcattgggctagccccagctgtacccagcaggtctagtgaaatattcactctgaggaatctttgagattccctgggaaaaagaattttcagcaagggccaattatttccagcattccgttctttaactgtgtatttctttacagggaaatagcgcacagtgtcggttttgtgttaagtagcggaatggattcgtgagcacggaaacgtaattgaagcataatattcttgcttaaggaataattcctctggcagtaa

SEQ ID NO: 573394 - DNA, 2850 bp, Homo sapiens
  misc_feature (184)..(184): n is a, c, g, or t
  misc_feature (430)..(430): n is a, c, g, or t
  misc_feature (2832)..(2832): n is a, c, g, or t
cagcaagcatgctttgaaatctggttcagactatcatcaggaagaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcangggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagatnacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccgtgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactgggcgatcccagcccctccccacccaccctctaatggacctcctcatagaagccccatttcacttttgttttatctacctcttagcaaaacaatagataaattaggtagtggcagctccacttgcttaggttagggggggaaaaagatttctttttccaaaggaaaaaaatattaccttgagaatactttccaaaaaataaaatttanaaaaaaaaaccaaaaaaa

SEQ ID NO: 573395 - DNA, 1377 bp, Homo sapiens
  misc_feature (445)..(445): n is a, c, g, or t
  misc_feature (481)..(481): n is a, c, g, or t
  misc_feature (509)..(509): n is a, c, g, or t
  misc_feature (529)..(529): n is a, c, g, or t
gcacggagacgagtgcggctgctgcgagccgagcccagcgatcccgatcctctgagctcgtgaataagggaggctagcgagggggtaggtggttggggccttgagtgcaaagtcccccgagtgcatcctgcgtcatatgcgcacgtatggtgagcgaaggagaccaattggcttcaacgaagaagtggagacttcgtgggatagccgtggccatcactcaagagactaccagggcgtagagtgccttgccgggtaggagaagactaggcagcccgttgacgtctgagttgcgacagagccgtgtagtagtggagaccggcgcaagtcacgaagaagtgcttgccacgagagagcgtcgcatcgcataagcggtaaaccacatgcgcgcagcgcatgcaagcattgcgtattcgtccccgagaagcttcaacaggggccgccgaancatgtgcccaagtcgaagtagtgaggcctggaacanttgtcgacggatttctcccaggcgaggnctggtccctgtcgtacggcnctgaaaggtacacgtcgcgttttcataacggtcgccaggaattcgcgcgagcacgatcaagatagggacgcgcacatatggggtggatctaatgaattgtacgtgctcaaaggctcgatgcagatgaccagaagggaatgtgacccgaagcagcagcaggaccgatagagcatggccttttaatgtacccagagaattgcatacgccgcaagatggtgatccagaatcgcttgccttatggatgtatttccgcatggtcatggcaatcatctggatcgagtatagcctggctaaacaacgttcttgagcatgggcctttcacagggtccaagaaatgaccatgtagtagaagtgtgggcccagaagtgacaccctacagatattctactcaggacgtcatcaactgccgaatgaatctgtgcgcaacagcagagcgtaagagcccgttcaagggctttggagatgataccagtaaggacccaaaagagtgattaccaagaccagaatggtaaatcagggccaaattgggcatttccaagggtgaactagagagcgagccaggtatttctgaactggagggtgacatgcgcgacatcagcgaaggtcccaggtcaaaacggggtcccgggcaaaaaattcgggggaaagaggacccggagaataaaaccggacggttggacaccatggggaaaaaagggggcacaatgaggaacaacgatagaactaacacacaaaacaaagggacgcaaggtgtaaccacactgaactcgatgagacagaaagcaagagcgtacacacgcgagcaaagaggtaaagaaaaaagcgatatcgtcccgctgctcgcaagt

SEQ ID NO: 573396 - DNA, 200 bp, Homo sapiens
gagatagtacaagatacaacatcgaggtcgtacaccctattgttgatatggactctagaatagagattagcgctgtatatccctagggtcacttgttccgttggtcaagttattggatcaattagagtatagtagtatcgctatatgactaggtgaagtctctagcatgtactagctcggaggttgggcttactgctacc

SEQ ID NO: 573397 - DNA, 225 bp, Homo sapiens
gctgcgttgtctcacgatcccttggtcacgctcatttcctggtatacagcgactttggctacagcaacaggttggtgaacctcatggcccaggattgcctccaaggagtaagacccctggagcacgctagcccccgcaatgagcacaatgaggacgagagagaccctcactgctggggagttccctgccacctcaatcacactactccccatatctaacaacggg

SEQ ID NO: 573398 - DNA, 1670 bp, Homo sapiens
  misc_feature (1312)..(1312): n is a, c, g, or t
gacccacgctgtcgaacagagcaagactctgtctcaaaaaaaaaaaaaaaagcatgcttttaagcagtaactccccattccccccaatgcacccactcctgggttaacctcttctttctctctggtctctggaacttggccttccttggtgaagaaccttggtggtaaggtgggaatattggcaatatttggtccttcgccttagcctcatggtcctcaagggttcattcatcttggtgttggcaagccttcttttccaataaattgggtcccaatttctatggattattggaacattgggcccaaattggtcccaatagaaagtgcatgttcaatgggttccgtgtaaattaaacaccttaagaaaacttggcgcccttcttgaacatctcttgtagaacacttgggagaacagagtttcacaattgtgctccataatcgtgaggttccccttccttcgaggaaaaccaaacccaatgtggtgccttccaaggaatgcgcacgcaagagaaaagcgtgaaaattcacaccagaaactcacaaggcattctgtggacaccaagtggaaaacgtgcaaagaagcaccaacgctatcaacgccttttccagtaatgtgtgcccccagggtgtgggaccacacgctgggcatccccaaatttgggaccacagagcgatcgatagtccagtataacccccattcaccctataaaagttccgcccacaagtttattccattacgacataaagacacaagggaatgtcgcatttttttctatttcgcacgagtgggtataagagaaagcacgccccgtagtaaatatataaaaaggacgagggagcgtacagaacagcgcacacattgggggcgggattagcaacacctacagttagaaaaggatagacaaccgaagtgatcaccaacgcgaaaggggaacaacaccaccgttcgatctaaaacaaagtggagggggggacataataacccccaacggacaggagagaagtagggaacatggaggacgccaccaatagtaaaaccgagtttttccccccccaagattgggagacgccacgaagccacaaccaaaaggaggggaggcgcgagcgcacgcaggagagaagtagtccccccaccacgaagaaggcggcgactattatgggcgctagcgtagccacgacgtatgaaagccctagcccccgcgattatttgttcggcagagacgaggaaaacatcacgacacctgtctggggaagagaaacaaccgtaagtagcgacatgttgtgcacacaccccggatggtccaacaaaaanacgaccagacaggaggcaagacaataagaacgtctcggagaacgacagttgcgaggcggcagaacacccggagcgcggcgagacacgatcgcacaagagttaggaaccccgggaaagatacgcgggacactcagtcgtggagacgatcccagacggagacgagcagagtgaaaggcagcagtgaggaaccaagcgtcgggtggaaaccaccaaggcaaagcaggggagactatacgagcaagagagagaagtcagcagagagagatcctaccccactgtggtgagcgaccccacgacacggtcgagacgcaaaacgagaggcgaagacagctccgcggctgagcaagacagacaacca

SEQ ID NO: 573399 - DNA, 241 bp, Homo sapiens
  misc_feature (38)..(38): n is a, c, g, or t
  misc_feature (99)..(99): n is a, c, g, or t
  misc_feature (178)..(178): n is a, c, g, or t
  misc_feature (184)..(184): n is a, c, g, or t
gtgaaacctcattctccaagccagagacaatttaaagnctgaaagtcaaactacaagttaaattctctacccagattgagaactcgccttgctattttncttgcttttatctgattgatccccaccgttcacctattttacatatacctaccatttccggattgatttttctatactntcatgnccacctttgagtggtatgtttgctttaaccttttttgcatactcacaaaccagtcag

SEQ ID NO: 573400 - DNA, 205 bp, Homo sapiens
tctcccagagatgaaccatgacagcatgtgaaccaacagtgcatggcactccacacatggggatgcatcatgtagccgtttttatacactaaagcatgcctactaatttccttcgggactaactctttgatccatggactgtatagatctgtgtagtttgagtatgcagtagtatgggagatgctcctattacctttctattatt

SEQ ID NO: 573401 - DNA, 283 bp, Homo sapiens
tttttttttttctagaactccttataaatggaatcacatagtatgttctcctggctcatcttcttttgctcaccataatgtttctgacactcatccacgttgttttatcagcagttcatttctttttgttgttctgtaatatcccattacacaaatacatcacaatgagtttatccattcgcccgttgagggatatatgggttgcttccagtttttctctattatgaataaagttttttttggggacatgtgttttcatttttcttggataaacacctaagag

SEQ ID NO: 573402 - DNA, 103 bp, Homo sapiens
cgctttagctttccccagtgatgtgccgtgcgggatcatcagcgacttgaagtcaagatctgtacttcccattgctgatagaactcagtgatgcttcttgact

SEQ ID NO: 573403 - DNA, 250 bp, Homo sapiens
tcccttgtctatttcgaagtgatattcagaacttatctgttaatgtgtaatttttatccattattctgtgtgtacagatctttgtgatttttgactctcttatctagttttttttttttttttggggtttccggtggtgttatccaagggcaaaaggggtatatggacaatggcaaatggaagtggtggctacaaagtgtgaccgggaaaaaacccagatagcgtcgccaccgtgggcacctcatcctca

SEQ ID NO: 573404 - DNA, 470 bp, Homo sapiens
taggagtatcccccatcacaggcagtagcaggctggaaaactcagtcggtgatggacttgagcgacaggccatccagctcgtccttcttcttacatggcataggagatacgaggagcccttgcagtattgatgagctcatctgccaggcaactcagcaagtggtcttaaatgtgccggaagacagcctcaggagcgcctgtgcacggcagccagatggcctgttacacactggcgcagggaggacaaatccacagcctgtcgtctcacagtccgctggggcgcccaaatggggtatggagtccttcccggggaccactggttgatgtatgccgttcaccaaggaaccctgcagaaggttccatcgcctgttagcaggtgtatgatctcgaagggatgcctaatgattcgcacagtcattaagcttctaggcggttgttgcggccgtgaatcatcatggagttagtgaggc

SEQ ID NO: 573405 - DNA, 655 bp, Homo sapiens
gctcaaactcatgacctcgtgatcctcctgcctcagcctcccaaagcgctgggattacaggcatgagccatcatgccgtggcaattttggtatcgttagtagagacgacggtttcaccatgttggccaggctggtctcgaactcctaagcctcaggtgtcccagccacctcagcctcccaaagtgctaggattacttgatgtgagccaccgaacctggcctccacctttaaaatctatccagaattgattggattctgacaggtatagtggtgcagtgcgtcaatctgagctgtcatcagtgtcctctctgtgactgttggaacacagtcgacgggctcttataaggccttgatattctattgatacacttgcccttcaatggagtgcagtagtctatgtcccttcatcttgcaaactggagtccctcgaaggaataaactgcatgcggaagcgatgcagtcttaacttctagaagtgcacgttagacgcagatgatttctcagctgggcatggtggctcacgcctgtgatcccagcactttgggaagctcaagtgggcagattacttgaggtcgggggtacgagacgcagcttggccaacacggtgcaacacgttcactataaaccataacaacgatgcagacatgatgtcatg

SEQ ID NO: 573406 - DNA, 317 bp, Homo sapiens
tctcgcaacgatacaccctaggaagcaattgatatcatagctcagaccatacctatgtatccaaatggttctttttttccggagtagtaagttacaagtatgggagattattccgcaagcctggtaggataacgaatatagaacttcagaggtgaccgaagaaatcagaactaggtgttgtgtatacgaatggggtctcctacctccggacggggtcgacagaaggtggtgttgacggttgcggtctagttagatagtatacgtgatgccagcagactaggactgggagacgataggacgaagtaggactcgctgtg

SEQ ID NO: 573407 - DNA, 111 bp, Homo sapiens
aatagctcggtacctctctccacactgggtgttacggtaatattggattagctgtggggtagtcttggcattttgtgaatttttgcactgtgtaggtaaaattgttcaggt

SEQ ID NO: 573408 - DNA, 419 bp, Homo sapiens
ttctgatccgctgggtctctgcctgctcttatgccaatgctgcgtctggtgactacgcacacacgaatgatgctgctgatcagagcagagattgaggccaacatcacacctgatcctcggcgcccattgcctcagctcaggatctctaccaccgttgatgtgcagatgatctaaacagatactaggacgtaggacaatggcctactgcatgtgtaggtgaacagtcaagtccaatatgtgacccataccgacctgcacaagtatgacactgaggatgcacgaaagcatacattgggcaagcccctgaccctggtcactggctcgctccacgaggacctgacatacatgagtgcgactgtgcgtcacacagatgacggcccgcatacagctccgatgctagactaacttcaggatgaggt

SEQ ID NO: 573409 - DNA, 351 bp, Homo sapiens
atggaacgtcatcaataacggatatgtacggactgaacatacgcacatctagctcagtgccccaaaatatacaggtcctctgtgaccttggcatggtgagcatttatctgggcatccaactgtacctccactggcatgtcttgcacacccttggaccaaagtccgagaagagtttttgactggcaaggggcgggggacagtcctcactctcgccctgaggggtggctgctcccaggctggcgacagtctcataggtcttgttgctgatgtccagcctcccactggcccagtgagcctgggccgggagcttcagcaagcagcgctgccagagcaaaagattgaggatgagga

SEQ ID NO: 573410 - DNA, 646 bp, Homo sapiens
  misc_feature (34)..(34): n is a, c, g, or t
  misc_feature (54)..(54): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (98)..(98): n is a, c, g, or t
  misc_feature (149)..(150): n is a, c, g, or t
  misc_feature (162)..(162): n is a, c, g, or t
  misc_feature (164)..(165): n is a, c, g, or t
  misc_feature (173)..(173): n is a, c, g, or t
  misc_feature (179)..(179): n is a, c, g, or t
  misc_feature (192)..(192): n is a, c, g, or t
  misc_feature (199)..(199): n is a, c, g, or t
  misc_feature (213)..(213): n is a, c, g, or t
  misc_feature (220)..(220): n is a, c, g, or t
  misc_feature (222)..(222): n is a, c, g, or t
  misc_feature (252)..(252): n is a, c, g, or t
  misc_feature (271)..(271): n is a, c, g, or t
  misc_feature (293)..(293): n is a, c, g, or t
  misc_feature (311)..(311): n is a, c, g, or t
  misc_feature (318)..(318): n is a, c, g, or t
  misc_feature (348)..(348): n is a, c, g, or t
  misc_feature (359)..(359): n is a, c, g, or t
  misc_feature (405)..(405): n is a, c, g, or t
  misc_feature (423)..(424): n is a, c, g, or t
  misc_feature (427)..(428): n is a, c, g, or t
  misc_feature (440)..(440): n is a, c, g, or t
  misc_feature (445)..(445): n is a, c, g, or t
  misc_feature (478)..(478): n is a, c, g, or t
  misc_feature (502)..(502): n is a, c, g, or t
  misc_feature (504)..(504): n is a, c, g, or t
  misc_feature (544)..(544): n is a, c, g, or t
  misc_feature (565)..(565): n is a, c, g, or t
  misc_feature (589)..(589): n is a, c, g, or t
  misc_feature (591)..(591): n is a, c, g, or t
  misc_feature (601)..(601): n is a, c, g, or t
  misc_feature (605)..(605): n is a, c, g, or t
  misc_feature (609)..(609): n is a, c, g, or t
tctaacgccaacacactttatttcccttcggacncatctgcaagcttctgccanacctgaacccacggcctggcaccaacgcnaccancacnccccanaggtcaatcctgggggctgaggagctgcaatttccctttcttcctgaaaannaaaaaaactganannaattgaanaaaccncactgccattccncactcancagtttcagcaggnctgaaangnggctgtgggaagttgccattttgggaaggngtttattctctgcggctanagggattgcctgctttaaaaanccccttacgctgattaantcaaaantcccttcaaagtaaaaaaccaacctttcanggtccaaaaangtggtatttctggtttcctgatcaggaggcttgcaaacctaaaaangttcttccttccaaaaannaannaacctgaagtanaaaanctcaaacggcagaattttctatttctggaaaanctggctgcgatttgtttttgggananagtgaggcaagtccctgtggcagagaacgaattggccccncggcctctgtttgtgagagcngcccagccacacccaggaagaaanancccccatgcnctgnagcncatcctccttagagagagaacgcctgcgggtttcggc

SEQ ID NO: 573411 - DNA, 378 bp, Homo sapiens
cacgaggccgaagaagtatctggacgacgcgccgcggctggtgcacaacccggacggctcggacatgtggaagttccgcgacaccgtcatccccaacgtggcgctcaacgcggtcgccggccggccgaaggaggaatacggcatcgagccgaccgggctcgacgagatccggccgggttgctacaacgtcgacgagcgcgtcaaggacatgaacgccggcggcatcctggcctcgatctgcttcccgtcgttccccggcttcgccgggcggctgttcgccaccgaggacaacgatttctcgatcgcgctggtgcaggcctacaacgactggcacatccacgagtggtgtggggcctacccggcacgcttcatcccgat

SEQ ID NO: 573412 - DNA, 366 bp, Homo sapiens
ttagagatgattctgaagagccttcgttgactgtccctaggtataggctcctggtcaaaggatttcttcatgaacgccatggttcatggccgtgctgagagacaagtgcattctctcggatctacggacgtgtgctaaacggtcttggtcaccaagatgctctccagtcggttgtccatggtctgtccggatttattcggacacagaaagtccttccacattgcacctaattctccggtcaatgctttatgacacctaagtctcgtggtgggtgagtgcgtgacaatctgtggtccatggtgcacacgcagtttgtgagagcagaggcgtcccacataccgcacactgtgtgtgagcccgcgtgcc

SEQ ID NO: 573413 - DNA, 604 bp, Homo sapiens
  misc_feature (440)..(440): n is a, c, g, or t
ctgggcgcggtggctcacgcctgtaatcccagcactttgggaggctgaggcagggggatcacctgaggccgggagttcgagaccagcctggccaacatggtgaaacccagtctctactaaaaatacaaagaaaattaactgggcctggtggcacaagcctgtaatcccagctacttgggaggctgaggcaggagaatcgcttgaacctaggaggctgaggttgcagtgaactgagatggtgccactgcactccagcctgggcaacaagagcaagactccatctaaaaaaaaaaaaaaaaaaaaaaaaaaaaaaaaaaaaaaaaaaaaaaaaaaaaaaaaaaaaaaaggaaaaaaaaaaaaaaaaaaaaacttgcggccgaatttggggctaattgggccaattcgccctatagggagcggttttacaattaatgggccgnggttttaaaccgtcggaacttggaaaaacctgggggttacccaactaaatcgcctgtgagaaaatccccttttcgccagttggcgtattaccgaaaagccccgcaccgatggccttttccgttgcccaacctgaatggcaaatggaattgggcttttttttgtt

SEQ ID NO: 573414 - DNA, 1087 bp, Homo sapiens
catcacccggtcatgccgttgtgtgtcctccgtgtgtgtccctctttatcgatcttcttaccgccctaatcccccgttctcccttctttatggtctttccttgcctctggagccccgttctctggagggagtgtccaatttgttaacctggtgccccttaccgtgctataattgcccgccatgtgcgcataattgtaggcacagctccgccgagcttttctctagcccctagccttattgtgactccagactatgtactgggtgctctcaagacttctctggttttacatgcaaggccccatgtgtctgccccagtgaaacccgtctgcctaatatcggatcacaggcacttgtgttcagccatcaaggctcacctggtggaacatctgtagcagggcccctttatcaagccatcctggattgcctttggacacaagaaaggtttctagccacagtagatctttagctctcatagcatgcccaggggtgccggaatgaacactttctggaagctttcatcttttgcctacattatgtgcagcgaccctctcactgtggcagttagtagactcgcccaagctccctcgactttggatagcatttcgagggaccaagggcgggcggagtctctcaacagtgtgataatatgaggctccggtggctggtgactggacacttcactcaatacccggacgattgtctggcatcactacaagcatgggacgagacttgcttggttcaccacggagtttcaagaacgccaccttcgtggtacatgtagcatagaccccgtcttccgtaagaatttcgagagaagtgtgaataaaacgataagattaataacacaaggaaacaagggcgccgccgcgatctagaactagtcctcatagaacctgttgcatgcaagcttagtctcaatcagctttgcctcttctttttgagtgtatattattccagacctttctgccacttagcacttgtataatcaggactggatatggggatgatgggtgtaaattgtattgacaaagtcgcgaataaaaatctaccaatgtgaagcccataaaccatctattcgtatttttcg

SEQ ID NO: 573415 - DNA, 1501 bp, Homo sapiens
agcggaggagcctgggcctgggcctgggggtggggtgggggggacaggcgtccccaccgacacgaaaacccaatataatccctggaaggagaaagcggaataaaaacaaagatgtgccgatgactaccaaaagaggacagaaaagagaagacatagcacacggcgtaacacgagcgtcagggaaacacagagacaagcggaagggagagagataacaagaacaaaagaggaaggacagaagcaagagcgcgacaagaaaaaacagagaaacaatgaaataagcgaaaaagggaaaaagaagcgataaagggagagcaaaaagacgacgagaataacaaagcagaacgcatacagagacaacaaatacaaaagacaaaaaaaaggaaagaaccagagatacaaaagcgaaacagtaggaaaaatcgcagacacacgagaaaccaagagaacacagaacaaaaaggcaagggggacacagagaaaaagaaaaacaaaagatggaataacagaaaagtaacaaggaaatcaaaagagagagcccatgaaaataactaagagagaaacagtgataaaaagaaaataacaagcaaaaaaaagaacaaaataaaacacagaaataataaaaaaaaaaacaaaaaaacgaaaagaacagaaaacgaagcaaaaaaaaaggcaaaaaaaaagcaaaagaagaaaagaaagaaacaggagacagaaagaacaaacagagacaaagaagaaaataaataaaaaaatagaaaatagatacaaaaaagaaaaacgtaggtaaaccaacgttaaaaaaaaaaaaagatgaggaaacaaataagaatagaaattgatacacaataaagagcaataaattaacaaataaaagaaaacgaaaaaatatatagaaaaatagacaacaaaaatagatgaaaacaaaaaaacaaatagtaaacataaaagaaaaacaaaataagaaaaaatactgacaaaatatgaataaaaaaacaccaaatgagaaaaacaagaacaaaatcgaaacaagaaagaaacaaagaagacaaaagaaagaacacacaaaacaaaaaaacgagagaaacaagaaaagaagaagaacaaaacacaacacacacaacagaaagataacataaaagtcaagagaaacaacaaaaaaaacgaaacaacaaacagagaccacacacgagaaaaataacaaacgaaagcatacagacaacaaaagacaaaaacaaaaaaataagaagaagaaaaacaacaaaaagaaacaagagaaaacgaaaagacaaaaaacaaaaaaagaaacacacaaggaacaccaaaaagaacacaacaaaaagaacaaagaaacaagaaaaacaataacgaaaaaaacaaacaaagaaaagaagatagaaaggaaagagaacagaaaagaacaaaatcaaaaaaacaaaaaacaacaagataggagaaaaaaaagataagaaaaaaagcaaaaaaagaaaagcagaaaaaa

SEQ ID NO: 573416 - DNA, 300 bp, Homo sapiens
ggttctgagcgatctctgtgcattcatctctccattggtaatcccaaatgtggactgagcacacacctgtgcgtcaggcctgagctaggttctagggctgctactgtcaccaagacagatgatgtgtcctgccctcatggaggggagggagacaataagcaaagaaataactgcatgatgtaatgtcagccagggagcgatgctgcaaagcagggtgggcgtggggagtgacgcaggccggggttgggtgagagccatgctgaagaaagtcttaccagtctttccaggaaccccatgatg

SEQ ID NO: 573417 - DNA, 1237 bp, Homo sapiens
  misc_feature (244)..(244): n is a, c, g, or t
gcatatttgttgctgcttgctcttcaatgatgcagtgtgccatgtgtgctagctcttcctctgtatcaaggctcctgctaggcccaccgactgggtgctgggtgttgctgcttattgagaccagcaaatctctgtgaatgactgaagtgtgcttgcatcgttcgaccccatggggattagcacgttggtcgttctctctcacagcaggattggctttactgtgtagtgctcgtaccctctaagnctgggaagtctgagcatggtccttacacagatagggtagctgggtgctgggcctaaggctgacataggaggaatcgctcgaagaggcaataccttgtgcccgtgtccgttttgaatctatggaccgtcagtgttctagcttccacatggcaccagtgaacataggtgcattgcggtcaccaagaaggcggactcattactcatgacatcggagtccaatccaagccttggacgccttgtttagaacttagaccagtctacaacaccttgtcataccctaaggctgttgtgcacctacttgatacgggtagaggacacgatgggaccacggatgacaacgtaattcgtttgtcgcagcattgtcgtagcacgggattccacgtacacacatacacgtgcaagcgtatcccaccggccaagacaccttatatcggggcccaaaaccaagaatccggtaattactaacccccgtacgttgtcaagcgtcactatagctctcagtgtgggcgattcctggccttatgcaaggccctggaattcacgcttgccaggtaaaccagattctaaccggtgcgtatgggtaattttgcccacaaccaactggcaccgcataaggcattccccttggttagtggggcggcaaatgccccttgcaaaccgctttgggtgtgccaacaacaagactaggcaaccagagagtaaggttagggtgacttggagggggcctcaatactgaaagcttcctccattggaaaccaatcattaccccatttcccaagaattcccttgcatgacatccttgctaggcccattgagaaactaatttgccatgtggcacgagtcaataccttggttgcaagacctctttgggcaggggcccatgtaagccctttatcccccaaaagaatgcatccaaacgaacactccaaagggaaaggccaacgtggaacggccaaccccgttttcctatcaaggagacttaaggtttaacccg

SEQ ID NO: 573418 - DNA, 1067 bp, Homo sapiens
  misc_feature (1038)..(1038): n is a, c, g, or t
  misc_feature (1057)..(1057): n is a, c, g, or t
tccccaatcccgccagcgcggggtgattcgccccccccaaaaaggggggggggggggggcgccaaaacaccgcggggggggggggcctccggggggggaccccgaaaacaggggggggcggccccgcggcggcgctgagacggaagaggggggggtttgccccccccacaaatggggcgcggacaaatggagaaaacacggggtgagtgaaacccccgcggggaggatgaaacgaccgaggcacacacgcccacaaagccaccacaacgccactgttgggagagaagagccggactatgccgccacccgacagcatcgtagcagcgacgcgtgataggagtgagaagaaaagacacgcaacagggtttggaggagcccacgaacacaaggcaacgaaaactggcggcgcgcggaagaacacacattgcgccccacgagaaatcaacagggcgggggctactcacagggtagcccaacaccccacaggtagggggagagactcccagaagaacaaaccccgtctggaacgaggagaggcgaggcgcaccatgaggttgtacacaaaccaacgaaccaccctggcaggatacgggcagaacaagagcaaacggataagcccacgaccaagagcagatacaaccacagcacacgccgggctggcgcaaaggatataataggaccgcacagtgagccccgagtgggggaccgcagccgaccccgacaggagcgggaccagcatcagaatctagtcatctactgagagccacgatacgagacgcacaagcggagtagtgcgggcgacaacaacaacaaactcacacgcccggagcaagacatactacactctacgccgaaagctggacgacccgggcctaccagaactggtggaggtcacacaatacacggaagggcgggatctcacagacaaaggaatagctgagtcgctgcacagacttcggactccacagatatgaaagtcgtagatatgaggagaagaagtgaatccacaagctgcactgcgacgtgcaactggacgancacatctgagcacaattcngagcagcgag

SEQ ID NO: 573419 - DNA, 859 bp, Homo sapiens
  misc_feature (1)..(1): n is a, c, g, or t
  misc_feature (656)..(656): n is a, c, g, or t
ngggggggcgccccccccctctccctcgcctccccgctctgttaggtttctcacgtgcggggacgctgcgccccgcttgctcctccccactctcgttcgtggtggccgctcttctctgcggttcactcgctgggtcccaccactctctctgtcagccctcgcgctgtgtcgcatcccattgcttggggcacgcctcgcgcggcggcgtcctctcgcggtagctcacacacacctctctctcgcgctggggtgctcgctcgcttcacacacactctctgtgtccgctgcagtaactctctctctggcggggctctccctctcctccaccgtagcggcgcgcgcgggcgtgtaactctcacgcgcgcgcgcgctacgcgcgtgttcgccactcgctctgatatgctcgcgccacacacacacactcgcgcgcggtcgcacaacacacacacacacactcgctcgtgcacgaacgatacacacacacttgtttgttacacgccatccacacgcacacagacagtagagatgtctgtctatatgtatgctcacgcactcaaatgataacaacaacactatcaacatgctggtttgttgtctgtaggttctgtggtggacaacaccactagtcgggtgcgggctgctcataccagtattgntgtcggggcggaccctctactacctgcggcttcttttgagggtgtgtgggggacctcttcttctggctgtcgatgattaacaaacacgatagggtgtgctcctccctgtcttgtgagatagatttttttttatttttttttttcccccacaccacccgggcgaaagaggggaataggggaaaaaattttttggggttgtggta

SEQ ID NO: 573420 - DNA, 127 bp, Homo sapiens
gaccccctatctataaaagagaatatcattaatgacgtgacttcaatgcttgagcgaaatctctacttgacagtggtcctgatgtccacactgagggctgtcccttggcatttcatgtgagcaatgt

SEQ ID NO: 573421 - DNA, 368 bp, Homo sapiens
ctgtaggaattcggcacgcgagtacggttgttgttaatgttttggacataatcagatatgagcatagatagtcgagtgacaatatacctgtcaagccactgagattctgagacacacttaaatgttatgacaagagatgtattcctcaggatcatgattcttagtttactcatacatgaagacacgatccggagatatacatgaacttagtttttgattgagtgtaaatgcgcttatatgtcttcaatcaagaacataatcatattttaaacttagtatacctataatcaataggccgatgacactaagctctggggtagctttgcaatgtatattttaacagctctctggtttctttcctgggttct

SEQ ID NO: 573422 - DNA, 351 bp, Homo sapiens
ggtgatcctcgtgagtaggagacagacgtctcactttacatcacttgggcagtcattagctcgcatatctcagagttgggacttcccttcttgggaacttggatagatccgtcatgagagattgctgtgttgccctggctacagcttatatcgatgtaatatatgctaagtctacgccgctatagctggtggagctatttgactggtaggaatcctaccgtactaccttatgcaggcttggatctctaggaggcccctatgcactactacacgctttggaggctggcatggagccagatgccgaacggctatcagaatatactgatgcctggtgtatcaggtcacttttct

SEQ ID NO: 573423 - DNA, 629 bp, Homo sapiens
  misc_feature (83)..(83): n is a, c, g, or t
  misc_feature (106)..(106): n is a, c, g, or t
  misc_feature (129)..(129): n is a, c, g, or t
  misc_feature (240)..(240): n is a, c, g, or t
aaccactaagtttctgatccagtttgtgagactgttaggcattaatcacaagaggctgggtgctcgcgcctattgtggtgcantgtagtggtggtgtgggtaggantggactttttattgcattggacngaatcttctagcagttagactccacagattctgtggacatttatgcagcagtgcacgacctaagacttcacagggttcacatggtccagagtgagtgtcagtatgtctacntacatcagtgtgtaagagatgtcttcagagcaagaaagttacggagtgaacaagaaaaccccttgtttccaatctatgaaaatgtgaatccagagtatcacagagatccagtctattcaaggcattgagaatgtacctgaagagctgctggataaaaatcattccccgtgccatttgtgtttacatacttggttcatgcccgccataggaggccggctatttctgttgatcgtatgtataatttattaatatggagaatgtttaaaattttatataatttaaaggtaacagatattattgtacagacttgcattccgtagtttcttctgtaaatatgtatttctcacaatgttggatcttcagctttaaataatacgatttttccgcga

SEQ ID NO: 573424 - DNA, 198 bp, Homo sapiens
tgaagaacagtctctcagattctacctaacccaaatcactatcgcttccaatacacaagttattcgtactcaacacagttctcctgtcattagttttatttctatttctttcttttttttttttttttagaaatggatatcccgctctgtagcccaggctgaagtgcagtgcaaaaatcatcagctcattgaaccctc

SEQ ID NO: 573425 - DNA, 239 bp, Homo sapiens
ggggcccttttgggggccctacctcggggtccccgcccgggcccggccggggatccccggggccccccccgctcccggtttttccccgtcccttcttctggcgttttttttggtttctttttggttttttgaggggttggtttttttggggtttccttgggccgggccccttttgttgtccttgttttttgtttctgtttgggttttgtttgggtaaattttgaccaatgtaaaaccga

SEQ ID NO: 573426 - DNA, 494 bp, Homo sapiens
cgggccagtacggatgtgtggagtacggatgtggtttgttcttgctatttcaagttccttgtatgtgcatcattatactgtttatatagaaagtcttccatatgtatctgcatgtaggtattgactgctacagatgtccatcttagcactgcttttgctatatcccatagttttgggtatgctgtgtttcaattttcttttgtttcaatacatttttaaaattttctctcttaatttcttcattgacccagtggttattcaggagcacgttgtttaacttccatgtatttgtatcatttccaaagttactcttattgattgctagttttagtccacttttattccagttttattaatagtggaaaacttcccgagtctagcaggatgtttacacatctggatacaagaagctcagagattctcaaatatttataatgcagaaagacattctccacagcacattatagtcaagccttttctcacgttggggagct

SEQ ID NO: 573427 - DNA, 342 bp, Homo sapiens
tataggcgctatataggcgcaggttgctgagcagtgtctgcgctcttcgttggtttttttctatgagagtctttatctgtttcaccccgtgacagcatttggaatttccttatggacgtacttacttccctgatgggacatttcctggagctcatggtctgagaccgtctggtctcatggcacactccggggagctccttcagcttggtctctgattcccgggtctcatttagggcatcctctttcttcttcgtggcttctgctaggtggctgagcagtgtcgtgcgctgtgcgtctgttttttctatgagagtcttgatctgtttcacctaggggcctatg

SEQ ID NO: 573428 - DNA, 272 bp, Homo sapiens
catagctgaattcctatgaggtaaccccataaaccacgcctatgacttaatgcttgtttcgaccgtctaatcatgctgtgacaaagtacttcggctgacaagtgacacctaaaaatataatgtactttgacttaccttatgaccgctagcagatataaagactgtaatcagagttctcttgaataaattttgcgtctaaggaataaatactatttattcctaattagatggggcggaaagtctttgaagaggaacctttactttacttttta

SEQ ID NO: 573429 - DNA, 356 bp, Homo sapiens
  misc_feature (6)..(6): n is a, c, g, or t
  misc_feature (22)..(22): n is a, c, g, or t
  misc_feature (50)..(50): n is a, c, g, or t
  misc_feature (66)..(66): n is a, c, g, or t
  misc_feature (209)..(209): n is a, c, g, or t
  misc_feature (249)..(249): n is a, c, g, or t
  misc_feature (256)..(256): n is a, c, g, or t
  misc_feature (301)..(301): n is a, c, g, or t
  misc_feature (304)..(304): n is a, c, g, or t
  misc_feature (311)..(311): n is a, c, g, or t
tagggnactgtgggacactganaaaacagttggggaaaatctttcgaagntgtggaaatcccaaanaaagactgataattccctggtaggggtgtgtgcgtgacgtactgcagcctcaacctccctgggctcaagtgatcctcccacctcagcctcctgagtagctgagaccgaccaggtgtgccaccacgcctagctaattttttatncccagggtctaccctttgtttcccaggctggtcttgaatncctgggntcaagcaatccttccaccttgccctcccaaagtgttgggattatngcntgagccnccacgactggccagaggacaaaattttaataaaggtcttagctta

SEQ ID NO: 573430 - DNA, 115 bp, Homo sapiens
gaccacgtcacattggttttaaagaccttcacgaaagagatcggcgggcgatgcgccgggctcaagcgcaagactgcggcggacgtggcggcatttgtccggcctgcgaccatgt

SEQ ID NO: 573431 - DNA, 201 bp, Homo sapiens
  misc_feature (21)..(21): n is a, c, g, or t
  misc_feature (45)..(45): n is a, c, g, or t
  misc_feature (51)..(51): n is a, c, g, or t
  misc_feature (63)..(64): n is a, c, g, or t
  misc_feature (67)..(67): n is a, c, g, or t
  misc_feature (91)..(93): n is a, c, g, or t
  misc_feature (95)..(95): n is a, c, g, or t
  misc_feature (144)..(144): n is a, c, g, or t
  misc_feature (149)..(149): n is a, c, g, or t
  misc_feature (198)..(198): n is a, c, g, or t
gacctcatggtatagcaaaanacaacaacaaaaaaagaataaaanataaancagacaaaaaannganaacaacaaaaaaataaaaataaannnanatccctaagtctcccttctacccacagaaccaacaacacccttcccggnctttnctttccctcggcctcttctcgtcccctaagcacacaacatccgcttgcntct

SEQ ID NO: 573432 - DNA, 104 bp, Homo sapiens
ggatttgctggtgcagtacaactaggcttaatagggacatgaactgagtgaaaatttaaaatatcgtcattttgaagtgtagtcttatcttattctatgcaaaa

SEQ ID NO: 573433 - DNA, 328 bp, Homo sapiens
taatgctcctgcatacctccaggacacaggttcaccagctgggtgtctgtcacagacactgagcctccgcgttggtccaaacttgtactctccttgacaggtcttctctggccctcctcaaactccacaggactgacactgtgttcgctgatggccacatcactcgtgtcgcggcgtataggatgggctgcggagtgaacgttgtctgccgtcgagatggagccttcctgtggttcgcgcgcttccttcctgaagcctcatatttcccattccgtagataaatgggcaactcaaactggaaagtgcagttaccagtgtcctcttcata

SEQ ID NO: 573434 - DNA, 897 bp, Homo sapiens
taaaagcttatgggctcaatatctatcattcgtcttctttcccaaactacacatcactgtatgactcaaccagtagcagtttattttggcccctgggtttttatccagtttaacgtaatgttcccaagataagatggagctaaataagctttaaaaaaaaaaaaaaaaagggtgtgatatctcttttttcctttcactccacggggcgtattctcttcggcttatctcctccagaaatatattaatggcgcctaatctcacgcctcaactttacaacgagtggagactctcaaggcgcgcaacaatctctttgtgaacaccgcccctgttcttagtgtgtgtgatcttttagaaaggtgagagcccctttgtgggacaagagattttcgtatgcaaagccgcggatataataagcattgttctttgttataaaatgggctcgtggctgggggtgccacgagagatgtgtgtcctcttaaagaaggtgaatcccttttgtggtgttctgcgtggattcacccccccaaattttttcggggggcggcatggcggcgagaagtttgtggagggtggcgtagctccttttgtgagaacggggggcccaattgagccgtcaaacgtggcgggggaggcatgttcgccggatataggcttttttgtggcgctaatctccttgttgtgtgcgcgggagccacacctccttgggttgcttttgggggcagaccccaagatttcgttatctgaaagccgtggcggcgctcagaagtgaaatttgtaagaccgggggaagactttaaaagaagccttttgtggccccctgggggggtatttctggtcggtggtaccccgtctttcggggttcacaatccgggggcctttaacccgggggccaaagaa

SEQ ID NO: 573435 - DNA, 214 bp, Homo sapiens
cttgccccggcatgctgagagtataaggtgggattggtggcaccggttgctgccatactaaaattggtaggcctttaaggtgtaatggtggtagaatctgtaggaccttgtgatgaactcggggcctgaccttacttcacagcctgtggagacccagtggccctcgatggtaggtggcatctgcactgtgatccttgcacaacttgtcgagatt

SEQ ID NO: 573436 - DNA, 383 bp, Homo sapiens
  misc_feature (272)..(272): n is a, c, g, or t
cctgtcttttgaccaagacatacctctatcatcactcagttattaaagtcaccgcctgccctagtgacgcatgtttaacagtgccgcggtaccctacgcgttcaagggtaccataatcacttcttccttatttctggaccttttttaaatgtttctcccgtaacagctgtctcttacttttaaccagtgaaattgacctgcccgtgaagaggcgggcatgacacagcaagacgagaagaccctatggagctttaatttattaatgcaaacantacctacaacccacaggtcctaaactaccaacctgcattaaaatttcggttagggcgactcggagcagagccaacctcgagcagtacatgctaagactcacagtcaagcga

SEQ ID NO: 573437 - DNA, 461 bp, Homo sapiens
atttatttacaggatcatgtgtgaatgtgttcacccagagttcaggtcacggcattttattctcttaatacaaggttttcgcaacggttaccttgctttccaaaggtggatatattttggatgagaaagctgagttgttttaatttctaatacctcttataggagaagaattaataagtttttagaagcagtatgcgggtaagatacagtacatgatttggttttctgacaaaagcgagttcttagtgcgtgaagaagaagactgagtctggcttctatgtcaatttgtcgccatagaagtgaaagcgtcgctcttgcttctttcattattagcttgggacgcaatgagtgtgatggattagaatttggacagagtaggtggggcctcagttccaattcaaatataatgtctatgttcaaattgagtgtgctgtgaagttgttctgtctttgaaaaaaaaa

SEQ ID NO: 573438 - DNA, 113 bp, Homo sapiens
gatggttatagtatgtcgggactcccactccaggatgcgggctccccttggttgcactgtagagtggacagacagtggacagtaccatgtagaatggggtgtgaaggctggcc

SEQ ID NO: 573439 - DNA, 385 bp, Homo sapiens
aaggtacagaggccagggagtgaaaatggttgacaaaagagggaagagttaggtgtctcatagccactcatagtggggtggccaggggtaatgcgcatctccccactttaggcttctctaacaaacttctgacacctctcaagttcacatctttaatgtggaaacacagaaggtgtggggaaggaggggcattttgtctgtttgcaaacgtgtgcgcttcaggccttgggacttgccaagaggcaaggaagaaaggaaagcgaaatcgtcgtaagatgtttgttgaaccttagggatcccaccgtaaatctccacagtcacccctgttacatgaggaggggaggggtgaagtggggaataattcttgtattcgtccaaaaaaaaa

SEQ ID NO: 573440 - DNA, 125 bp, Homo sapiens
gcttgtccccagaccagagtggaataatgccactcacagagggcatgaggagaatggcacctgtgctgcaggctacatgcagccaccacacgtgactgtgtgcatctgataacacctgtggtgat

SEQ ID NO: 573441 - DNA, 86 bp, Homo sapiens
tttttttttttcaagccaatataaggaatttattgtgtaaaaaagaaacatctagagaatgccacagacaggcctagtatggctac

SEQ ID NO: 573442 - DNA, 366 bp, Homo sapiens
  misc_feature (19)..(19): n is a, c, g, or t
  misc_feature (24)..(25): n is a, c, g, or t
gggtccgggagcgcggcgnagacnntgcctgagatcagagtcacgcccttgggggccggccaggacgtgggccgaagctgcatcctggtctccattgcgggaaatgtatgctggaggtggatgaatgggctgcaaatgacgaccgacgcttccctgacttctcctacagtcacccagaaccggccgccataacagaccttcctggactgtgtgatcattagtccacttccacctggaccactgcgggggacatacccctacttcatgcgagatggtgggcttacaacgaagacccaatgctaaactgatctcaccaccattgacatggacatacttgtggacaactcagtctgcacgaactatcgc

SEQ ID NO: 573443 - DNA, 644 bp, Homo sapiens
  misc_feature (28)..(28): n is a, c, g, or t
tatcagtgcttggtcccccggcagttantgcatatgtcgaccgagacggcctcgcgccgcagcgatgggcatctctcgtgtgacaactggcacaagcgccgcaaaaacgggggcaagagaaagtcctatcacaagaagcggaagtatgagttgggtgcgcccagctgtcaacaccaagattggtgccccgtcgcattcacacagtccgtgtgcggggagtgtaacaagaaatacctgtgaccctgagtgttggactgttgggtgaatttctcctggtggctcagaagtgtttgtactcgtaaacacaaggatcatcgatgtttgtctacaactgtcatcttaactacacgaagcttggtttctgtaacgcaacgaacccctggttgaacggacatttggacatctcgtggctccaatttcgacgcaggcgaccccgcgtaccagcacgggtgtgttacagatgtcccccaacatagctgtccgctattgccccctgttgggccccggccgagcaagtggggaccccagcagtgttgcacctccgatgtagagacacgacagaagaatttcttatcacccaaagaaacgcattcttaaaacacaattccctaacagaaactattgatgaacaggtacacacgcca

SEQ ID NO: 573444 - DNA, 130 bp, Homo sapiens
ggaccccccatctcaagtcatataccaaatctctccctcactaaacgtgatgccttctccgtcacgtctctgcaatcattgtccattcatagcacggcatgttgagtgtggattagaccaagacccagac

SEQ ID NO: 573445 - DNA, 109 bp, Homo sapiens
cttccttcttatgcgttgcttgtatacttcctcgctccttaagcctcagctcctcgatcctgttagtccttcatttgttatctctgacgtgcctttgattacgcccgca

SEQ ID NO: 573446 - DNA, 199 bp, Homo sapiens
catgtgcgtgtgcaagacagggggccttgaagcagagttcccccgtgagatcaggtgtctcaatgaagggtggaagaggtagttggttaaaggttgcaattagagtgctggatgctgcagaggtgtatcctcttcatggctccttggaatgagacccgtctctcatggaaattcataaataaaactgtggttactgaga

SEQ ID NO: 573447 - DNA, 308 bp, Homo sapiens
  misc_feature (23)..(23): n is a, c, g, or t
  misc_feature (205)..(205): n is a, c, g, or t
  misc_feature (240)..(240): n is a, c, g, or t
  misc_feature (268)..(268): n is a, c, g, or t
gagggtcccaaataattgcattntaattcctctgcaatcttcctgccgccaacaatttctcttgttggctgttttaggctccatctgggaggaacccagcctccctcatatgaaaaatgagttccctgggatctattttattttatttttttgaagacagtcttagactctgataaacccaggaatgggagtgcagatggtgacnctctaagagctaccacatagcacacctacatgccnacacaggagttcaaagcaaattcatcantgatactcagcactcaccagaagtaagacaggagactaca

SEQ ID NO: 573448 - DNA, 1330 bp, Homo sapiens
  misc_feature (537)..(537): n is a, c, g, or t
  misc_feature (1330)..(1330): n is a, c, g, or t
tggcttcagcggtggtttattggacatacaggtaggctctatagacaacaggccgggaggtgctgtgcaagtagtgtgggggaaaaagtggagagggtgggaggggtggagtgtgttgtgcggtgcgaggaacaagctgtgagtgtgggagggtgtggggcacagaggtgtgccaacactgtggaagagagcgctcttagaagaacgcttaaagaacagacacagagttagagagcgccagagggggccacagagagtcgtcgggcttctcacagagtgtgacaacacacacagacgcccagagtgtcgcgccttaagagcgcgcccctaaacactctctgtgtgcggtggcgtttattctctgtgtgacacccccacacagacaccagaggggtgtgtagggagagtctctctctctgtggagacacctctctcccactattcttcctctctaacaagaggacacactgctggacacagagagagcttcacacacacacagagagtaaaagagagacagagcctgtgtcgtcaccnctctctctgtgttgcacactctcgtgtggctctcacagtgggggggccctctcacagagtctcacagagacatatctctctctctctctctctctctccccctgctgtgacgtggggcgggtggggggcacacacaccacgatggcaccgtgggggcacacgcacccgagggcgctccccgtgaggcgcgcgtggctccccccacacatacgacgacgacacgagggcggcgctggagcaaaaacacaccacacggccccacacggtggtgtcctccccacgcgtggaagcgagccgcgtagtgaagaatactcctatgctctatgcttcgccgctgttggtggtgtggtctctccacaacgaagcaccactaccgcacacgagtgtgcggcaccaacgcgcttgtactacacaagagccgtcacaaaaagaaacgtatgtggagcagcagtctctactcaacaccaaacaccaggccaagtagtagatggaaccaggtgggcgggcccccctaactaccaggtgggcgcaactggtggctgggcggccctagtctggaggggcggagcacgacacaaaaccagccgcgcgggcggccggtaccttaggcggcagcaacaccccacggggccggcggcgaccacccccactggggcccacacgccaccaaaaccggggggggagacaacgaccacccacagagtggagggacgggagccgcaccccccaaaaatccaaccagcgcgggggacccgcacaccacggcgggcaaccccaaacaccaccaacgcgn

SEQ ID NO: 573449 - DNA, 405 bp, Homo sapiens
  misc_feature (65)..(65): n is a, c, g, or t
  misc_feature (234)..(234): n is a, c, g, or t
  misc_feature (276)..(276): n is a, c, g, or t
tcacgcccatgtcacaacatcaatgaacgatgctgttacttgttccaaacacatatcatttaagnggtttggataaacaacaacctaaaataaataagcactaagcaaactcagggctacataaaccctgtggtgaggtaactgacaatgggtacaactgggacactttactgttaaatcacctctatctacatgtgcccaagctgtgaggtacttggttttaatcctaaaaantcatggtgcacatttattcctgccttccaactgggctctaangtcacctcctcagagaagcccacttttctgtgcttccactctgctttttttcagcatttagtagagcatcagtcaccatccatatctgggaacaatgattgtaagaaacagaaacccatttgcatgagc

SEQ ID NO: 573450 - DNA, 194 bp, Homo sapiens
tcagcactgatggaaaataccagtgttgggtttttttttagttgccaacagttgtatgtttgctgattatttatgacctgaactgattatttatgacctgaaataatatatttcttcttctaagaagacattttgttacataaggatgacttttttatacaatggaataaattatggcatttctattgaaaaaa

SEQ ID NO: 573451 - DNA, 133 bp, Homo sapiens
gataggatcctaacagagcggactgaacatgcgccggacatgtctcgaccttgttccaatgtcttcctgaagcagtagagcagcccgtagttcttgagccagtgctgtcatggttgtgtgcagtttgtgtcag

SEQ ID NO: 573452 - DNA, 241 bp, Homo sapiens
gaggatccgtgatcggtacttggttgcctgaaacaccaaaacaaacccgggctctgtcactgctcaccctctgatttaactttaactttttatcctgctggtaggtggtggatgcgtaagaatttaaaaagaagatactcacatttcggacaacgtgtttcatggtagaaggaaaagaaacgttgacatgtttaaacacaaaaccacaatattttattctttacaaaggtgacgatgctta

SEQ ID NO: 573453 - DNA, 271 bp, Homo sapiens
  misc_feature (183)..(183): n is a, c, g, or t
  misc_feature (210)..(210): n is a, c, g, or t
  misc_feature (240)..(240): n is a, c, g, or t
gcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtntgtagcccccagtcacgttcctcacgnttactttgatctattatgacccttttacgnggaccccttaggagtttgtaagctctttaaa

SEQ ID NO: 573454 - DNA, 613 bp, Homo sapiens
cttcattggtagtagccgggcccttaggtggtgcctaaaccagttatgtgtgttgcatgagcccccgccagtagtttacagagtcccctaatgcggcacagaaccgttggtgacaagaaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 573455 - DNA, 654 bp, Homo sapiens
  misc_feature (353)..(353): n is a, c, g, or t
  misc_feature (358)..(358): n is a, c, g, or t
  misc_feature (361)..(361): n is a, c, g, or t
  misc_feature (370)..(371): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (392)..(393): n is a, c, g, or t
  misc_feature (395)..(395): n is a, c, g, or t
  misc_feature (397)..(398): n is a, c, g, or t
  misc_feature (408)..(408): n is a, c, g, or t
  misc_feature (412)..(413): n is a, c, g, or t
  misc_feature (418)..(418): n is a, c, g, or t
  misc_feature (422)..(423): n is a, c, g, or t
  misc_feature (425)..(425): n is a, c, g, or t
  misc_feature (427)..(429): n is a, c, g, or t
  misc_feature (432)..(432): n is a, c, g, or t
  misc_feature (435)..(435): n is a, c, g, or t
  misc_feature (620)..(620): n is a, c, g, or t
  misc_feature (622)..(622): n is a, c, g, or t
  misc_feature (626)..(626): n is a, c, g, or t
gcagtcctcaccaccctagcccaagtgggcacccactgtcgccaacacctcgaggccaaagcatcgcctgctgcacaagctatccactccgtgctcctaaaccagtactgtgtggcatacaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcatcacaagagcncctgnaanccccacgcnncctctnccngctctngnananncncnntgcaagcctncccnnaagcngacnngntnnnccnagnagggtaaaaaacttgttgctgcaagtcaagctgccttaggcttataacatcacatttaaaagcatctcagcctaccatgagaataagagaaagaaaatgaagatcatcagctcactcatcagcctttcttattagcctcctatgtgcttcaattaataaaaaatggaaagaatctaaaaacaatnanaaanaaatcacaaacgcgagactagttctctc

SEQ ID NO: 573456 - DNA, 373 bp, Homo sapiens
  misc_feature (90)..(90): n is a, c, g, or t
tcttatgctagtaggtcagaggactataaactatcagcggctgaccccggagacacctactccgttactgttgctgctataccaccaagnggatggtgccgcagaatgccaaattgtcactacaacaggtgcagtcccaggccgggccaccatgatgatcagcaccacgggcataaacactgcgctgctccagtggcacccaccccaggaactgccttgcgaagctgctgggctaccggcttggcagtacccgccggggccgaccgaggcgcggcccaacaacactatatatttcggcgagggagtgaccagcacttcacagtcaccgggctgcacaaggggaccccctacatcttccgggttgctgcccaga

SEQ ID NO: 573457 - DNA, 663 bp, Homo sapiens
  misc_feature (47)..(47): n is a, c, g, or t
  misc_feature (304)..(304): n is a, c, g, or t
  misc_feature (309)..(309): n is a, c, g, or t
  misc_feature (312)..(312): n is a, c, g, or t
  misc_feature (321)..(322): n is a, c, g, or t
  misc_feature (328)..(328): n is a, c, g, or t
  misc_feature (331)..(331): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (343)..(344): n is a, c, g, or t
  misc_feature (346)..(346): n is a, c, g, or t
  misc_feature (348)..(349): n is a, c, g, or t
  misc_feature (359)..(359): n is a, c, g, or t
  misc_feature (363)..(364): n is a, c, g, or t
  misc_feature (369)..(369): n is a, c, g, or t
  misc_feature (373)..(374): n is a, c, g, or t
  misc_feature (376)..(376): n is a, c, g, or t
  misc_feature (378)..(380): n is a, c, g, or t
  misc_feature (383)..(383): n is a, c, g, or t
  misc_feature (386)..(386): n is a, c, g, or t
  misc_feature (629)..(629): n is a, c, g, or t
  misc_feature (631)..(631): n is a, c, g, or t
  misc_feature (635)..(635): n is a, c, g, or t
ccgaccgcccacacaccagcccacagtgcccacccatctccgcacanacccctaagccctcacgaacgccccgtgcaaacactactctccgctgtactcgcacccagttatgtgtgttgcatcaccacaccgccagtaagcgccatagtcaccccatgctgcacacaatccctggtcaccgccgcccctgctttccagctctcacagccgatacaacataggttcctgagaaggaccgacccctccaggaccaatctgcacttgctgagcttgtcacacccaagcccaaggcatcacaagagcncctgnaanccccacgcnncctctnccngctctngnananncncnntgcaagcctncccnnaagcngacnngntnnnccnagnagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaaaaacaatnanaaanaaatcacaaacgcgagactagttctctc

SEQ ID NO: 573458 - DNA, 101 bp, Homo sapiens
gtcaattgctacacgctttatttgagttaaagataacaaacaatatacttttatgtaaatagctatggcaatgtagtttacagtaattccttttatatata

SEQ ID NO: 573459 - DNA, 187 bp, Homo sapiens
tgagcagacgtgttgaatggaacggctacgacctggttaaggccatgtgacccttgtaccccaggaggctctggtgctgtgtcgggatgagacggagggaatggtcatgcctcatgaggccatgataattatgagggaggccctatgagaagtatagggaacggacttcaaatgataatttcgccag

SEQ ID NO: 573460 - DNA, 334 bp, Homo sapiens
ccggcgctcgtaggaataacggcagcgcaggagtatctgcagactctttgtaggagaaaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 573461 - DNA, 849 bp, Homo sapiens
tgggctggctccggccagttaatggaggtttccacgtgggggtaggggaaggggcccacccttgccctggcggtgtccccccggtgaaggacctctcccgaaggaagcaatgcccacaggttggagcacatctggttccatgggttcttctgtggtccccaacagggcagttctggggcctcgtgggggctcgggcaatgttccagagtctgcggctacgccccaggtgttctccggggtggctgggcagactctgtgcaagggcatctagggcagtcccccattttgggacccccagttcttggagggccaaacccagggtttcccatttggctcgaggcaagaggagacgccctttggttagacgcggcccaatttctccttccatggatgagtgtccgagaggaaaagagatggtgttctgggaggccctcatatagggttgggtcacaagacgcttgggaggctgggggtttggcccaagaggagaccacccatttctggggcgcaagagaccgctggttgagtaaacctccaaagagagagtcctggcggtcacggagggcgccattgcgggggaagagacccacagtgtgctgagacggctggtcgtgggaggccacaggaagtgggcctcggagtggcccccaggggggagagtgtggggtggccaaaaaacaaataccctctcaggagcgcctacggggttgtcgacccaacgaatgggcaactctcaaaagggagacagcggccaaaggaagggaacctccatctacagcaatgaggaagcacaagaggggtcttcgttggcttatggcaacacgcacgattcaggaaataggactctag

SEQ ID NO: 573462 - DNA, 313 bp, Homo sapiens
tctagaggatcccgcccgagaagctgagctgcccagatggtcgctacccgaatgtcagcgtcacaggatatctgagatgctgggtgacccccaaggacgcatgaccggaccaatgaaagaaatcaatccttactccttgacagctcattccgtggttgtatcagagacttatgcgtggccaccaacatatgaaagtgagtgtctatgctctctaaggacactttgacaagactgaccagctcagggctgttgtcacctagtcttggagaatgtcagcccaccaaggaagggctcggtgtgaacagatgctaac

SEQ ID NO: 573463 - DNA, 1154 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 573464 - DNA, 909 bp, Homo sapiens
  misc_feature (133)..(133): n is a, c, g, or t
  misc_feature (135)..(135): n is a, c, g, or t
agcgggacgactcagggacctcccgagcgccaggagtcaggggccgacctgcaggggctggaggggccagggcaccgcgagagcgggcatgggcgcagagacgtccggttcgcacggcgcgcgtcggccgagngntcatttcgaacccgtgcagattcacatgtgttgagcagtgcagccacggtcatggaggagtgtcgttacaggagtctctcagtggtgacgtgaatagtggcgacatgagtccgccattgaggtccctggatgggagagaagtcggagaaattcgcattggtagctgctggacgtggtcgtgaacacgacgggaaggcggtcaggaccaacagcagataatgacctgctactgaaaccgttgggctgatcggaggaaagcatctcgttagcccgtaaactagccaggtacacattgtctaactgtaggaatcagagaatcaaagcagcaagtgatcttttcaggggactgtcaggtggcttagttcttccacatctttcggtagcccactgttcaactcgatctcgtgagtcgacaaaatgcagtcattctcgtcataatgcaggaaggcccatgaccgaggtcaggtgagcgctacctggagaggactccaaagggccaggccctgggttccccttgggtggaagactcaccggttccttgaaccgtgtcattcgtgagacaggggccggtgtgtccgttgggggcattccgcgggtccatcgaaaggttgtgccttgatttcttgaccacgggtgccccgcaggttttggtccccaattctggacaacttggtgggagagggttgtcccgggggttggccccacgatgtgttgccaacaggcgtgtccgtttccaaactggttggcgtgttcttggtgccctgggggaggaca

SEQ ID NO: 573465 - DNA, 1183 bp, Homo sapiens
gccaagatatatctgtgaaaatcactgattcgatctccagtaacactgaaggaatgctgtgaataaacctctgtctggaacatacactcccactgtcattgccggaaggtgcgaataatgtagtgagagtgcctgctggacttggccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 573466 - DNA, 664 bp, Homo sapiens
ggttgcttcccggggcgaaaaaatacaccctttttttttaaaaattttcttttaaaacccctctcccaaaaaatattaatcccccccaaacaaattttgaaaagaaaaaaccttccccttttttaacaattacaccaaggcttcgggttcccccttgggggcgcccctatgcccggggggaaattcattttttataaggaaaacccctttgtccacagggcctttaaaaaaggcgttcttttcaattgaacaccttcacctccgccccaacacaggaggcaaaagatttttgtaaaaaaaaaaaaaccaccttgggggagcggcccaattaggcccccaaatatctccccggtggtttttaaaagccccttgaaaaaaaacggggggggggaaaccccctttttttttaatttttcccccggcatttagctcgatataccgcgggggagggggcgctatccccaatttttgggaaaaaaaaaatagggagggggggggactttcgggctccagcggcggagaattgtttgtggaaaaataaaatcttacaacacccgtgcctataaccaaaaagttccccgggctgggaactccgaagaacaccggcgcccctttgtgtgccaattttgggccaaaaccacctgtttttttctttctgggcccg

SEQ ID NO: 573467 - DNA, 1864 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
  misc_feature (1220)..(1220): n is a, c, g, or t
  misc_feature (1353)..(1356): n is a, c, g, or t
  misc_feature (1434)..(1434): n is a, c, g, or t
  misc_feature (1467)..(1468): n is a, c, g, or t
  misc_feature (1596)..(1596): n is a, c, g, or t
  misc_feature (1641)..(1641): n is a, c, g, or t
  misc_feature (1667)..(1667): n is a, c, g, or t
  misc_feature (1722)..(1722): n is a, c, g, or t
  misc_feature (1807)..(1807): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctatcagagtgtctgatgcgctgctactctggtccacacccggctgttgtcctctgcatccccgcccnccctgtcctaagctcccccccccggcccacccccctccccgcccaggtatcatctcacgcccacagtgactcacgggctatgccgaggccctccccctgctcttgtcaatggtacggtgcgtcccgtgagtannnncaccactactcccctcaccgccatctccccactatccacccgctacgcgcggccatgccgccagcacacacatccccncccgccggccacttcctccccccccccctcctnncaccccgtcaccgctcgggcctcccgcgcctctcagactcctctaccccttccacaacaacgtttatctggtcgcatacatattatttaatgccccccactaatctgtctaactaccccctctccagntcccagacagcacactcggtgtgcagcgctcgcagcgctttcatntccaaccacacacgctccccagcccnccacacgaatcccgtgtgcttcgctctgatccgttaagaggagccatcgagttcnccctatggtaacatgttagtcccagactgtgcaccgactccccacctctatggctcccactcgcctcgtattcccctcattgccntccacacccacccatcagtctatcatccctccattcgccactctcttccaccctcag

SEQ ID NO: 573468 - DNA, 228 bp, Homo sapiens
tctggtatgcgagaagtgaacaaacaacgattgacaaaccagttcacattataagataaaacggttaaattaaaactcaataaacgatataattcactcaataaaaacagcttatagaaaggcagtgcttgacacatagcactgtaaaatataacaatgttattatttaaccgcaatatcattgttttttgtaccattaatgagatacctgagcataataatcagtta

SEQ ID NO: 573469 - DNA, 1026 bp, Homo sapiens
gctcctcgccagcagccgtccggagccagccaacgagcgtttcgctcttgttgcccaggctggagtgcaacggcactatctcggctcaccgcaacctctgcctacctggttcaagcgattctcctgcctcagcctcccgagtagctgggattacaggcatgcgccaccatgcccggctaattttgtatttttcgtggtggtggtggggggggggggtccctccagtgtgggctcaggcgggtctcgaacccccgaacctcgggttgacccgccgtgcctcggcctcctaaaggtgcggggattatattaggcgtgtgggccactgtgggcctgtggccttaccttcaagttttattaaccattttcattacataggaaatgggtggtgtttcccattaaagggaaaatgtggcagacacattttccgcctccagtgagtgcgtttactcgtgggctctggaaacccaaacccttcagggatgtggcctgggcgcatgtgggggaaccagccgtgcgtggggcaggggggcatacccaggggctttcctatcctgggggcctaccccggggcaggggacccccaggggcttatcctgggacagggcacctccagggggccttaccatggaggcacctggagcttatcccgggagcacttgacctggaggtctacccagggccacccagcggcctggggctaaccatcttctggaccgcaagtgccccggagctacctgccatgggccctatggcgccctgtgtgccttgattgtgcttataactggcttgcctgggaattggtcccccattgctgtaacaattcgggccggtgaaccccatgacccagatggtttaaattcccaaagggactatggtgccctccactattacccggttctgggacacccgcgggcctggtgtggaacacagcgtacgcggggggaaaaacaaggggtcaccacagaggagcccccacaaaggtgtacgaccacgtgagagcctgggcacacgctcaaaacacagcga

SEQ ID NO: 573470 - DNA, 1366 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctcctgcaaagctgccaaaaattgaagcgcactattggatatttttacaaactcaagggggggcccggtgcccataacccccatagagaggcgtatatcatttactggcccgtcgtttacaacccttgactgggaaaccctggggtcccaaagtaattcgcctgccaatatcccttttggagattgtttatcgagggccgttcgtacgccttcc

SEQ ID NO: 573471 - DNA, 238 bp, Homo sapiens
aaaaaaaaaaaccttttaaaaaccccccccttaaacccaccccttttttgtttttggcccaggggtttttccattttttttggggttttttttttgaggtttaaaaattttttccccccttaagcccccccctttttgccccccccttttttaaggtttggggttggggggggggccgggttttttttttttttttttaggggggggggccccaagggaattaaccccgggcctttga

SEQ ID NO: 573472 - DNA, 1584 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaaaaaaaaaaaaaaaaaccttgtggcccccttggcccaagcgaatttaaaattaaacaaacttaatcaaggcgcccaaattcgagcctaattggccaaatccccctaaaaggaacgcaattaaaaataaatggcccgtgtttaaaaaacgttgaaacggaaaaaccctggggttacccaacttaaaccccttgagaaaaaacccccttttcccaagtgggcaaaaaccaaaaaagccccaaccaaatcgcctttcaaaaaattggccaaacctaatgggaaaaggaaaattgaaccttaaaaatttggaaaaaaccgcggaaaaatttgga

SEQ ID NO: 573473 - DNA, 1301 bp, Homo sapiens
  misc_feature (52)..(52): n is a, c, g, or t
  misc_feature (71)..(71): n is a, c, g, or t
  misc_feature (85)..(85): n is a, c, g, or t
  misc_feature (113)..(113): n is a, c, g, or t
atctctaatgctatacagccacctccaatatctataaatcagatcaccccanaactaagatgctgaaaccntgtgaaaacccacncatgccgagtgaaagatgagtccgctanctgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctgtgagattggagagaatctactagagtggtacagcactgtgatattacagagatgtgttgctatcctgaacattctgtatgatctgtggaagtgctactgcgatctattattccacttccgttgacgagacataggtagacgtgagctaacttaattaaccattgctgctctgctctacagtacgtgaccctgagactggataatttgccacagcctcct

SEQ ID NO: 573474 - DNA, 254 bp, Homo sapiens
cctggtgctgccgcccaggcatctcctctcctcactctgggaaggaggtggtcttctggcaaagaagatatctgagttcttccatcagaggagatccttattcatgcaagacattcactctgtagaagccacggtccctgtcatttgtgctgagagtctttttctcactgagtcttttcaaacggcccatggaaacgggaaatccagatggcccatttgacaaacgaaggaaacgggccgactttagacattgt

SEQ ID NO: 573475 - DNA, 1202 bp, Homo sapiens
  misc_feature (1036)..(1036): n is a, c, g, or t
ggtttctttgcaggacatcagcgatggcgtgcttgggtaccactgaacagagtgatccttggtagacactgggaggtgtcttctacaggtctctcatcgtcttggtcagctgatgatctgggcgttcagcgtccagtgtgctcgtccgatagcaccaccagatatcacaattgttaggaccgaaactaaccgttctcgccatgaaattatcctctctgccaagatatcacttgacgccaggccaaaggatgccccagcacatcaccgacggggtggcatgtatcgtgccaatgtctgtggatggatcccagcatgaagccaagcgggcccactactgtcctaaccgtattggttcgagcgcacactcgaagagaagaccttgccggggggcaccgctcccatcactatgtacgcggacaagacccagccacccgaggggctgggcgtgaacacgctgggcggacagaagggcctctgcgggctttgagattctgcgccgaattattccgttccgtgcccctcaagtggcaagaccatgcattgcgcatgggttgaccacgcgatgccgtcatgagaatcaagtccaattgactacccctactcagactctaacaactaggagcacccaaccgtaggtacgcacagtggacacacacggggagagggcacacctcgcgggccgccacaccccctcggggggcccgacccgagaatagcgctcatccctactggtacagccacggcaggggcccatccaatccgacgcgctcgagcgcgccaacggccaggctcgaacgcacaacgaagcgcaggcaccaatcccaccaccaagcggctcgtgtgcccaactccgcgtgggctatggctcgccgccacattgacattaccgaccagcgggggatccgctaaccgtacgccacccgtcagtcgtatccacgagaacaccacgggcgctgtcgaaccacgcgacaactaacgcccaaagcggcgcgtcctaggagagattcccctcctcaccccgggtccacctcaccgnacccaaggtcgactccaggactcggcagcggaccccagcgcacacgcatgggctagcccgcacacacgatcgcacccaccacggcacgttcggcagcacaccgcactcgcgccccctccgcgcacagcaacctgccccttacaagacacggccatgcccacgaagc

SEQ ID NO: 573476 - DNA, 676 bp, Homo sapiens
  misc_feature (106)..(106): n is a, c, g, or t
  misc_feature (124)..(124): n is a, c, g, or t
  misc_feature (175)..(175): n is a, c, g, or t
aggtgactctagagatccccagtgggtcctgcttacatggaaaccctgggcctgattgtgcaggcggtggccttaggcggggtgtaggcgccgtagatatgcaatngggcgcctggcagttgtnggcggatcagtggccacaggcggtgcttcatccacagcaccgcatcccaantgggcgcgtggcggaagttaccgatgctgaggaaatgcgcacggtcgtcaaagggcgcaaatgcgtcggtgggcggttgcagcatcaaggggcaccagtggagcagggcggcaggcaccttgaactgttcggtgagcagacggatttccacgtcggagatcatcaagctgatgtcacagcggtaaatggcggcgatttcgcgtttggccaggtcggtgtcggccatgcgttggaactcgtcttccagcgccggcgcgaacagggcgctgaagtcgtcgctgtcgggttgggctttcacctgctctttgagccgctggtgacgggcgtcgcgcaggctttgcaggtcggaggtttccagcacgcgcagggcgtcggggcagcattgttctacgcgccagccgaattgctcctccatcatgaaacggtcgaacagcacgatatccggggccagttcgcgaataaagtcgtcgaaactgctgttttcagttcgatggtgcgtcg

SEQ ID NO: 573477 - DNA, 615 bp, Homo sapiens
  misc_feature (431)..(431): n is a, c, g, or t
gcacacctggaagggactgcctatggtccctagcaggtgcaggccaaggaccggggctccccatccttcagtcacctacatgcgcttacgtcaagacttgacatcactagatgcttgagaccctactcccgtgagcccgcatgagctgctcttcctagatacatgaccataggacaagcccccatgaatggccagtggagtgttgctgtgcctggcaccattggccacctgtcgtaggccgatcacttgtccgtcagtctccgaccgccacacttctgtgcgcaacaacgaaggtctaagcaatggtccttgccagatgcggcgaggtgctccgacaaggcggcccatgccctgcggccccagtaccatccagcatttgagtggctcaatgtccaagaagcaccaagagccgcgtaccaatgttcatgctncacagacgaaacctctccaatgcagaactggtaacagacaagcagcccaagaaagctctctagctcccgaagagctccgagctctcacctccagcaatccaagcgtggcagcccaagcactggctgcatgcccaagtggaccgtgcctactggtctctgtgctctctcacttccgcagagcgcc

SEQ ID NO: 573478 - DNA, 830 bp, Homo sapiens
  misc_feature (489)..(489): n is a, c, g, or t
  misc_feature (492)..(492): n is a, c, g, or t
  misc_feature (499)..(499): n is a, c, g, or t
  misc_feature (679)..(679): n is a, c, g, or t
  misc_feature (742)..(742): n is a, c, g, or t
  misc_feature (745)..(745): n is a, c, g, or t
ccgagcggcgctgtgaactgcttcctgcagagccgtggccatggcgcttcacgttcccaaggctccgggctttgcccagatgctcaacggcagggagcgaaacacttatcagcgattagaacaggctgtgtatagaaacatacaagcttgctaactgagcttgaccataccactctgtacagcgatatggaccacattggcacagtgaacatagaactggttatctacaccatcttgcagaagtagctttgtgatcaacaacgatgcctcatacctagttctaatcagatctagaagtacagcattcctgctgctcaaagtgagtcgtaaaggccttctcagtactgcagagagcaagaagtcggagatggcactaaacttatgttctgggtatttgctcggcagctctcctggacttagctgcaagaacttctgaggattggcctgtcagtttcagaggtcatagaaggttatgaaatagcctgcagnaangctcatnagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgatnacatcagagtttgtaaaattctgggctctggtatcagttcctcttcagtattgcatggcatgnttnttaagaacggtacacagacggtgtacgtaatatcatgtctgatgagccggtgataacggtgtcctcgtgacatcttatcgccgca

SEQ ID NO: 573479 - DNA, 424 bp, Homo sapiens
caacttcccaaaccaggacctgtcttccagtttgggcagggtatgcctggggttggaatcatgcctacggtgggtcagcttagagcacagttccaaggagtactggccaaaaacccacagctgcggcatttaagtcctcagcagcagcagcagttacaggcactcttcatgcagcggcagttgcagcagagtcaggcagtaggccagaccccaccttaccaggagcttgggacccagacctttcccttccagggcttcttgggttgccaacctcaacttgggggcttccctggaccacagacaggccccctccaggagttaggggcagggcttcgacttcagggcccaccccggctccttgccccaccaggagccttatttacaggaccagtccttggccctgtggcccccacctccaccctca

SEQ ID NO: 573480 - DNA, 339 bp, Homo sapiens
gagaaccgcacacgcgtttggcacactgaagagtgctacctctatgtgccttctgtatctctttagctcgggttatacccgcggagtgtattgacgcgatgcacacagcagtgtgggcgctcatcggagtacagatttcggagaggactatttcatagcctcgcgcgggatggcctttgctcagcatcttcaactctggccattggaagatgatgcctaagtagagagtgaagtaactgaatttgcatacacgtgcgatgctgatgagctgggtggcactctttgagagacctatcgtgagctggcctgctgccgtgcagcaggagaccttgcgattgg

SEQ ID NO: 573481 - DNA, 178 bp, Homo sapiens
agaagggttagaacccgggaggtggaggtgcagtgagccgagatagcaccactgcactccagcctggcaacagagcgacactccgggtcaaaaaaaaaaaaggtacctggtaataaacttacctctaaaaatggtaaccttccctcctaaggggtaaaaaaaaaggccaattaacaaa

SEQ ID NO: 573482 - DNA, 205 bp, Homo sapiens
tgtgctgtcacatgacccactgttatcgttactttgacgttttcagcgcacacccttcctctggtttggtatatttattgatggatcaataataatgaggaaagcatgatatgtatatgctgagttgaaagcacttatggaaaatattaaaaggctaacagttaaaagactaacacgaaagaaaaaaaaaacaaaaagagaacga

SEQ ID NO: 573483 - DNA, 630 bp, Homo sapiens
ggaactttgtgactaatgagcaacttgtgaagatggtgtactttgggctggagatgatatcttcaagtagaatggcactggcttgacatatgcctgatatgacgagcaatgcaatgcctgactacgaactccgacctaagtgcacgtgacactatacagttatgccacattcgaataggaggactggtgcgacatgctcactattgaactgcgctagaagccatgagaaggactgggagttactatagcaggttaactacactatactggagtatccgtgtcatacgttgtcatacgaagaattgcccatgccgatggaagactgatgcagggagaccctatatgaatggtgaatgctgaagacgcacgtgatgccactgctggctgaatcaactctggttcattgcatacagataggatgctatctgactgcaagcaggtattgaatgccatatggcgctttgacttgtgcagacggtggatccagggcatctgagtcactggacagtagctacaatgacaatgcattggcatctgacctgcggaatgaccaacatgcgagatggaatgggacctactgactgactgggaatagcatcgctggacgagtgacagcccacttggtgtgtg

SEQ ID NO: 573484 - DNA, 670 bp, Homo sapiens
gacctcagttcctgtttggaaaatgagataataaccctgacataggaaggtcattgagatgatttgagagagattacccagtataagatatttgttataaaggcctgtaaatgctttataagtagctgctgttattatccttatgaggtattttctttttgaagaaaaaaagataatgtttgtaaaactggattccaatcataggaaaggatttggcccaggcgctgcagctcatgcttgtaatccccaccactttgggaggcccaggtgggaggatcacttgagccccaggagttcaagacccagcctgggtaaccaaagtgaggcccccacctctcaccacaaaaaatttttaaattatccagcgccccggctgggcaccaatggcgttaccaccctgtaattcccacccactttgggatgaggccaggtatccactagaggtccagagttcaagacccagcctggcccgcccatgttggtgaaacatcccatctcttatttaaaatacccaaaattagcccggccatggtggtggatgcctgtaattccagctacttgggaggctgacaccggagaattgcttgaaccccggaggcggaggtttcagtgaggccagatcacacccctgcactcccccctgagccatagagtgagactccaatttcca

SEQ ID NO: 573485 - DNA, 894 bp, Homo sapiens
  misc_feature (880)..(880): n is a, c, g, or t
gtagaagcagagtggttaccaacatcaagaagacactcaaagccaccgatcctcctcggtcaggagatggacgcagcagttggtgaacgggatgtccccctcacgctgaagcagaggcagcccaccaagaatgatgtccaaagtgaaaggtctggtcctccagccgccactagggccggctggggcagttggcactcaccaggcctgggtcaggtgggggaggggacaccaagggcccatttcctcccctctctacctgcagttgagttccagacctgcccgtaccctcacccagagcctcccaaacctgttgtactgtcccagaaaaactgttactccccctcaaccaaattcccttccttcccaagtttgtcccttcagatcaggggctcaaccaatgccaatcccaaaaacaaggttcagaacactgcccagcttccctccaggaaggttcttgtctctggtgtaaagggctgtctccctcccagtatctttgccccacgtcatttgtccaggctggtaataaaccgaacggcaggtttaaacaagcccccaggaatgatcggtaagggaggcccctcaccttgtgaggagggggaactcttctcaagccctgttaccaagcctagatgtgcaggattctagccaggtcagatggcggtcctcactgctaatcctgtgaagcaagtaagcaggagactgaagcgctggtataaccaggttcacctaagcggccggccaaaaggaagggcgaaaaccgttcaaccaaggtgggtcagaggaagagctcgcggtacgccatggcgaaaactatgtgaccccaacaggggcgaatccgggggggccgctctcgccctccacctttcacatatacactcgnaaaaacgagaagaa

SEQ ID NO: 573486 - DNA, 765 bp, Homo sapiens
gcggttggccgggaggattgtctacgggggggtgcccctaactggtcggggcgccccgctgtggtgcccccccctttgccggcgggagtcctggttggccccccccctgtggccaatgaagtggcacccgagggcttccacgtcgtgaaaggccgcggccctcaatggctgtatggttgcagaccctttgtccaagggccttcgcgttttcgcggcctcccctcattctgtgggataggcgcgcctgccggggggcaagaacccgccgggcagtggcgcgcgtcggcaagcgagaaggggcaagaaaaagcaagacgcaacaactacaagaaggcggctggcagcaaacacccggcaagatcggcgcaaaacgaggggcgcctccaataagcggcgcgcgcgcgaggtgcccgaagcgccgattccaggaagacacaccagaagcatacagactcaccagaagagccacacatcgatcacataccctgtgtactacggagggtaaccttgattcaccgtggcgcacactgcattcttgggcaccgttcccgcccccggttatctccgtcgccctccaccggcggtgactacgtccgtggctgttggccacacacgctccctcccggcagtgcccggcggggaccccgctgtcactacgctacatcacctggtcctaatagtaaagcaccctttgacgattcgcgcccctgggtgccctttccttttgcccccggggccccccccgacccctcgcccaacataaca

SEQ ID NO: 573487 - DNA, 186 bp, Homo sapiens
  misc_feature (23)..(23): n is a, c, g, or t
  misc_feature (94)..(94): n is a, c, g, or t
  misc_feature (176)..(176): n is a, c, g, or t
gcctttaacatcctctgccaatnactggcctcaaatcaccagtggaaccttttcaaaaaatacaccattggctctatgtagttctactgatctnaaatatccacgtgtgggccaggagcactggctcatgcctgtaatcccagcatcttgggagagcgaggaaggaggatcatttnagcccaggag

SEQ ID NO: 573488 - DNA, 205 bp, Homo sapiens
cagtaacagaaagataactggaaatcccccaaatagttagtgattaaacaacatacttgtaaataacacatgggttaaagaagaaatctcaagagaaaactgaaaatattttgaagtaaaagaaaatgaaaaccttaccaaatttgtagaatgcagcaaaagcagtgcttagagggaaatttatagcattgaatgtatgtattag

SEQ ID NO: 573489 - DNA, 181 bp, Homo sapiens
agaggatccccgacggtcgttttgtcggtcgccagcgtatcgacagcgacggctgcgtgcgcgtccgctggtggtgggtaacatgctttatgtgtatggcaacggcggcaagctggaacccctgaccatcaagtaaaggtttgactatgcttggggtaacccccaggttaacagaccgtcg

SEQ ID NO: 573490 - DNA, 262 bp, Homo sapiens
tcacaggtgtgagcgacgcagcaagacggcgatgattgctgcatatccatcgtgaggaacgcatttcctcaccagcaacggaacaaatctggatggagaatgattatgacgagctgagagaagaaggcttcagacgatcaaattactctgagctacgggaggacattcacactcaaaggcaaagaagttgaaaactttgaaagaaatttagaagaatgtataaatagaataaccaatacagagaagtccttaatggacaaga

SEQ ID NO: 573491 - DNA, 821 bp, Homo sapiens
gcatcagttgctctcaagctcggggtctgttgggtggggtgacatcgcgggtccaacatgcgtatcgaaaagggttatgtctgtgcgggggccatctatcctggacacggcatgatgttcgtgcgcaagtgatgggacgggggtcatgatttaggaaactctatgatgtaatagaaatattttaataagagaagcgactagtccttcgagcataaagtgtaaggtggacgggaaacgtcaattaccgggaaagcgggtggtacaggagcttgcagtggataatgcatttgaattggaaaaatcgtataaatgaacctgatcaaatacacagcgatggaaggtatggaaattaagagggtattgatgcgatgatagaggagattgtaagagagaatcaacacaggaaagcgagggagcgtatagtatgtataatagagtaggattgacggatctatgaaggagctgacaggaaatgttcaggtatatcaaagaagtcgagcgaagagatgattgatcttatccggagtcccatctagctagggaaagggtgaaaagagtgtagggaatgagatagatggtacagtggttacagaggaggatgtggaccatggatagatgctccctgtaaataatcgtctgggaatgcattggcgttgagaggtacgatttgaaaaatggcactatgtggatacttggaaactggctaaattatttgagggtaaagggtaaaggtgcaggttacatgaaaagcgagtttatcagacatgtttgcctggattgccgaggctacggtaattatcagatatgacggatgtttagag

SEQ ID NO: 573492 - DNA, 354 bp, Homo sapiens
  misc_feature (18)..(18): n is a, c, g, or t
  misc_feature (21)..(21): n is a, c, g, or t
  misc_feature (60)..(60): n is a, c, g, or t
  misc_feature (110)..(110): n is a, c, g, or t
  misc_feature (112)..(113): n is a, c, g, or t
  misc_feature (137)..(137): n is a, c, g, or t
  misc_feature (192)..(193): n is a, c, g, or t
  misc_feature (224)..(224): n is a, c, g, or t
  misc_feature (226)..(226): n is a, c, g, or t
cgcgggggtaccgccccnatnacaattcattcatccatccatccatccatccattcatcnatccatccatctattcatccatccatcatccattcattccagaagcattngnngagtgagcacatccatctatccangcatccatccacccacccattacccatccaattatccatccattccagaagcatnngccgatcgagcgcatccatccatccatccancnatccatccatccatcatccattcattccagaagcatgggctgagtgagcacatccatctatccatgcatccatccacccatccattacccatccaattatccatccattccagaagcatgtgccgatc

SEQ ID NO: 573493 - DNA, 266 bp, Homo sapiens
aacgcgaggaaaggaatggccagccacaccttcgcgataactgtgttggcccaacatgttctatgaggacaggacagacagacagtccaaggctgaactgtttttcctccatcacagctatcctgtccctcattgacctctgtggtttccactatacacagtcaccgtcccaatgacatgatgaatgaaggaacaacctctaaatgactcgcactgcaagtgaacagcgatgttcagtcctgcattgatcacctggtcttcctcat

SEQ ID NO: 573494 - DNA, 157 bp, Homo sapiens
cgacggtctgtaccaatttattatatataccaaacagtaacatatgtagaatatgggaatcgtcttccgcggtgccgacgtcgagcgctagttgtgaacattccaagccaatgtactacaacttgggcaggggaaggctaaacaagtatcatcaacc

SEQ ID NO: 573495 - DNA, 284 bp, Homo sapiens
  misc_feature (264)..(264): n is a, c, g, or t
tttaggccatttcattaaaaaaatgaaattatgctttaggtaagctttacccttcatcctcttcccctgattgtaattcactgattcatgatggatgagcgttatggtgtggccgcctgactgtaagatggcctggtgagccagagaaatcagctaggtgactctcagatttcagacgcacagaaactgtgagataataaatgcttattgctttaaatgctaaatttttggggttattgattatgcagcaatagataaggtagntgaagtgtgcaatgggaatg

SEQ ID NO: 573496 - DNA, 295 bp, Homo sapiens
  misc_feature (18)..(18): n is a, c, g, or t
  misc_feature (21)..(21): n is a, c, g, or t
  misc_feature (60)..(60): n is a, c, g, or t
  misc_feature (110)..(110): n is a, c, g, or t
  misc_feature (112)..(113): n is a, c, g, or t
  misc_feature (137)..(137): n is a, c, g, or t
  misc_feature (192)..(193): n is a, c, g, or t
  misc_feature (224)..(224): n is a, c, g, or t
  misc_feature (226)..(226): n is a, c, g, or t
cgcgggggtaccgccccnatnacaattcattcatccatccatccatccatccattcatcnatccatccatctattcatccatccatcatccattcattccagaagcattngnngagtgagcacatccatctatccangcatccatccacccacccattacccatccaattatccatccattccagaagcatnngccgatcgagcgcatccatccatccatccancnatccattccagaatcatttaccaagcaaacacatccatctatccatccatccaccgtgcttatctcaat

SEQ ID NO: 573497 - DNA, 186 bp, Homo sapiens
tcgaggatcccttcttgtgctggtgtctgattgttagtctaaatatttccttaaactgtgtggactgtgatgccaccacagaagttggtctttactggagaggtaataggtcactcctggggcctcttgggtcccccatcgtaacagtccctgggaatgtattattctgcagcaaagaaccacacg

SEQ ID NO: 573498 - DNA, 191 bp, Homo sapiens
aaattcactgggaagaaaccggtaaaatgaagcactgaggaaatgacaagtggttccgtgggggtacccaacacccagcccatcataggagtatgcagagaaccacacctgattgaacttgccacagttaacaattctgcaagaagagaaattaggcgctgtttatttctctaaaggtgtctggatgaaac

SEQ ID NO: 573499 - DNA, 255 bp, Homo sapiens
  misc_feature (79)..(79): n is a, c, g, or t
  misc_feature (92)..(92): n is a, c, g, or t
  misc_feature (127)..(127): n is a, c, g, or t
  misc_feature (216)..(216): n is a, c, g, or t
cattccaccagttggcaacagcagggtgttttttcattttcagcaaatgctcaacattttctctcaaccaagcaccaanaacatcccagggnctctcaacatcatgccattcacccatgcacaaacngttcaacagcaaaggccagtccttcaaccactctcaactcactcattcacaccagccttgtgcccaaccactatgccgtggcctcactncccctttccagacaccaaggtcagcaagccgcagggggc

SEQ ID NO: 573500 - DNA, 416 bp, Homo sapiens
tggcggtgtgtctattcctatcaagaactgctattccatttgtagtcccgcagggctgccagcatcagtctcacttgccagctatgttcagggccttcccaccaggaaatctttcccatagccagtttctgtctctcttactgagaaacagaacagttcttcctagcattttgtgccttggaattgccatccataaaccaagaagctcttgtttggtcagttgaaagttgtttatttggcactgtagaatccagcagtttctcacacagttccagagtcagtcctaggggaaaagaaattctctgcatgccttgagtagcatgatcctctataaaccatttccattgtgtcatggaactcttctgggcactgccatccccattagaatgttcctctgacatcatctgagacagcat

SEQ ID NO: 573501 - DNA, 277 bp, Homo sapiens
ttttcctttccctttcccccaagggggtcctaaaggttccttccccaggggggttttttttgatttttggggggggcaagcctttttgataaaccggttagcccccggccttttccagggttttttttccaatgggaaaattagggggggaaaggggggggggggctgttaaattgtaagctcccgggggcagagtttttgttccctttttgccccctgttattttttcattgtggggcccccgggggcggcccaataatttttgaatggcccccca

SEQ ID NO: 573502 - DNA, 1013 bp, Homo sapiens
ggcggggtctgggcagcggcggccgtggtggagggctatgctggcgggggatgacggggcaggcccctcctcctttgtccgccctgccctcccattggtcctagctggggtgtgccgtgggtgcgtgacaccgggctgcggtggccgtgagcatctgctggctcagtgctgcgtggaaagcggtgcgctgtgccagctggtggtgggtgcccttggtcctggcgggcggagctctgaattgcatgcccaacgccctgtggctgctgtacggggtgcccaatgtgacctgggcccttgaagtggcatgcagctgttgtgatggccacttatcccttggcacggcacacacgtggaacccgtggtggttcaacccctgggaaaggattaggcctttgtggtgtgcggctaggccttgtggccatggggccgcgaaaatgggaaacccctgtgcgggtcgtttggctggcacgcaacatgcgcccgggtggttcaattacattatggggccatatgggcaaagggtggaaaggccactgggtaccgaaccattacacttttgagctgttaaacactggcgcacctgagggtgacatttactttaaggacttgataggatgtacccggggcgcgctttaaaacgctggcgcgaaagacgcccgagttacactatacacgttggggccgtttggtgtaagcacgaaagaaattatcctttaccgatgttacccggggggaacatttctcgtggggcgttagcgtattaaagcccccctccagtccgggtgaccaaaactttttaatgttttggggcccgccgttttacggaaatagttttatcccaagagaatacgggggcgcatttaaagttttaccgtgtggacatgtgagcagtgtgccgcgccgcaccaagagaaggcgccccgacacagactggtgctgacacagcgtgtgaaaacctcgtggacacccacagccctgtatggggatctgtattgggtcgacatttccagaag

SEQ ID NO: 573503 - DNA, 330 bp, Homo sapiens
agtctgaggatccccttccccacatgaggtactttggaatatttagatgaagggaactcttggaataatccagcctttattttaaaaagtttatttccagttgctgcttaatgtatgtccagtggatgtgaaagtgtggaatggttggatacatgtcgcaggtagagtcctatgttttcatggtttggtaaagggatttcccagtgtattgctggttcattggcacatttatttccttgatgtcacttcactgttttggtttttggggttggttttggagacagagtctcactctgttgtccaggctggagtacagtggcaggatctcgg

SEQ ID NO: 573504 - DNA, 419 bp, Homo sapiens
actcatagtgcagtgccccataacagagttatcaaatcttccctccaatcctctgtgacgttgatatttatttcacttatccatatgctataatcaaccaatacattgttgctattgttactttaaacagttatctttgggctgggcatggtgctcatgcctgtaatcccagcactttgggatgccgaggcgggcggaccatctgaggtcaggagtttgagaccagcctgaccaacatggagaaaccccgtctctactaaaaatacaaaattagctgggcgtggtggtggcaacctgtaatctcagctatttgggaggctgaggcaggagaattgcttgaacctggtagatggaagttgcagtgagcagatattgcgtatcgcattccaggctgggcaacaagagcaaaactctgtctc

SEQ ID NO: 573505 - DNA, 128 bp, Homo sapiens
gcttgtggggaacttggtctgttcagcccaagaggaatcgaacagatcaaaagcagtttgggaaggccagtaaccgatcagggatggagggagaagtgacaatccaggggtcgggggctgtttggcat

SEQ ID NO: 573506 - DNA, 384 bp, Homo sapiens
tggacgatcgtgagctcctctgatggacacaagtattgatttcaatacccaacatgcacgattggctccgcaatccttgttcaacaacagggtttccaaccaggtctctcagccaacttcagttcagcagattccaatccctatttatgcaccactgcaagggcagcatcaagcccaactgagttggggggctggcccctgctgtttcccaggctcaggaatggttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaa

SEQ ID NO: 573507 - DNA, 687 bp, Homo sapiens
ggtcaagaccgtgggaaccttcagagatgaatttggatcccttccaggagttgtatttgggaaccagtagtgtggacgaattgcgagagaagcttagtgaatccgtgggattcccttggatgatattgaatttgctaagggtagaggaaccgttccccgtgatatttctgtccctgatattcatccagatttagactggaatcctaaagtttctaccctgaatgtctggcctctttatatctgtgatgatggtccggtcatattttatagggattaacccgaagaattaatggaattgaccgatgagccaagaaatgaactgatgaaaaaagaaacccgtcgactcccgaagacctggacactcgtgtaacatactcccctcgtaaagagaaagcccttaaaatatatctggatggaccccccaataaagatctgactcacagactgactctgatagtgtacccttttcccctcgggggaattttggttttaattagatggttcacctacccctgggtagtgcccttttggcccggacctggttggggtaaccccagtgacccccgccctgattggactgccctacccccatccagaagctccagtgccccatgggcccctgttttgactcggaatcatgttgtgccctatagtccaatgtactgtaaagtgaaaagggatgtgcca

SEQ ID NO: 573508 - DNA, 181 bp, Homo sapiens
tggttcgaggttaacgtacaaatccttaatccatcttgaatggattcagtaggagggggtaaggaagggatccagtttcagctttctgcatatggctagccagttttcccagcaccatttattaaatagggaatcctttccccatggctagtattactcaggtttgtcaaagatcagatag

SEQ ID NO: 573509 - DNA, 285 bp, Homo sapiens
  misc_feature (214)..(214): n is a, c, g, or t
  misc_feature (231)..(231): n is a, c, g, or t
tgttctggtcacacttaaaaatatcaagcctctgaaagaacaaacagtttttggagtaacttaactttgccccagaataaggcttaaaaatatttaaagaaatacaaataaacaaacaaaaagaaccagcacccaaaaatgtaaagttcatgtctagtaacaatcaaaaatcatctagcagacaaagaagcaggaaaacatacccccacccccngcagaaaagtcactttntcagaaacagactcagacatgagagatgacagacttagtacacagcgatcttta

SEQ ID NO: 573510 - DNA, 457 bp, Homo sapiens
  misc_feature (1)..(1): n is a, c, g, or t
ntgtgaccacacacacattacatgtgtatacacaccaccacttatacataccacatccacacatacacgcacatgtgcatgcatgcatatacactcttcgtgtgcgcgcacacacacacagattcagtatagaaaagaggaaggcaaaggctaaatatacagtgtgagaaaagagggcaggtgatggacacgagttatgaaagggatcataatcatttttagttctaactgtgtcatggatttttaatttttggtgatagataagtacataaaattatattcatcaattacagtgtaaaatccagtgtgaagctctacagcttcagaataggtaagtctaaatgcataggagtgtgttgaggtgtctagacttcgggtcggcttcatttttggtgtgatttttttttttaaataaatattaaagctataaaaatactccagctgtaaagaaaaaaaa

SEQ ID NO: 573511 - DNA, 134 bp, Homo sapiens
atggaatcggttccaaagagcggtttactgctgtgaagggatcgcagctttgaatttcaacgctctggttctcagtcctcgggcacctgtgcgtgaatcgctgccgcaaggctgggccaagttaaggccccacg

SEQ ID NO: 573512 - DNA, 374 bp, Homo sapiens
ctggtcgatcttgaggatcccccttatgttctgacccaccacaactctttctgttcccgtatgcttcagtcttgctggttgtcatcccagttttctggagcccctcaactctaatcataccttggtctttgcacagtgcttctatctggaacactcttcagcccagatattggcatgggctcctcctccacctccttcaggtctttgctcaaaagtcagaagagcctgggtgcggtggctcacagattctttcccctgggagtctggaagttgctgatttaatgcggatgcctgcttcaatccttgccctctggagtctgttctccaccaggcagccagaggcagcttctgaaccaaagtcacatcatgttgtt

SEQ ID NO: 573513 - DNA, 826 bp, Homo sapiens
ggctcagtctagcgtccgtgtgtctctgtgagcatcttagacagagtgctcatgatagttagggatatagtgcatcggactggcagcctgaattggtggagaccgcagtcagtaacttgagtgatatatggaatattaagaggacagtaacccatggccctacgccccgtacctgatcacatcgtgccctgctgggctttaccccaaacagcccacctatccatctaggcctggccatggccctgtgccatgccacatagaggattaagtcaggatatcttgagccctctcaaatcccatgttatattcaggcctctgcccaatatagagccagacttctgtccccaacacttccactaccatggagcccagattagtaaaacgctctctgggcccagcgttcgccagaaaagacaccaggggagcaaggctcaaaccaggggcagctaaatctgatcttgtggaccagtctctagtacgggctttcagcgtggctgtctgttcattgctttccacacataggatgcagcaatgatggtacatgggtatcacgatcggcgtaggggctagtccaagtctagcactagccacaactggaagagcctcttgaagtactgagagatcccagagggatagtcagcatccaggcagaacatcctgattatcaactttctgagtccaaacactagacccagagggtgccagaacgcacagcgtagagggaaaaccccaaagtgtggacgaacacaacacacagaaaggggacggagcacgaaggatggcgaagcggccccggaggcacaactggcccgtctcgagcaacaga

SEQ ID NO: 573514 - DNA, 123 bp, Homo sapiens
tacctgtcggtcatctgcaggcgtctgtacaaagtgccctaggcatgcatcacgccggtcacgcaggagcggtctaccattaagtctggataggttgtgatcgtttggcccagactcaatcat

SEQ ID NO: 573515 - DNA, 169 bp, Homo sapiens
ggggataaagaaaactcaatgaattgagaaagtataatttgctcaggagaagtgcattacatgatttctctgagaaagaccaaaaacattccttatgaatagagcccaaagactttgattaaaattgactagaatgagtccactatacttctatttaaaaatgagaagg

SEQ ID NO: 573516 - DNA, 862 bp, Homo sapiens
  misc_feature (27)..(27): n is a, c, g, or t
  misc_feature (90)..(90): n is a, c, g, or t
  misc_feature (259)..(259): n is a, c, g, or t
  misc_feature (272)..(273): n is a, c, g, or t
  misc_feature (285)..(285): n is a, c, g, or t
  misc_feature (289)..(289): n is a, c, g, or t
  misc_feature (317)..(317): n is a, c, g, or t
  misc_feature (375)..(375): n is a, c, g, or t
  misc_feature (389)..(389): n is a, c, g, or t
  misc_feature (409)..(409): n is a, c, g, or t
  misc_feature (413)..(413): n is a, c, g, or t
  misc_feature (430)..(430): n is a, c, g, or t
  misc_feature (448)..(448): n is a, c, g, or t
  misc_feature (470)..(470): n is a, c, g, or t
  misc_feature (476)..(476): n is a, c, g, or t
  misc_feature (503)..(503): n is a, c, g, or t
  misc_feature (507)..(507): n is a, c, g, or t
  misc_feature (584)..(584): n is a, c, g, or t
  misc_feature (591)..(591): n is a, c, g, or t
  misc_feature (606)..(606): n is a, c, g, or t
  misc_feature (642)..(642): n is a, c, g, or t
  misc_feature (660)..(660): n is a, c, g, or t
  misc_feature (667)..(667): n is a, c, g, or t
  misc_feature (742)..(742): n is a, c, g, or t
tatttgtattcgaatcagcaattatantccctgtgattatttgaagagtgtgtagaaagacgtttttccagttcaaaatgccttatacantcgagaggaaaaaaattacacaatttcaggcaggctacgttttcctttgtttcatctgcttcctctctcaccaccccatctccctctcttccccagcaagatgtcaattaagcagtgtgaattctgactgcaataggcaccagtgcccaacacatacagccccaccatnatccccttctcannttataaacctcnaagnggattcactttctgatagttaacccccntaaatgtgcacgtacctgtgtcttatctatattttaacctgggagactgttgtcctgncatggagatgaccntgatgctggggttacctcancatnccccaccctttcaaagntgacatatggccatcccnttgcccagaatccccagacacncctaancctgtggcactgggacagaatagattntccntttgagaggcacttcctgtgtcaatcttgtttgaaggaggtggtgatggtggatagaggtgaaggaggtagggagtnccctccnagtgccaaaattacnaatatgattattgaccatcggggaattctcacacantgatttgttttttaagcnattgccngaaacccccttttttagcttttgcttggggtgggggtaggagttaaggtttattcaatcctgtcctgggtagggngaaagttaatctagcccatgtgatttttcagaaaagtaagtggaacatgctgccccttttcaatttctgtcagtgcttccacatggaaacaaaatgcaataaaatttttccaaaccctta

SEQ ID NO: 573517 - DNA, 363 bp, Homo sapiens
ctctagtagcgggacggagccttgcggccctcgagcatgtacgatacccctcaggaggtgaccgaagctagactgtcttacctgacagagaccatatagtgaggcgatgctgacgatgggcacgggctagaggaacaacagaagcggatcgtactggaccctacaggctccatgaacatttacctgatgctagatggatcagacagcatggcgtccagcaacattacacgagccagaatgggactaggcaactgaattgagaaggtggaatactgctatgcctgaactcgtcagaatggaatctcgctgatgctacaggactagctccctgatcattctagtcactatgaaccagggccatcg

SEQ ID NO: 573518 - DNA, 260 bp, Homo sapiens
  misc_feature (16)..(16): n is a, c, g, or t
  misc_feature (140)..(140): n is a, c, g, or t
tcaagttgtgactctncatgccctgatgtagagttttgttgaaacgtcccagcgaaaaaaagacgcggcgccccttttttagcttttgcttggggtgggggtaggagttaaggtttattcaatcctgtcctgggtagggngaaagttaatctagcccatgtgatttttcagaaaagtaagtggaacatgctgccccttttcaatttctgtcagtgcttccacatggaaacaaaatgcaataaaatttttccaaaccctta

SEQ ID NO: 573519 - DNA, 254 bp, Homo sapiens
ctccagacgatactactattatacccagtagtatctctggaggcgtaacacgttgtacgtcttggtactatatctgtaacatggcaccaaggtatatgcaagctgacagcgccgaagaggcttcattgtgcatattcctacaccgtatataagggtcactttatcagagtttgtacagaaaacatcttgtactgcgtttataataactattcatccatatcccaatgtacagtacacgtatatcacagcacaaa

SEQ ID NO: 573520 - DNA, 175 bp, Homo sapiens
agctcggtacccataaaaagatatcctgaagattactccatatcagtatatagagagcatttattaaaccacatagagtgtccttgttggtagacattcaggatgttttttaactcttaccatcacaaacaaagctgcagtgaatgactctggtctgtgtgtccttttgtacatg

SEQ ID NO: 573521 - DNA, 132 bp, Homo sapiens
agtgcactaggctcatgagtagccggcaccacaggcatgtgctaccagcccagctaattttcttttaatatttttttggtagaaatggggactcaccatgttgcccaggctggtctcagagctccgtgggcc

SEQ ID NO: 573522 - DNA, 621 bp, Homo sapiens
ggtggaagagggtgtattggacatgaaccgctatgagaacctataacgaagtgcattgatccggtcatttctccatgtggggctgaagcagtcggatatttacctacagattggaaaggggtaggccgatgctgatttcagtgcagttgttgcgcgcgttggctgcatgggtggtggtgggtcaccatgtcatgcagctgtttttcaacttcgaggcccacaacgccttcgaggacctgttggtcgaaaagggcggcgccggggtggacgtattcttcgtcatcagtggcttggtgattttcctcgcgagcgccgataaagcgctcacgccctggcgcttcatgctgatgcgcgtggccaggattgctccggcgtactggttctataccgtgcttttggctgtgctggtcacggtcatgccctggatgtttccagacgttcagctagaactgggtcatgcgctcctgtcgatgctctttattcccgcgcaaaacccggcgggctacggcgtgtatccactgctggatgtgggctggacactgaatttcgagatgctgttctactgcctgtttgctgttgcgctgctggtactctctggatcagtcacggatcctctaggtc

SEQ ID NO: 573523 - DNA, 100 bp, Homo sapiens
taactgtaatcacacacatgcatgatacttgtgcataaatgacaaatagatctacggaatagagtagtggatgtccagaaataaacacttgaccaaatat

SEQ ID NO: 573524 - DNA, 717 bp, Homo sapiens
tggactagaaggagaccgtccggcgatctggaggagtgtgggccaagccgttccctttgagggtcatcggcgggctggtcatagctattgcatatattgaacaactaatcttgtaatacgctttgatcctaggcgttccaagaccatccacatcatggctcgaccgaatcgtaatccccgcatgagtgtgaaccgttggtatccgcaatggagccttgttgtgagctttgggtcagtgccaaaacagccatcgatcatgccacaattgacctacacgtgtctctcccaccgggtgctcaacgtcacgtggctgtgcaagggggagcctggtcactgagggtgtcggctgagagcctcttccggcccagaacagattacgagcgttccacgaatgttccagtgtaccatgaccttttgtggcccgtctcgcaagaggacttcatatgactgcgagggtggagcactggggcttgagaccagcgcgctcgctcaatgcactggtgaggcccaagagccaactccagatgcctgagacaacggagactgtgctcggtgccctggggtcgtggtgctgggccatagtcggccaatcatcgagggcaccgtacctcagtcatagaagtctctgggttcgacaggacccccgggccagggggacccgtgaaatactgtaaagggtgaccaactctctgaccagaagaggctgaggagagaccg

SEQ ID NO: 573525 - DNA, 937 bp, Homo sapiens
  misc_feature (755)..(755): n is a, c, g, or t
gttaccaccctgtgccctgtgggactcttgagacaggccaccagacagttggtttctgtctggacacacgtgggggatatgatgtcccgtgtccatggcccacgatggccggacagctcttgatagtcaaggagcactgtgatgccatctatcaaagcgcgtgggaccgttgcggcgattccatcgtgccgacaggaccttcgatcggccatgaatccgactatcaatgcagtgggctttcttccccaacggctacgctttgaccaccggctctgacgacgccacgtgcacgcctcttcgatcctgcgggccgatcaggagctcctcatgtactcccatgacaacatcatctgtggcatcacctctgttgccttctcgcgcagcggagcggctgactgctcgctggcttacgacgactttcaactgcaacatctgggatgccatgaagggcgaccgtgctaggagtcctcgctggccacgacaaccgctgtgtagctgccttcggggtcaccgaacgatggcaatggactgttggcccacgggattcctgggactccttcgctacaagatctggaactagatggccccacccccactgggctccaggtccaggacggggccctagcccatgcccacactacaagtgccatggagcttgctggggactaggcagcaatcccagccccctgtccccgggcacatcggggacccttgggtcacctgccctacccacgcctaggtcttaggattcctcnccggggctcccacagctgtggagataacgaaggggactggaatgggggaagaggaggaagcaggaggccactcatccttctgctgcccatggggttggggcctcacccctctggagggccggaggcaggaaggtagaaaccccaggggctaggctatttataaaactggttttatttaatct

SEQ ID NO: 573526 - DNA, 125 bp, Homo sapiens
gtcaattcggcagctggaggctgacattttggatggtcaatcagatatttaaagattttgccatgatgatccatgaccagggtgatctcattgatagcatagtagccaattctggaaagtcaaag

SEQ ID NO: 573527 - DNA, 150 bp, Homo sapiens
actccacacggaatgacacagaggaatacctctacgtctcaaggactcacctcccagaggacgtcaggattcactcaatgattacttagatgctatcgaacacaatggccactccaggccaggacagcgacctgctctgagaggtccatg

SEQ ID NO: 573528 - DNA, 204 bp, Homo sapiens
  misc_feature (52)..(53): n is a, c, g, or t
cgtggatcggtcaggggatgatctttaccaggcccagggcgcagcacgccgnnctgactgcctgtggatttcatttctgcctttcagtttttacttcttcttcctttggaggcagaaattaggcataagacaatatgaggggtggtctcctcccttaattgtacgaaaaggttctcagggagatgatgaaaccatgtgtacatc

SEQ ID NO: 573529 - DNA, 909 bp, Homo sapiens
ggtccacccgcctcggctcccagggtgctgggattacaggcatgagccactgcgcctggccacactccataaactttacgtgtttgaaatacacgtttactcttagcccaaagcacccaatgacatttcttaccctacctgtttcaccagatttttctgcccctgactctgttctactgtcactctggccaattggaactcttttttttttttggagacagagtctcgctcggtggcccaggcgggagtgcaagggtggtgatttccggcttaggttcaggtgattctcctgcctcggcctcccgagtagctgggaattcacaggcacctgccaccgaccgggctaactttggtagtttgggtagagacagcatctcaccatctgggccaggctgggtctggaactcctgacgtcgatccacccgcctcggccccccaggggctggggattacaggtgtgagccatcgcgtccgggccaattgggaactctttaatgggtattttcacataatagctggtctaaatcttagacaactgaatgactggttagacatcactaaatttaatggggcataaaattctgcggaaacccaggtgctccggtctagtggtacctgggtggtgctgctgctgcgctgctcgcggtgcagcggcggctgagacgggccacaccttctaaataccccaagggctggcctggcagggcacagaccaactggcctcagggacgcccaacttcctggtacaggatattcctctccccacagacaccgtaattcttcactgtcgttttccccacagcccgcaaattaggaatttacaacacaggccctgttctccgcgtcttgaccgggcacacaaccgccaccagagggggaaatgacctgtccgccaccgaaaatgggccg

SEQ ID NO: 573530 - DNA, 788 bp, Homo sapiens
atacaaaaattaaccaagcacggtggtgcacacctgtaatcccagctactcgggtggctgaggcaggagaatcgcttgaactttggaggcagaggttgcagtaagctgagattgtgccactgcactccagcctggctgactgtgtgagactccatctcgaaatacataaaaaaaaaaaaaaaaggataaaaatttccaaaagaccaaaattaaaccaacaaaatttccgggtagaacgatgtaaatataccacaatatctattttttactacgatattctacgatagagatttaactacaattctgggcaagaaaaccaagctttaaataattggacaaaggattattttaaaattaattgggagggaacaaatatgcgaagatggctaatcttttttaaagtggaatcgagagggagactttcttcaccagattttaaaacggaccataaagctataataatcaaaatgggcatgggattgggcacagagttaaatcagcggaaaacttttcgaaactctagaaaattttaccaggtttttgtgggaaaggttagcactgtgttaaaaagtgcgcatttcaatgggggtaacaagaggggtcctaataaggcagagtgggctatcggggtgggagacattaattattctaatactgcttgccaaaataatttccagatgcgtaacagaggtagtaataaatggagtctaatcataaaaagcttggaaacttggtgtgtacctcgggggcgggcagattggaaggggaggctcttaaatttgaaacct

SEQ ID NO: 573531 - DNA, 309 bp, Homo sapiens
  misc_feature (204)..(204): n is a, c, g, or t
  misc_feature (288)..(288): n is a, c, g, or t
ctaaaggtcggatgcggtggctcacacctgtaatcccagcactttgggaggcccaggcaggcggatcacttgaggttaggagttcaagaccagcctggccaacatggtgaaactccgtctctactaaaaatacaaaagttagccgggtgtggtggtgcatgcctgtaatcccagcttcttgggaggccaaggcacaagaatcgnttgaaccaggagacggaggtttcagtgaatgaagatcgtgccattgtattccatcctcggcaacacagcaggactgtgattttntttggagactcctagattttc

SEQ ID NO: 573532 - DNA, 818 bp, Homo sapiens
gcccagtgaccaatgcactcccaccgcctaccttagcacatgtgtctctgcagtgactgcgggagccagtgctcctgccgcccctcttgcccctcagaccttgcatccacatgaagcacaacccatgccaaacaccacatgccttctccatgagcctggcactgtccctggcaaccatgggtgtgccccaagtgcatagctcattctacgctctgtgtggcactcactgtgactcccccttgtgccaactccttgtggcacttttgtgtcccactgtcgctgatgccacttgacgcacgtgccatgtctactctttcttaatattagtgccagacaaatgtcgtatttatacaacacaaacttatctccattgtgttttgtaacgtgtacttatatactatctactaagcaccacacgttgccttgacgtgcacgcaaaccggcaggcggcacgattgtgcattacccactgtgtctgccaatgcccccctagattgtgcttgcaatcccgtaaaatcccatccgacttggcgtcacatgcatatgcattgctcatctttgaccagcactggcacacatcatgtgcgacaggacagtcagctacatcatcctatccatatcttcgcattcattacgagaccattcttgtcaacacaaccccagatcacttccaggcagtgactaacgagtgtagtcgcacacaggcgacattgtcaccctataccatcccgactacaatgtgtcccactagtgccactgcgacttgttaacctcctcgtattccatctacacggtcgttgcacagctacaggtgctgc

SEQ ID NO: 573533 - DNA, 609 bp, Homo sapiens
tgagagagggaatgaggccacttgagagttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggctcgcgcctgtcctcccagctacttggggggctgaggcagtaggatcgctcaagcccaggaggtggaggttgcagtgagccaagagcctgtctctccaaaacctacaaaatttagccaagcttggtggtgtgagcctgtagtcccagctacttgggagacacacgctggagggatctctcgagcacaggaggcagaagatgactaaataaatggaagcacctgaatgggatgaggtctctcttgaaggagagagcaaaagagatttacatagtaacaattataataaggctggggctgtggatcacgcttgtaaatcccagcccttgggaggccaggcaggaggatagctaagctcaatacacttccctacctgtccctctcatttacagcaccagcacatatgggtct

SEQ ID NO: 573534 - DNA, 277 bp, Homo sapiens
aaaaaggggggtttttttaaaaaagggttttgggaagggtttccaaggacccccgggttttttcttaaggttatgggggaaacaagcttggcccctgggggccggggcaaataggtttccccccaaaagaccccggcccccatgttttttaactttttgggcccctttgaaaccttggctttttttttttaaaggggtttggaaaccccctttttttttccaaaaggtcccctgctttgtaaaaaaaaaaaaggcctttttaaaatttggttgttta

SEQ ID NO: 573535 - DNA, 244 bp, Homo sapiens
gtacccggatgacacttacgaatcagggagagatgaaagagtctagcaaattatttctagcataatcactcagtttaatcttcatgactcagtccttgtagtataagttccaaataaaaaagaaaaagtgctggtcaaccgattactgtttacccatttttcaaggttttaacttatgggaagccaggtgaaaaaaagagcctagcttttttgactacccattgccggctgggatacctagtgg

SEQ ID NO: 573536 - DNA, 162 bp, Homo sapiens
  misc_feature (52)..(52): n is a, c, g, or t
  misc_feature (61)..(61): n is a, c, g, or t
gattcaacccctagcttatgctgtccacatgccacacaagcagccataaaangagaaaaanaaaaagagaaggacatgaatgagggcagggagtcaaggtgtataaagagagtaaggaaggtaggtaggtagcaaagagggaagacagaaaaacagagaggt

SEQ ID NO: 573537 - DNA, 606 bp, Homo sapiens
  misc_feature (313)..(313): n is a, c, g, or t
  misc_feature (318)..(319): n is a, c, g, or t
  misc_feature (324)..(324): n is a, c, g, or t
  misc_feature (330)..(330): n is a, c, g, or t
  misc_feature (398)..(398): n is a, c, g, or t
  misc_feature (401)..(402): n is a, c, g, or t
  misc_feature (430)..(430): n is a, c, g, or t
  misc_feature (435)..(435): n is a, c, g, or t
  misc_feature (459)..(459): n is a, c, g, or t
  misc_feature (476)..(476): n is a, c, g, or t
  misc_feature (525)..(525): n is a, c, g, or t
gtcagcgttcacattcctcaggaactctccttctctggtccacggaacttaacccgatgcaggcatggaggcctctgctctcacctcatcagcagtgaccagttgtgtccaaagtggtcaggtgtggcctctggtctctgccgtagtttttgcccctggtccaggattgcctacagttgtgattggaaggagttgtgttccatggcggctgtgcccatggtgctcagtgccatgggcttcactgcggcgggaatcgcctcgtcctccatagcagccaagatgatgtccgcggcggccattgccaatggggctngagtnnccggncagctntggctactcgcagtcacgggagcacggactctccggatgaccaagttcatccgggctccatgggtcgncanngcggcgtcatgcgaggttctactagctncctgnccctcgccctgagagaagagaacnatgccaggggagaaggnacccagccatcgtgacccagcgaggagccaactatcccaaatatacctngggtgaaatataccaaattctggatctccagaggaaactaagaaataaagatgaattgttgcaactcgaaagccccaagcg

SEQ ID NO: 573538 - DNA, 858 bp, Homo sapiens
  misc_feature (627)..(627): n is a, c, g, or t
  misc_feature (830)..(830): n is a, c, g, or t
ggccaggcgtggtgatgggtgcctgtggtcccagctgctcgggaggctgaggcaggagaatggtgtgaacccgggaggcggagcttgtagtgggccgagatcgcaccactgcaccactccggcctgggcgacagagggagactccatctcaaaaaaaaaaaaaaagaagtttgaattttagccgggaaattagaccctcttctttctcagtgcgatttaggacgtgtggttttaagaaaactgtgcaacttacagaagtttacacagttaagaagggcagagtctcggtgcctcctaccagtgacttacctgtggtgttggtagcattaattggccttcttttccccaattcagaattacggcgtagtagaagtcgctaaggggatattaatctattggcaggcacaggaattttccccttgccatttaagagaagggcagggaacaatttattccttttttcctctcttctttttaggaggggcaagaggtttcccttctgtgttcaccccagggcaggagagttgcagggcgcattgactctcggcgatttaccttggggaaccttcttgcccttccccggggggtttcaaagcggaatctcctcaatggttctcggcgccatcncttgaagttgcgctttgtcgacttgcgcagcgcgttgttgtgcgcccaacaggtggccgtgggcttacaattgggcggtacattcgcacacgggggcgcgcgaaccggcgcgtcgtccggccatttgttttcgccccagggctgggggtcttggagacctctacagggcctccagggggtgactcccggtttggcctctcagngcctccccgggggttgcctggggactcc

SEQ ID NO: 573539 - DNA, 906 bp, Homo sapiens
catcttacagatgctaattcattgatgtaaaagatactcaatggtaggcctgtggacccattcaatatgttttggtacctttctgtaactttcgtatatccatatataatatagatttacccaaatctatctttcttaaaattgcatattatcggtcttcatgaacatgtcctttccacaattccggtttcaacacatttggtccgctctctttctacagaagtaggcctggacatcatttacacattattctgccagttcttacttatccactgtgtcccagagtctttactcctaaatatcttcctgttctgccagcgctttagatttccatgtgttctattaaaagagtaggaacatactcctccatgccagacatctgcttatgtataagcattgactcatctttcccccttatgtaatcacatgctatctccttccggtcacgtccgctgtacggcttcaagaacaaaaagcatatttactgtttctccctaaaaacttgtgggaaaactcaattctatattactctatggagtattgtcaccacaatggattgtatcctttaacttctgaatccctggtataacagtacgttacacccccttaaattcctttccattacctctgcctgccctgctcggtcaaggcgctgcggcaactaatccctggatcaattttgacaaaggcttctcttcttccacttccaccactgtccgtcgcatttgccggcccaatctttcgaacccacggccaaacacgaattctccttcattacccaatcacacaacactcctctctgtgggatccctctcagctccacaatcaccaatacaacgcgcgcggaccccataactctcgcccccctctccaacaccgtgcgggcctcgcccacacaacactcta

SEQ ID NO: 573540 - DNA, 802 bp, Homo sapiens
  misc_feature (374)..(374): n is a, c, g, or t
agcggtgtgatgatcacgcttggcacctttagtatagggccatggtgacgcaattcacagtaagtatgatccgaggtgcctgtgtcacgtgtatcattactcaaatgaggtcgggcggtggtcgtttcagactgtgccggtacgcatgcggcagacctctggcatggactggcacgtgccacgtgacgcgtagtcacttggaagtggctctaccacgagttacacgagtcgcagggctcgtaggcatgctgttcattctactcactctcgctctggtactgggaagggcactatggttagaccacctctatcaaggaaagcacctagcctagatgcagtagcatgagagttggatgtgacacgtagaagctgantgggcaatagagtcgagctgcaggtatcctcgatggagaggctacaattcgcgttgtacccatggttgtgaacgatgaggcatgaaattgtgaacttgactaggtgctagcaggcgcatgaacaccgttatagcgagatgggtgagtgaggccgggatacttagtcccgtgtcgctgagaaaggcagtcgacattgctgataggatcgcgcagacggatgttggcagaagcgtgtgatggaccagagcaagaatcacctctagtggtgctgtgttgggcatgaacgcgcctaccagcctgtcccagttcccactttggcgagtttggataacaggtgtggcagtggaactgactagcaactacctttcgtacctccttccatggccagcaatacttttgcccaccaacgatgtagccactgtactggg

SEQ ID NO: 573541 - DNA, 316 bp, Homo sapiens
  misc_feature (29)..(29): n is a, c, g, or t
  misc_feature (47)..(47): n is a, c, g, or t
attataaagtaacacattttccattggcnaaaaatttagaacacagnaaaatacaaacaagaaaactgaaactaatataaacatgtattttattcttctttaaaattgtactgcagttttgggggatgtattattttcagaaagatatatcatcaactgaatttgttgggtgaaaggcaacataagtatttcatatttggcttttatgatgctatgtagattgaagaatttttttgtatataatgaatgctaagccttcatgtttatattcagatattcattttgcaatgaataaaacagacaaatccctgccttc

SEQ ID NO: 573542 - DNA, 1103 bp, Homo sapiens
gcactcctggaagatggctaggagttccccagttatgacgaaggcagtggccatggttgagcaacaatgagtgttgtgaaacatcagtcagattgataaaatctagatgagtccggatgcggtggccagattgcctgtatttcccagacatttaaggagtaaggcttgagagccaggttgaatcacctgaggtcgggagttacaacgaccaggcttgggtcaatcaataggttgagagactcccggtcctgctatctagaaacatcagcagaaaacttatgccatgggctatgtgtggtctgagcgccgtgtagattccatgcctatactcatgaaaggcttgagagcatagggaggaacttcgctgtgagaactccatgggatgctgggaggtagcgagattggagcttgcaagcaatccaagtgctcaacatgcaagctcccgagccgtgtgagccggaagaagcgagccggtaggcaattccagatcgttcagaatagagacatgtaacatattcagaggacatatataccttcgtttgtcatatcgttccaattcagcgtcgattcagacaactttataaatttagtgatacagagcattattattgttccctggtctttgacttagtaagatcctagtattaggaatgtgtagaattattggatttagacaaagtattttacaagttaagccggttgcagtgaaagaagggtttgggtatgaataaggcacgacattggaagttgcttaacatggaaaagatacaaaaatcagtgtctctttcggcattgagtaaaccttaaagaaggcaatttgcaggctctggagttcccagtggcaggtgcatagccagctgtaattgctcccttggcaccttaaacgggaagttggtcttggttttgtgaggacaaatttagaattgtttaaagaaggcggttgagaaacatacgaagcaaggcccataataggcacgcattaagtattaaattttcaataggaaaaaaggagttaaaagcggagaaattatgtattggagacaagaggaaccccaaggaaaatgaaaagtggcctaaatgaggccaattcggtgtacgtgccg

SEQ ID NO: 573543 - DNA, 506 bp, Homo sapiens
cgacgacgtgagtgagaaggctataacgtttagtgacgggagagactttggtatatgattgagatgggggctagttatatgtcatgtgagacagaacgcaggccggatgtcagaggggtgccttgggtaacctctgggactcagaagtgaaagggggctattcctacgttttattgctatagccattactgacttattaatgactgacgtacttgacttggtacgtacttggttatggttccttgtccggacgacgtactacttgttgaacgacggactagctacttacgaacggactatggatgcggttgcttgcgtgaccggacactacttgactggccgcttctgtaggaaccgcgggtttcttttttattggttacaccctggaataaaacgctagcctgtttactttctacggcctacctcaggtaaaaacatcacgtgcgacgcttacgcgcctgtgaccgagaccctgccttgcgggggactcctctacgacgtcgacc

SEQ ID NO: 573544 - DNA, 409 bp, Homo sapiens
  misc_feature (31)..(31): n is a, c, g, or t
  misc_feature (401)..(401): n is a, c, g, or t
gatgagggatatacccacagtgaccctgaanacttgctggcttccccatcttctgtgaagagctatgacccagctattcctcaatgagctctggaaaatgaatgccctggttttcttttattattattattatttttttatttttttgacacagggtttcgctcttgcctaggctggagtgcaggggcataatcttggctcaccgcagcctcgacctcccgggctcaagccatcctcccacctcagcctcatcagtagctgtggactacaggtgcacaccaccacacaggccaatttttgtatttctttgtagaggcagtttcactcaggctggtcaggaactcctgagctcaagtgatcctcccacatcagcctcccaaagtgctggtgttacactggtncctggtat

SEQ ID NO: 573545 - DNA, 288 bp, Homo sapiens
cttagggataagtgaggtggactcactcctgattttacctgatgtctgtatttggcttccatataaaatgtcacttgaagaaaggattccgagcctcaaataaaaagcggaaaatccctgaactgggtttcttggtctgcatagcgagaggctaaccgtactcgcccccgtcaggcattgtgaggatcatggcgtagcaagccgaggaagctgcagcctgtggttgactggagcagtcaactggcttcacagatattagccattattatgaggctgtcgatgctggag

SEQ ID NO: 573546 - DNA, 740 bp, Homo sapiens
gaaataattcacttatctccaaaatagaatcctatatgccaataagtgagttattgatctgactagtagtatgtcttgctgttcaaaatagacacttatccttgtctgtgactaaatgccttgaaaagaatgaacaatatagaaaattcctcagacctacaagaattttccaccatgcagagaatatcactttattttagatttaacaactagtcacaggaattatagcatagggcagttgggttgttaagatctaatttatggcgtacatgtcggttgtatccagtgggaccaaacctgaacggaaatgaaatctcatcctattctttactatcaagagaatgaaatgatgctagaatgaagtgagtttgggttgtaatctgaatctatggatgtcacacaatacattatgtatagtgtgattttacagatatgctaaaaacgtcagagtgagtacacaacatgtgtatatttgaaaaactatacacactattgtatgatacacaatgctgtcagaaactattggtgcgtgtagggatgatctggtgcagctgaatagtaagtactttttaaaagttaggattatcattttcctatttaatgatatcgtgtatttatatacagaccactgatagataagcgcagggattctaaaagatcctggtatacaaaattaagaactctgctctaattggaaaccaaatgagattaaattgccagaaaagtcaggcaaattaatt

SEQ ID NO: 573547 - DNA, 456 bp, Homo sapiens
  misc_feature (42)..(42): n is a, c, g, or t
  misc_feature (49)..(49): n is a, c, g, or t
  misc_feature (51)..(52): n is a, c, g, or t
  misc_feature (120)..(120): n is a, c, g, or t
  misc_feature (313)..(313): n is a, c, g, or t
  misc_feature (336)..(336): n is a, c, g, or t
  misc_feature (352)..(352): n is a, c, g, or t
  misc_feature (417)..(417): n is a, c, g, or t
  misc_feature (435)..(435): n is a, c, g, or t
  misc_feature (453)..(453): n is a, c, g, or t
gcaatggcggcgctgacgagagctgcatttggaagtgttgtngagacantnncgtagcccaatgcgaccagactcagggaaaacatcaggcccctccagctgagccttgtgtgagcccgnccctccctaaatgccagacttgggagctgacagacagcactgcctgtgctgggtttaaaagtcctggtcagctgagtggaaatagaaggatttctgctgccatcatcttccatgggctttccaggtcacacgacctacaagtaggggaccagggaaaagaagagttaagcctgcatgccaattctaaagctcntcaggatcaaaatgtcgttcggncctgtccagaaatggnaagcctgttgaaggcaccttgcaaagaacaaaagtgacttgtgttccaagccccgtgttgggaanttcctgaggcaaagaganccccagccccgggttggnccg

SEQ ID NO: 573548 - DNA, 747 bp, Homo sapiens
tcatcgaagcgggatcggcccaaaatggaagtggaactacccttgagtgacttccgcaccgaagcaagactcgcgaaaggcatatcaatgcaccgtttccacatgcgaaggaagataatgtcttgcacctactatctaaaccacgctgagaccgaagtacaaggtgcgatccatgcccatccgacacaggatgcatgacagtacaggttgtgcgtggcacagtagaacggtcagcaatatggcgacgtagtcccaggtttacatgggaagaaatatgttgtctacatttgaacggtttgcccgtgggaacgggggtctaagtggcacaacgggtccatgggtaggcattgtctaccccgatgcagaggttgggtctctcactaaggctgtaatactctggacaaggcgaccgcctgaaacggatcctcggaacggaagagtcctcaatctcgccaaggtaggatcatggaccaagggcgaatacgaggagaggaaacctattgagaaagatgccggaagtaaaggactagtctgatatacagatgctttgatttacacttggaagctatagaactatgaaagcacaaccacaacacccaacaaaccatgtcggccgactcggcccggtcgactctaaactacatgaatgcgtgtcacggcgtcttgtaacagattgaaggcaaccggggtaccactttatcacctaaggatacccattactggttatgataggcgaagaaccccaca

SEQ ID NO: 573549 - DNA, 146 bp, Homo sapiens
aacaaggaggctcccaggcctctatcacaggccccacatcagagatatcagacgctcaaatgaggcagggcaaggtgcgcacccaggactccccgtcccctgcacactggggcttctcctctgcaagcagctgagagtcacacgca

SEQ ID NO: 573550 - DNA, 113 bp, Homo sapiens
tcaacgatacacagaagcaaaggtgtagtcctaatgtgccaaaggcatggtccttgggctctgggtctctcatccttgtgtgctgctctgctcaagagatgtccaaggcggag

SEQ ID NO: 573551 - DNA, 454 bp, Homo sapiens
aatgcgagcttcaactggaagccagtggagagagcggaggagcggggtgacgtgagagaacttgggaaggttgaacaccagacgggctgcggcgttctggatgagttgtaggggtttaatggcacaggcagggagcccagccatcagcgagttgcggtaatcaagacgggagatgacaagtgcctggattaggacctgcgccgcttcctgtgtgaggcagggtcgtactctgcggatgttgtagagcatgaacctacaggaacgggacgccgccttgatgttagttgagaacgtcagggtgttgtccaggatcacgccaaggttcttagcgctctgggaggaggacacaatggagttgtcaaccgtgatggcgagatcatggaacgggcagtccttccccgggaggaagaggagctccgtcttgctgaggttcagcttgaggtggtgtcgacgc

SEQ ID NO: 573552 - DNA, 969 bp, Homo sapiens
  misc_feature (1)..(1): n is a, c, g, or t
  misc_feature (21)..(22): n is a, c, g, or t
  misc_feature (60)..(60): n is a, c, g, or t
  misc_feature (88)..(88): n is a, c, g, or t
  misc_feature (100)..(100): n is a, c, g, or t
ncccttccccccccctctttnnggggcactcaggcgcgggcgcccccactctcccgcgcncccacccccactgcaaccttccgcccanaaagagacaccngagtctttcgctttctttctcttctataggagggatcagacattatcatttcctatattcattaccttgttatcgggaggcgcgatcgcaagcgctgtgtttaatgagtgggctgtgtggttactgtctatcttgatatcctctgcagacgtgctttatgcgcgcactgaagagaacatgaggaagtagaagaaaaaatagtatttgagggcaatatcttgtattatactatcgagtcttttccgatagtgagaagagtgcagagtatgaaccaggcaagacctactcccacaacattcgtctttatgtattgagatagagtcagcacctccggcgatcccacaacggaaacaccaaaaacaactacgaggacgcaaggcccacctcaacgaatattaatatccaattatgtgtaacaatactccgccaccacacaaccaacgcctcactctcaacatatataaagtaaagtattagcacctcgacaccgatcccccccatcttttataatctcgctcccacccctcctatcggttgagcttgtgaacatcgaactatttattgttgagctgcgctaagacaacagaacgtacactccacagtgatgctcagctcgagtggctaaatgtaaagatgagtaccattattacacaaagtaattaaatgtattcactgcgtgaactatatagtgtttattgcaatattacagacggaggtgaaggatgctacggaattcatgatatagtaaagatatatattatcaaatatcaattattatagaactacaatgcgagaatgataatagaacggacaatagaatgtagtagcgtgtgtttagttggatatacaagttgtaaagctcgaaagac

SEQ ID NO: 573553 - DNA, 351 bp, Homo sapiens
  misc_feature (16)..(16): n is a, c, g, or t
  misc_feature (21)..(21): n is a, c, g, or t
  misc_feature (81)..(81): n is a, c, g, or t
  misc_feature (112)..(112): n is a, c, g, or t
  misc_feature (187)..(187): n is a, c, g, or t
  misc_feature (189)..(189): n is a, c, g, or t
  misc_feature (225)..(225): n is a, c, g, or t
  misc_feature (228)..(228): n is a, c, g, or t
  misc_feature (267)..(267): n is a, c, g, or t
  misc_feature (276)..(276): n is a, c, g, or t
  misc_feature (278)..(278): n is a, c, g, or t
  misc_feature (299)..(299): n is a, c, g, or t
acccacacccacccangaacngggtttgttaaagatgcagagcccggtaatcgcataaaacttaaaactttacgagtcagnggttcaattcctcttcttaacaacatacccntggccaacctcctactcctcattgtacccattctaatcgcaatggcattcctaatgcttaccgaacgaaaaattntnggctatatacaactacgcaaaggccccaacgttgtnggnctacgggctactacaaccctttcggacgccataaaactnttcaccaangngcccctaaaacccgccacatntaccatcaccctctacatcaccgccccgaccttagctctcaccatcgctcta

SEQ ID NO: 573554 - DNA, 468 bp, Homo sapiens
gcctactactactaaattctcccccgatcgacggaagatctgcgacacacacagggtgtcgtgggcatgacaggtctcggccagccgccgatagccgtcgatgcaggcatcgtcggtggccatcagcacatgggaggtataacgcgcactgtcgtgaacgcccgccacctgcaacacgatcaggccgacaccgccctcggcgggcccggtgataggcgatcaactgttcgttgaccaggttgtcggtgggcatggaggtgtcgtgtccgctggacatgatgcggttcttcaggcgcttgcacgcagctgcaagggttcgaacaaatgatgagaggcgtgcggcgacgtcgacatggcaaggcttccaggcggcccgggatcgaacgcgggctgttgttattattgttccatgaaaatttacctatagtaaaaaatcaacttgtttttttactttgccttgagttagct

SEQ ID NO: 573555 - DNA, 1651 bp, Homo sapiens
  misc_feature (1)..(1): n is a, c, g, or t
  misc_feature (114)..(114): n is a, c, g, or t
  misc_feature (782)..(782): n is a, c, g, or t
nacaataatattgctggctcgtttttgtagtgtggtggctcaccctcctcctgtactatgtagccattttgtgtggtgtctctgtgctcgtactcactcgtgccactcccgcgnggtgttattataaagggtcctactcgtgtggagagggacgttgtcccgtgacctctcccttgtggtgatattgtaaagaaaaaatgtttgtaaggctctcatcactagagagacctctcacaggtgagcaccgcatgtctttgttgtccgctccgtccttgtaagagacaacatccttttacatgctccctcggggtggtgatatgatactcttcgcaagaaaagtggttttttattcccctcttcctccttccgcgatattgatggaatcccctggggcccaaaaggcgcgccaataagtttgagggaacactccgtcttttccgccgcgtgtattccccaggcctcttaagggggctccccgtgggcatttccagtctttattttattggagggaaattaatgaggctattatccatttcaaagggacccctttctacggaggaaaaccattcgctccccttgggggaagttttatctttccgtggtctttgaaaaattgtttatacccccagccttgggaaacacactgttttttgtaaaagcttttgtcttaccactgtggttggcgacactattttggggcaaaagtgtgttttttcgcccaatatttgggacatttgtgaaaaagagtggcgttttcttctcgggaagattttagagattgnaaatttgtgttccggcccacactctgggcgcgttttaaaccccgcggtttctccctctcacagagaggtgtaaagatcacacaaatctcgtgtctccacatagccacccaagagatggatttagaaatcccaggagatctctgttagccaggagaaatctcttgtgaaaatagaccctcacgagagatatctctctcaagagagcgcccctgtctgcgacgccaccccactcccatcagagagagagatctccattctcgccacgagagttctccgtttaagagaagagaacactctcaccgtgtgaataaaacactgtgtgagagaaatctcagagtgtgtgtgaagacgttttaacacctcaataatgcccacaagagactcccactgccgcccggggaacacaccccagtgttgtttctcgcaccagagcccccagggaatctcacacaaagacctcccggggttggatataagagccaacgtgctgtgccagcacagccggcgcacatcacacaaaaccgcacaataccagaatagagaaagagccgcgccggtgtctccagagccacagaaagaccctgtggttaaagttaagagaaagaggaaagaaagagctcgctcgttggtggtttaagaaagaccagaagaagacctctctggtggggaaaaaaggccagccagcttaccccagaaacccagcccctggaaaagaaagacctcgccagaagaaagaaaacacttactacagaagagagaaagaaagacctcgctgccataaaacattttaaaattgattattccctaaaggtccaatcaatttggacaagacttcttttgaataaagagccctgattaaaaccggccca

SEQ ID NO: 573556 - DNA, 712 bp, Homo sapiens
ttgctaggtacgatggctgggttttgaaagaaatccagaaggacttcctgctgctgcggtacgaggtggtgatcatcgacgaggcccacgagaggagcgtgtacactggacatcctcatcggcctcctgtcccgcattgtgactctccgtggctaagagtgaacctgccactcaagctgctcatcatgtctggccacgctgcgggtggatggacttcacccatgaacccacggctcttctgccaagcctgccgcctggtcatcaatggtgtgaatccatgtgcatgttcccatgtgactagtgcatttcaacaagctggacaccgctggaagactacatgtggctgatgtgcttccggaaggtctgcaagatccacctggatgcttgcccgcaggtgtgcatacctgtgtgttcctgactggtggcagtgctgagtgtgcatagcgcttgtgcctgccagtgctcatgtgaatgtgctttcccaccctaccagagcccggccacaagaaaaggacgactgatcagaaagactcggtgtgcaggaaatgcggaagtttaagaagtcacaggtgccagggccaaccaaggcgcggtgctgagtgtgctgccccagatcaacttggatcactctactcggtgtaaccggcaggcgaaggcgatgagtgacagtgaaggcaagaagtggcatgacggaacgaggggggccctggga

SEQ ID NO: 573557 - DNA, 417 bp, Homo sapiens
caaccaagtgaagattaaaagaagctttgacagaaacattcagaataacacccgaatgcgaatccagaaaaaagcgctactgggggacaatagtcttagcacaatgttctaaaaaatgctcataaggaagggttggggcattaaccctttagacacaagctctaagaactctggatccaacgggcacttgaatagctacaagatcatgggcctgctgggccagatgtaccgagggcgagaccggaaagcagcctgtcttgcaccattgcaactaactggctataatctacggcaagagtccatcagctccgtcacaagagtactctcccaatgtgttatagttatccttaacgctcttcaattcaaggaagtgcttgccacgtatactcttctgactggagggcaggtatgtcacct

SEQ ID NO: 573558 - DNA, 330 bp, Homo sapiens
ccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcgtaggccctttatggggggtttggggctcagcccagctttcatcatggatgtaagctgctgtctttgccacgtgactttgagtggatgttctgggggatggcccttgttgggaggaggtcagatgccgcccgcctgctcccggcagaagggtggtattaatatgtcataggatggctaaa

SEQ ID NO: 573559 - DNA, 235 bp, Homo sapiens
ggaaacaacatgacaaaatttacaacgcaaaaagtaaatgaattactttgggtcaatgagtcgtttaaagttccagataaattaatgtcaatcatgatgaatcgtgaacaacgtgagcaaacgtttaaagcatttcaggaagttgagcgttatacatcattcgattggttccatgaatattttgaagacgaacaagctaacgaagacaaccaaacaagatttcacaccagaagtc

SEQ ID NO: 573560 - DNA, 129 bp, Homo sapiens
tcgtttactaaatcaattagccaggcatgtggcgggtgccgtaatcccagctgcttgagaggctgaagcaggagaatctgcttgaacccaggaggcagaggttgtggtgaggcgagattgtgccattgc

SEQ ID NO: 573561 - DNA, 826 bp, Homo sapiens
actgcttaatgtccctgtgtggggaatccacgaatttactcgccatcaggcctactcccgatccttacatatggcctcctctagcttcttgcctgccacccagctcgatcatctttgctccacttggccttatacctgtcatatccatgatgcggaggatagtgggagagtctgtgtaactatctttctcagaccaaattattccaactcttctgcatgcaatcaggatttaataatgagcagttagtatgtaggctgcactgtgaggcgggaatgacttccgacttcaggccagaattcactgtgtgccattgttgcacagagaggcgtttcagtatttctactacagcctgtgtgtgttgtgaagcattcgctggtttctggcagatgccattggctcatcttggtgcacgtgcagctgtagaattggttatttcgctgagtgtatccacgtcaacgtctctgaaatactggtgacttaactttttcccaaccccaatgagaaaatgctgtttcactttctatgaccagttaaaagaaacatggatgcacagatgttcaagccacaggtcaatcgcgaggcaacgaggtagaaataagatgcggccccggcaccaatggggcaacagaagaagatgggttccttacaagagagcccgcgctgtgcagtggtacgttgcagacttacctgggtacggaggagggtagaaaccgtttgacttggttatttcaggcggtcacctgtcttccggacttcatgcaacgaacgatatccagacgttttcccactgccactgaaaagtcgcgcctatactgatttgatcca

SEQ ID NO: 573562 - DNA, 466 bp, Homo sapiens
gtcgttacggacgctgtcgaggtgagatagtgcgatgacctcgggaggaattgtgttgagggtcaacgtcgctcagatgcaacgtacgtaaggttggggaagtgggtgaggaaacctggcgctccccgggtagtggggtaaccctttagcgtcaaactggacgtgtgatcgaagtttgcattgagtacaggccgttcgccgtgaatggggtagccaaggttcagtgtgcgtccgattgcgtggtcagtatcgatcggcgtttcatgacgccagccgcggagcagttcttgtgtccatatccagcggtgcagttccgcttcggcgaccgtggaagggggcagcggggcatcggtgttgagagaggcctgcaagagggtcgagcgccaggccatcagatcggttttgagtcgtaaaagctcgtttttcaggtagcggagcgtctgtaagggagtggcgtccgtagcgg

SEQ ID NO: 573563 - DNA, 165 bp, Homo sapiens
tgacattaaagagacatttataatgtactgaaaaaagacacaggaaccaacattgtgtgtccactctgtacctctctcaccgccccattagtgtcccattagctgtttccctgctaagggctggtgcatctggccaggcctagctttggatttggccaacaatgt

SEQ ID NO: 573564 - DNA, 104 bp, Homo sapiens
  misc_feature (12)..(12): n is a, c, g, or t
  misc_feature (63)..(63): n is a, c, g, or t
agcttacagagnaaggaggtgggagagacctggccaggtgagcttgggtgttgcccccaggtnaatcttcctcctctcctctctctgtccctttacctttgatc

SEQ ID NO: 573565 - DNA, 1341 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (893)..(893): n is a, c, g, or t
  misc_feature (899)..(899): n is a, c, g, or t
  misc_feature (923)..(923): n is a, c, g, or t
  misc_feature (1188)..(1188): n is a, c, g, or t
  misc_feature (1190)..(1190): n is a, c, g, or t
  misc_feature (1194)..(1194): n is a, c, g, or t
  misc_feature (1196)..(1197): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttaccaagncatgcntgttggccattggtgtgtcaaacnaacacacagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaananaagnannttgaggacctcgtggctcacatggatatgcagttgctgatgattcctcggatcattgtcggggggtgggaggactaggggccagctgagcggacaggtgattgtgtctcccggcccggactcgtgtcacgggcggtattgccgg

SEQ ID NO: 573566 - DNA, 1254 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (936)..(936): n is a, c, g, or t
  misc_feature (940)..(941): n is a, c, g, or t
  misc_feature (950)..(951): n is a, c, g, or t
  misc_feature (956)..(956): n is a, c, g, or t
  misc_feature (1092)..(1092): n is a, c, g, or t
  misc_feature (1095)..(1095): n is a, c, g, or t
  misc_feature (1104)..(1104): n is a, c, g, or t
  misc_feature (1120)..(1120): n is a, c, g, or t
  misc_feature (1132)..(1132): n is a, c, g, or t
  misc_feature (1144)..(1145): n is a, c, g, or t
  misc_feature (1149)..(1149): n is a, c, g, or t
  misc_feature (1156)..(1157): n is a, c, g, or t
  misc_feature (1161)..(1162): n is a, c, g, or t
  misc_feature (1176)..(1176): n is a, c, g, or t
  misc_feature (1188)..(1188): n is a, c, g, or t
  misc_feature (1209)..(1210): n is a, c, g, or t
  misc_feature (1215)..(1215): n is a, c, g, or t
  misc_feature (1221)..(1222): n is a, c, g, or t
  misc_feature (1228)..(1228): n is a, c, g, or t
  misc_feature (1232)..(1232): n is a, c, g, or t
  misc_feature (1234)..(1234): n is a, c, g, or t
  misc_feature (1237)..(1237): n is a, c, g, or t
  misc_feature (1244)..(1244): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagantctnnccaagaganntaatngtgcgtattgagcacattaagcactctaagagccgagatagcttcctgaaacgtgtgaaggaaaatgatcaaaaaaaaaaaaaaaaaaaaaaaaaaaaaaaaaaaaaaaaaattgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573567 - DNA, 1412 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatgggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaaaaaaaaaaaaaaaaaggacatgcgcgcaattttagatctcactggcacaatgccctctatagagaggcgtatcacaatccagtggccggtgttacacaacgttgagagtgaaaaaaccgtggcgtcccaaatctaaatcgtcttgcaacatatccctttttcgacatgtggtattatagaaaagaggcccgcacatatcgcttttcacaacatgtgcacactctgtgtggagaatgaaaattgtacgctaaaatattgttgaaaaatccggggaaaattttgtgaaaaagagctcattttatccccaatgggccgaactcggaatctcctttatattcaaaaaaataccccgatatggggtagagtggttccccattttggcacaagaccccctttaaaagaagcgggtctcccacgagggagccgtctatggggagaggccctcctcgagcccatcccctatgtttt

SEQ ID NO: 573568 - DNA, 1854 bp, Homo sapiens
  misc_feature (1854)..(1854): n is a, c, g, or t
cgtcacgggagcgccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccaaaaaaaaaacaaaaaaaaaaaaaaaaaaaaaacaaaaacacccccgggggcgctctaatgcgggggcgcggaaaacaagaggagaagcacgagaaggcgcactggtgtcaacaggggtccctgacccacgttctgtgtacaacgtggaaaacacggggaccccaaaggagaggcgaataaccgaaaacccggtaccccgtatgcgcctgagn

SEQ ID NO: 573569 - DNA, 759 bp, Homo sapiens
  misc_feature (4)..(4): n is a, c, g, or t
  misc_feature (8)..(8): n is a, c, g, or t
  misc_feature (26)..(26): n is a, c, g, or t
  misc_feature (32)..(32): n is a, c, g, or t
  misc_feature (644)..(644): n is a, c, g, or t
  misc_feature (659)..(659): n is a, c, g, or t
  misc_feature (661)..(662): n is a, c, g, or t
  misc_feature (664)..(664): n is a, c, g, or t
  misc_feature (674)..(674): n is a, c, g, or t
  misc_feature (678)..(678): n is a, c, g, or t
  misc_feature (685)..(685): n is a, c, g, or t
  misc_feature (688)..(688): n is a, c, g, or t
  misc_feature (691)..(691): n is a, c, g, or t
  misc_feature (699)..(699): n is a, c, g, or t
  misc_feature (703)..(704): n is a, c, g, or t
  misc_feature (706)..(706): n is a, c, g, or t
  misc_feature (710)..(710): n is a, c, g, or t
  misc_feature (712)..(712): n is a, c, g, or t
  misc_feature (715)..(715): n is a, c, g, or t
  misc_feature (726)..(728): n is a, c, g, or t
aggnaacntaggctaggtacgaggcnggggtntaatcggccgaggccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaataaaaaaaaaaaaaaaaaaaaccccggggatttttttgggggggggaaaaaggggtntggaaagggccgggntnnanggtttccggncccnatttttnggnacnaggggganaatnngngggncnccntaagggggggnnnaattgaaaaagccggggttaacctgtttatg

SEQ ID NO: 573570 - DNA, 903 bp, Homo sapiens
  misc_feature (129)..(129): n is a, c, g, or t
  misc_feature (141)..(141): n is a, c, g, or t
  misc_feature (171)..(171): n is a, c, g, or t
ggcaaatgttttataataaggtgttagggggaatgttaaaaatgttaattagtcctggtggaatatgccattggcgagttccttaaaaaacgggggaaccttccttcctttctctttccccccctctcnctctttctctcnttccgcgggcggaattcgggcacgagcggnacggccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaaaaaaaaaaacaaaaaaaaaaaaaaaacaaaaaaacaaaccaaaagaagcaaaacaagaatcaaaacaaagaagaagaaacacaaagaggaaaaacaaaacgggaaaggaaccatgaacacagcacggaaaccaagaccgctatgaattcactgcgcactaagcagactgtgagaaaaccacacacaatgaagaaaacgactcg

SEQ ID NO: 573571 - DNA, 153 bp, Homo sapiens
cgaatcaacttccttaccaaccttcctgtctcaacctcccaaagagctatagattacaggcttgagccaccacccccagccctcgacttgtaaagacagattcaacttatattccactatatgttgactttaatttgcttgtatatagttggc

SEQ ID NO: 573572 - DNA, 2009 bp, Homo sapiens
  misc_feature (1681)..(1682): n is a, c, g, or t
  misc_feature (1684)..(1684): n is a, c, g, or t
cgtcacgggagcgccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatttcagctgaccccagcccacctgtgaataaatgtttttgcaggaaaaaaaaannanaaaaaaaaaaaaaaaaaaaaaaaaaaaaaaaacaccaacaagaaaaaacaaaaaaagggggggggggcccctaatatattcccccgcgggggggccagacagattgacggccccccccgacttttttagtgagcaacgagggggcccccaatgagagggggaccttattataaaaacatcgacagcaggggcgcgcgcgtttaaaaccagcactgctgtggtgagggacaacagaccggacgtggtgggggactctgtggcggacagccacacccccctgcacggggggggggggcaaaaactaggtgggaccacacactcaccg

SEQ ID NO: 573573 - DNA, 631 bp, Homo sapiens
ggacgcgtgggtcgacggacgcgtgggtcgacccacgcgtccgcgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaagaaaggtacctgggttcaactaaagcgccagcctgctccagccagagaagcacactttgtgagaaac

SEQ ID NO: 573574 - DNA, 576 bp, Homo sapiens
  misc_feature (21)..(21): n is a, c, g, or t
  misc_feature (27)..(27): n is a, c, g, or t
  misc_feature (37)..(37): n is a, c, g, or t
  misc_feature (44)..(44): n is a, c, g, or t
  misc_feature (52)..(52): n is a, c, g, or t
  misc_feature (90)..(90): n is a, c, g, or t
  misc_feature (115)..(116): n is a, c, g, or t
  misc_feature (119)..(119): n is a, c, g, or t
  misc_feature (134)..(134): n is a, c, g, or t
  misc_feature (146)..(146): n is a, c, g, or t
  misc_feature (217)..(217): n is a, c, g, or t
  misc_feature (264)..(264): n is a, c, g, or t
  misc_feature (357)..(357): n is a, c, g, or t
  misc_feature (369)..(369): n is a, c, g, or t
  misc_feature (397)..(397): n is a, c, g, or t
  misc_feature (405)..(405): n is a, c, g, or t
  misc_feature (408)..(408): n is a, c, g, or t
  misc_feature (410)..(410): n is a, c, g, or t
  misc_feature (413)..(413): n is a, c, g, or t
  misc_feature (430)..(430): n is a, c, g, or t
  misc_feature (433)..(433): n is a, c, g, or t
  misc_feature (437)..(437): n is a, c, g, or t
  misc_feature (447)..(447): n is a, c, g, or t
  misc_feature (450)..(450): n is a, c, g, or t
  misc_feature (453)..(454): n is a, c, g, or t
  misc_feature (457)..(457): n is a, c, g, or t
  misc_feature (461)..(461): n is a, c, g, or t
  misc_feature (464)..(464): n is a, c, g, or t
  misc_feature (473)..(473): n is a, c, g, or t
  misc_feature (475)..(475): n is a, c, g, or t
  misc_feature (482)..(482): n is a, c, g, or t
  misc_feature (485)..(486): n is a, c, g, or t
  misc_feature (488)..(488): n is a, c, g, or t
  misc_feature (499)..(500): n is a, c, g, or t
  misc_feature (506)..(506): n is a, c, g, or t
  misc_feature (508)..(508): n is a, c, g, or t
  misc_feature (522)..(522): n is a, c, g, or t
  misc_feature (529)..(529): n is a, c, g, or t
  misc_feature (531)..(531): n is a, c, g, or t
cttaccttccagcaacgccanactgtntaacaatttnactgtgnaaataaangcaacagaaataaaattcattaatgtccttaacctgtnctcttactgtgagcattatataganntcngatacaagatatatnaatcatagtatnggccttcatacatgtcaatgttacttacttcatatatggtttttaataagccttaacctaatttctatttnattcaagatcttcaattaagacctaagtgaggcttgaagctttcaanattatttctgttattaaaattctatccccatcccttcctacccgcatttctccaaactaaaaaggtatcactcaattctgagtttttgttttntttttttggagncgtattctcgctctgtggcccaggatgnagtgcagnggnanaanctcagctcacggcaagntcngccnccgggttcanggnatnntcntgcntcnacctgcccngnagttggnacnnanagacacagtcnngcacgntngactaatttggtantttaagnanagacggggtccacggtgttagccaggatggtcttatctcctgacc

SEQ ID NO: 573575 - DNA, 1672 bp, Homo sapiens
cgtcacgggagcgccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatttcagctgaccccagcccacctgtgaataaatgtttttgcagga

SEQ ID NO: 573576 - DNA, 463 bp, Homo sapiens
  misc_feature (3)..(3): n is a, c, g, or t
  misc_feature (6)..(6): n is a, c, g, or t
  misc_feature (433)..(433): n is a, c, g, or t
gcngcngcctactactactaattcgcggccggtcgggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcacacattanggaggggatccttctagagtcgccccgcct

SEQ ID NO: 573577 - DNA, 983 bp, Homo sapiens
atgcaactaacacttgcctccccactgcagcctgcggtcctgcccacctcccgtgatgtgtgtgtgtgtgtgtgtgtgtgtgactgtgtgtgtttgctaactgtggtctttgtggctacttgtgtgtggatggtattgtgtttgttagtgaactgtggactcgctttcccaggcagggcgctgagccacatggccatctgctcctccctgcccctgtggccctccatcaccttctgctcctaggaggctgcttgttgcccgagaccagccccctcccctgatttagggatgcgtagcggtaagagcacgggcagtggtcttcagtcgctcttggagaccctgggcaaggttctgccagcactttgctcaatcattcttcatggactccttatacactcccttctaacaaaacacctttgccttccttatcccacctgatcccagtctgaccggctctcttacgcaaactggacgactacacagcacggcacgctggtgagcccagcgttgacgtcacgcaggctactgccccttccgccgctcaactctcttcccaggggcttccaccgagcgcgtccccatctgccccgccccttcacagagcgcccggaggataccacggcccagggcttctactctgcccctggacgcaattgtgtcccctgcatatcttctcagccataactccatgggctctgggaccctaccccttccaacattccctgcatcctgagcacttcaaatcatacacaccacaagctacatccaagatgccagaactaacagccccccagccaacatcgacaccatcagggccacgacaaacaatcagaaagcgacacccagcaacacccatgagggaccaacacaaccggcgaaatgaaaacaccagcacccaagggaccttgacaacatcggacctacgcccccaataaaaagcgccaaaaacaaaccccgacacctgccccacgccaaaggccaaa

SEQ ID NO: 573578 - DNA, 1652 bp, Homo sapiens
gtgaggttgtgatctgccctacgtactgctttgttgatgcatacaggctacggcttcgtgcttagtcatcacctgacgaagttattacacaactagtgtgtggggttgttgtttgcttcttttccccgtcttgcggtcccaaggtgatgcgtgtcgtctgttctatccaccacaccgtctgtgtgtgtgtggtgtgcctctctctgttgctttcccacactttagttgatcgtctcaccacccgcgggatgttatataacgattcattggtgctagtagatctgcctcccacagaaagtttcttttgagggagtcactctcctctttttccctggggggacaccaacatttgggggggcctctcacaatagctgcccaaaagagaatggtgttctccttctcaacgaagagatattgttgttttctcttcgctgggggagaacaagtaagtttgtacgctgtgggtgtaccgcagcgaccaacactagtggggcgccccccctcccccttctgtggtgtaacagccacaccctcggggcgtatttatcaacctgcgtcttatccaacggtgggtggattttattttcctcgttgggagaccgctttctctcctcgggtgcccccataattttatatgggccgtcccccggcggttttatttggctcgccccccgttcgtgttatatttgtgggggaggtttgccaccacacccaaccgggggtcgtctcaccccctatgttgcccactgtggcaacaagttttttgtgctgggagagctctctagaaaggggagaaacacagaatcttcgagtctcccccccgctgttctctgggggtaataaaaacaaagtcctcgggagagagaattggggcccccctccaaaaaattttctcttggaaaagatttctcggcgtgagagatgtctcgcccccacctctggtttagaatataaatggggtttctctctgggacacaagcccccacactggggggtgttttgagagaggccctttctctcacagagacctatatcccacacccctttttggggctctcccattttttgtcttgttttctggtgaataaatggagagacacacagaccacaggttgtcggggtgggggtgtgtgcaacacgcacaaagcgcacagtggggagacacacagagaaggggctcggctcgggagagcctcgggagcaaaagggtgcacaccacacgtgtctcgcccccacgggaaaggcttcacagagagggggctaaatggagaatattaattccccctagaatatacctcggccacaccccacacttctttaatacacacgtgtggtgggagaagaacccggtgtcttcaagaaactctgtgtttgtgttgcacaattgcggccactcttaaagtgtataagtgaggtgataaataggagactcggtgtaaatgagtaaccacaagcactcgtgtaaaacctctcacagaaggagaaaggagagaatgttttgtggagaccacctcttggtgttttcttttttgcgtgtgggcacagttttaaagttaattagtttttaaaaatcacgtactttttaatgggaacaacttgacccaaaatttgtcaccagaattttgagaccccatttaaaaagttaaatgaga

SEQ ID NO: 573579 - DNA, 997 bp, Homo sapiens
  misc_feature (993)..(993): n is a, c, g, or t
cgtcacgggagcgccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatctgcgcagtggggccacgctcatgacgattctaaccggctggactcggggggctcactgtggcttgacggtgtcactgatgaaaaaactggataccgatntacg

SEQ ID NO: 573580 - DNA, 373 bp, Homo sapiens
  misc_feature (19)..(19): n is a, c, g, or t
  misc_feature (21)..(21): n is a, c, g, or t
  misc_feature (348)..(348): n is a, c, g, or t
cggttgactctagaggatncncctccataatgtgtgcccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctcngggcacacattatgggaggggtacc

SEQ ID NO: 573581 - DNA, 1963 bp, Homo sapiens
  misc_feature (1963)..(1963): n is a, c, g, or t
cgtcacgggagcgccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgggtgatggggtcctgtcgccagcatcatgctgttgcctcccagggaggcaggcactggggggcggcgtcaggcactcaggccaggctcccgcagtgtgccccccggcctttttggaacaattggcttccaccgcttgcttgtctttgccgtgaagcccttgcccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccaaaaaaaaaacaaaaaaaaaaaaaaaaaaaaaacaaaaacacccccgggggcgctctaatgcgggggcgcggaaaacaagaggagaagcacgagaaggcgcactggtgtcaacaggggtccctgacccacgttctgtgtacaacgtggaaaacacggggaccccaaaggagaggcgaataaccgaaaacccggtaccccgtatgcgcctgagn

SEQ ID NO: 573582 - DNA, 705 bp, Homo sapiens
gcgtatgtaacgtccgtaacgagcgcgtaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggacaatatgatcttatacacaccaattattcctagaaccaaggacgaactgtttgtgccttgacgtggccaagaagagtattactcccgatttgatggcggcccatgcggcactcacataatgtacatgcaacaacgagggtcttggcagtgcttgcagcggacaaacccggtgaggcaaaaaggggcgatgctctcccccggaagataataaagccgggggacaaccaagcggctttcacgaccgtccgtatagtgaggtcagggctctgagggctgttgacgcaaaggcgactgcgcatgcccatcgtactaatccg

SEQ ID NO: 573583 - DNA, 352 bp, Homo sapiens
ttgagtgtcactgtaaaatacatggcatttttttgtttgttggagacagagtcattggcttgcggccaaacagctagtaggtgtcagagtaagggtccaaacctaggcagcctgactccatagcctggggcacctaactatgttttaatccttttcctcaccacagattttaaaataagggactaataaggccttctcattaatttcggggaaacttttggaatttcctggtggggcctatagcttatagctgaaaggagtggtagaggccagggtggtggtgggcctcaggtctggtaattcccaaccaccttgtgggaggccaaagacagggaggtactggcttaagggc

SEQ ID NO: 573584 - DNA, 707 bp, Homo sapiens
  misc_feature (141)..(141): n is a, c, g, or t
  misc_feature (327)..(327): n is a, c, g, or t
  misc_feature (597)..(597): n is a, c, g, or t
ctggaaatctggtgggagcaaacgcacagtgttcatgcccatcgtccgtagaattaagttgcccctaaaaatcgtttgaaagtagggcccgtatttaccctaatagcaccccgctcgtaccacccgtcgtagagccgtaanaaaataaaaaatagagaagaaaaagaagagaacaaaaagggtgggagccggactctgagggacgcgagtgcaaaggcgttgtttcgaacactatcggagtggaggggcgcgcggcggccgccagaggagaggtgaagaggtgaacacagtggggccaaagaagtgtgtgttccctaagaggagagnactccggggggccaagagacaccaagagaggggggcgggaaatctctctcacaccaaaatataaaaaaagccccgcggggggggaaaaccggggagcggtctccggtgagacaaaatactccagagagagggggagctccgagagagaggcgccaaatccgaggggggggactctcttactacaaggggggggagccttccaaagaaggcgagagcgtcgcgaaatattcccagatatctatagcgcccccggaaacgcgggggggggtnataacagcagaagcaacaagacgcagcaaccaaaacacacgacacacaaaagaaaaaaacagacgcgagaagaaaacacaagacacaaatacaacaacagaccacagccc

SEQ ID NO: 573585 - DNA, 1038 bp, Homo sapiens
  misc_feature (10)..(10): n is a, c, g, or t
  misc_feature (12)..(13): n is a, c, g, or t
  misc_feature (19)..(20): n is a, c, g, or t
  misc_feature (60)..(60): n is a, c, g, or t
  misc_feature (119)..(119): n is a, c, g, or t
  misc_feature (1038)..(1038): n is a, c, g, or t
gtccagcatnanntccgtnngggctgtgggaggggacagcaggggcagaggcacactccncagacttacactcagtgtgggcagggggtagggtgggagcgaggtcactgcagctccancctgtgtctgtctgtccgcaggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccaaaaaaaaaacaaaaaaaaaaaaaaaaaaaaaacaaaaacacccccgggggcgctctaatgcgggggcgcggaaaacaagaggagaagcacgagaaggcgcactggtgtcaacaggggtccctgacccacgttctgtgtacaacgtggaaaacacggggaccccaaaggagaggcgaataaccgaaaacccggtaccccgtatgcgcctgagn

SEQ ID NO: 573586 - DNA, 1491 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1329)..(1329): n is a, c, g, or t
  misc_feature (1332)..(1332): n is a, c, g, or t
  misc_feature (1341)..(1341): n is a, c, g, or t
  misc_feature (1357)..(1357): n is a, c, g, or t
  misc_feature (1369)..(1369): n is a, c, g, or t
  misc_feature (1381)..(1382): n is a, c, g, or t
  misc_feature (1386)..(1386): n is a, c, g, or t
  misc_feature (1393)..(1394): n is a, c, g, or t
  misc_feature (1398)..(1399): n is a, c, g, or t
  misc_feature (1413)..(1413): n is a, c, g, or t
  misc_feature (1425)..(1425): n is a, c, g, or t
  misc_feature (1446)..(1447): n is a, c, g, or t
  misc_feature (1452)..(1452): n is a, c, g, or t
  misc_feature (1458)..(1459): n is a, c, g, or t
  misc_feature (1465)..(1465): n is a, c, g, or t
  misc_feature (1469)..(1469): n is a, c, g, or t
  misc_feature (1471)..(1471): n is a, c, g, or t
  misc_feature (1474)..(1474): n is a, c, g, or t
  misc_feature (1481)..(1481): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaaaaaaaaaaaaaaaaaaaacaaaaaaaaaaaaaaaaaaaaaaaaaaaagaaaaaaaaaaaaaaaaaaaaacaacacaaacttgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573587 - DNA, 1143 bp, Homo sapiens
  misc_feature (22)..(22): n is a, c, g, or t
  misc_feature (111)..(111): n is a, c, g, or t
  misc_feature (147)..(147): n is a, c, g, or t
  misc_feature (152)..(152): n is a, c, g, or t
  misc_feature (164)..(164): n is a, c, g, or t
  misc_feature (190)..(190): n is a, c, g, or t
  misc_feature (815)..(816): n is a, c, g, or t
  misc_feature (818)..(818): n is a, c, g, or t
gtttactactacgcgagcactnccgtttttagcgcggttgacctgagtgtactagagacgagttccgccttgtcgtctagacgctcctagctacagaggtgtgtgtctacnacctcgcgtgcgcacgtatatactctacgcctggcngggcntactgtgctgangtttatctataaaaaactgatactantacgatacgctctgaccttttcctcatcgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatttcagctgaccccagcccacctgtgaataaatgtttttgcaggaaaaaaaaannanaaaaaaaaaaaaaaaaaaaaaaaaaaaaaaaacaccaacaagaaaaaacaaaaaaagggggggggggcccctaatatattcccccgcgggggggccagacagattgacggccccccccgacttttttagtgagcaacgagggggcccccaatgagagggggaccttattataaaaacatcgacagcaggggcgcgcgcgtttaaaaccagcactgctgtggtgagggacaacagaccggacgtggtgggggactctgtggcggacagccacacccccctgcacggggggggggggcaaaaactaggtgggaccacacactcaccg

SEQ ID NO: 573588 - DNA, 832 bp, Homo sapiens
atcaatcggcgggattccattgttccagcgataaaagaatcatatgggaaagagaaagaaaatagtaggcatatagaaacactggagagtgtctaaaggggaggaaactacagagcacttggttgccacagagagcagattgacctctgctggagcccaggatcagaacgttattaattcactgtgggggggtttggcatcttaatattcttgaagagaaaagcttagaatacagtaaatcctgtaaacgccagaacttgagccttgtgtatagattttaaaagaatatatatatcggccgggcgcggtggctcatgcctgtaaatcccagcacctttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaaccccaggaagcggggttgcagtgagccaaaggtacaccacttacactccagcctggcaacagagcaagactcggtctcaaaaaaacaaaaattttaaaacaagactataaggcagtactgtaaattcagttggaattactggaatatttacccaattttcgtgtaatcccctataggtcacatttggtattaaattggggttccattgggaatttgaatgtaaatacgtaatctagtttcatataaggaagtctttaataccaaatgaaaggttttctggaataataacgtcatgattttagactggactttctcaggtgagctacataggatattca

SEQ ID NO: 573589 - DNA, 102 bp, Homo sapiens
gcctcggacaccgccatctattactgtgcgagacagacctcagttgttgtagttaccttcttagtcccaccctcttacttctttgacccctggggccaagga

SEQ ID NO: 573590 - DNA, 983 bp, Homo sapiens
  misc_feature (8)..(8): n is a, c, g, or t
  misc_feature (63)..(63): n is a, c, g, or t
  misc_feature (89)..(89): n is a, c, g, or t
  misc_feature (101)..(101): n is a, c, g, or t
  misc_feature (150)..(150): n is a, c, g, or t
  misc_feature (204)..(204): n is a, c, g, or t
  misc_feature (241)..(241): n is a, c, g, or t
  misc_feature (281)..(281): n is a, c, g, or t
  misc_feature (289)..(289): n is a, c, g, or t
  misc_feature (303)..(303): n is a, c, g, or t
  misc_feature (327)..(327): n is a, c, g, or t
  misc_feature (355)..(355): n is a, c, g, or t
  misc_feature (357)..(357): n is a, c, g, or t
  misc_feature (365)..(365): n is a, c, g, or t
  misc_feature (373)..(373): n is a, c, g, or t
  misc_feature (385)..(385): n is a, c, g, or t
  misc_feature (397)..(397): n is a, c, g, or t
  misc_feature (448)..(448): n is a, c, g, or t
  misc_feature (485)..(485): n is a, c, g, or t
  misc_feature (508)..(508): n is a, c, g, or t
  misc_feature (525)..(525): n is a, c, g, or t
  misc_feature (527)..(527): n is a, c, g, or t
  misc_feature (533)..(533): n is a, c, g, or t
  misc_feature (578)..(578): n is a, c, g, or t
  misc_feature (646)..(646): n is a, c, g, or t
  misc_feature (648)..(648): n is a, c, g, or t
  misc_feature (670)..(670): n is a, c, g, or t
  misc_feature (674)..(674): n is a, c, g, or t
  misc_feature (694)..(694): n is a, c, g, or t
  misc_feature (696)..(696): n is a, c, g, or t
  misc_feature (698)..(698): n is a, c, g, or t
  misc_feature (700)..(700): n is a, c, g, or t
  misc_feature (721)..(721): n is a, c, g, or t
  misc_feature (775)..(775): n is a, c, g, or t
  misc_feature (791)..(792): n is a, c, g, or t
  misc_feature (795)..(796): n is a, c, g, or t
  misc_feature (816)..(816): n is a, c, g, or t
  misc_feature (826)..(826): n is a, c, g, or t
  misc_feature (834)..(834): n is a, c, g, or t
  misc_feature (843)..(843): n is a, c, g, or t
  misc_feature (850)..(850): n is a, c, g, or t
  misc_feature (861)..(861): n is a, c, g, or t
  misc_feature (877)..(877): n is a, c, g, or t
  misc_feature (893)..(893): n is a, c, g, or t
  misc_feature (901)..(901): n is a, c, g, or t
  misc_feature (959)..(959): n is a, c, g, or t
gacgcgangctcggcgatggggagcggcggcgtggtccactgtaggtgtgccaagtgtttctnttatcctacaaagcgaagaataaggnggaggccccganacctgaccatcttgagtctccccgaagatgtgctctttcacatcctganatggctttctgtagaggacatcctggccgtccgatctgtacactcccagctganggacctggtggacaaccacgccagttgtgggcatgtnccagcttccaggagctgtggccgtctccagggaacctgangctctttnatagggctgctganaaggggaatttcgaagctgctgtnaagctgggcatagcctacctctacaatnanggcctgtntgtttctnatgaggcccgcncagaagttaatngcctgatggcctctcgcttcttcagtctcgctgagcggctgaatgttggtnccgcaccttttatctggctcttcatccgccctccgtngtcggtgagcggaagctgctgcnaggccgtggttcacganancctcanggcagagtgccagctgcagaggactcacaaagcatccatattgcnctgcttgggcagagtgctgagtctgttcgaggatgaggagaagcagcagcaggcccatgatctgtttnangaggctgctcatcagggatgtntgancagctcctacctcctctggnanancnacaggaggacagatgtttcanatcctgggcgatgcctccacagcttccgataactcagggactacgctgccaaangctgctgggaagcgcnngtnncttttgccaaagcctgttcnaattctaacnagcttggnctggtggtnatatctncagttatatcntttgctagctattttntgcttcccaggctgtnagttaacnacaagtcttctccgtgcagaagggactcaatgacaccaagaggtacattctgatcgantggctggtggaagttgcaccatga

SEQ ID NO: 573591 - DNA, 944 bp, Homo sapiens
  misc_feature (22)..(22): n is a, c, g, or t
  misc_feature (63)..(63): n is a, c, g, or t
  misc_feature (72)..(72): n is a, c, g, or t
  misc_feature (78)..(78): n is a, c, g, or t
  misc_feature (105)..(105): n is a, c, g, or t
  misc_feature (111)..(111): n is a, c, g, or t
  misc_feature (115)..(115): n is a, c, g, or t
  misc_feature (121)..(121): n is a, c, g, or t
  misc_feature (147)..(147): n is a, c, g, or t
  misc_feature (153)..(153): n is a, c, g, or t
  misc_feature (186)..(186): n is a, c, g, or t
  misc_feature (215)..(215): n is a, c, g, or t
  misc_feature (233)..(233): n is a, c, g, or t
  misc_feature (235)..(235): n is a, c, g, or t
  misc_feature (248)..(248): n is a, c, g, or t
  misc_feature (263)..(263): n is a, c, g, or t
  misc_feature (302)..(302): n is a, c, g, or t
  misc_feature (313)..(313): n is a, c, g, or t
  misc_feature (330)..(330): n is a, c, g, or t
  misc_feature (357)..(357): n is a, c, g, or t
  misc_feature (361)..(361): n is a, c, g, or t
  misc_feature (375)..(375): n is a, c, g, or t
  misc_feature (388)..(388): n is a, c, g, or t
  misc_feature (390)..(390): n is a, c, g, or t
  misc_feature (403)..(403): n is a, c, g, or t
  misc_feature (411)..(411): n is a, c, g, or t
  misc_feature (415)..(415): n is a, c, g, or t
  misc_feature (435)..(435): n is a, c, g, or t
  misc_feature (440)..(440): n is a, c, g, or t
  misc_feature (449)..(449): n is a, c, g, or t
  misc_feature (463)..(463): n is a, c, g, or t
  misc_feature (467)..(467): n is a, c, g, or t
  misc_feature (483)..(483): n is a, c, g, or t
  misc_feature (485)..(489): n is a, c, g, or t
  misc_feature (507)..(507): n is a, c, g, or t
  misc_feature (511)..(511): n is a, c, g, or t
  misc_feature (518)..(519): n is a, c, g, or t
  misc_feature (521)..(521): n is a, c, g, or t
  misc_feature (523)..(525): n is a, c, g, or t
  misc_feature (944)..(944): n is a, c, g, or t
ctgtagcagaaatgtttgaaanaacataagcacaatgactcccccaaagaacaagaggccaangcaaacccngcggangtggaaggaaaaaaaaataaagccacnaaaagnaaangagaanccaacagataaccaagagtctataangtgcgngggtattgttacgaaactaaacaggaggaaaangtctgcaatgagaaagcgtataagaaaanagaaaactagaatgctgncnacaaggacaaaanacctgccaaatttgncaatgcatccagtaaaagcaccaatgctgttagcctaanctagtgttgancgtaaaatcgcacaacnaaaaagcatgcatcccaaagacgcaantcanaaaaaccaaagctnggccaacaataanangaacaaaagccanaccactanaaanaaatctcaacccaagtgccncgcanaaagcgccngcaggaaccaaagnaacncataataaaaaaagtnannnnnaaaaacaatcaatacacnattnaaaaaannantnnnccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccaaaaaaaaaacaaaaaaaaaaaaaaaaaaaaaacaaaaacacccccgggggcgctctaatgcgggggcgcggaaaacaagaggagaagcacgagaaggcgcactggtgtcaacaggggtccctgacccacgttctgtgtacaacgtggaaaacacggggaccccaaaggagaggcgaataaccgaaaacccggtaccccgtatgcgcctgagn

SEQ ID NO: 573592 - DNA, 419 bp, Homo sapiens
  misc_feature (125)..(125): n is a, c, g, or t
  misc_feature (140)..(140): n is a, c, g, or t
  misc_feature (143)..(143): n is a, c, g, or t
gagtatgtgctaagtattcatataaattagagatggtataggaggggaattaggtggtttgaagattaagatgtatctattcccagcactttgggtggtggggatggggggatcacttgagcccnggagtttgagactanccngggcaacaaagtgagacttcctctctataaaaaaatacaacaacaaaataattagctggacatggtggcgtgaacctgtggtcccaactacttgggaggccgaggtggaaggctaaggtagaaagatcgtttgagctcaggaagttgaggctgcagtgagctgtgtttgtgtcactgcactccagcctaggggacagagtgaaccctgtcttcaaaaaaatacataaataaaattacaaaggggtggagacaagggtaaggaccaaagaatgtttt

SEQ ID NO: 573593 - DNA, 103 bp, Homo sapiens
aaagggatggataggctggcacttctttttgttttccctttactggacacagtctcactattgttgtctgggctgtcatgagctccggtactcaagaactcct

SEQ ID NO: 573594 - DNA, 741 bp, Homo sapiens
gaaaggaaagagaaaattgacttctgtttctcagtctagtgtcaatgttcaatgtacaggttgttactgaatgagagtatttcggaatacacattgcacaggactttgatttggggtgatgtatttgagagtatttgttggggatcgttgaccgtatgtagaaaccatctttaacactgaattgtttttgttcgcagtgtttcctctcttgaggctttctcctaccccggcagatgactgcggctttgatttggatgatagcgaaggagtttgtgatctgtttgatgtccagatactgaattattggattccatggaaacttgggactgtgtctacctctaactgtgtagcatttggacttcttgataacctaaatatttagaatggtgaatgtgacacctttttggttcactgattctggggtgttcttccctggtgctttctttgcttcacaggacttcaaccatgggggcgaagggctctgattgcttgggggatgggtgatttaatgtccacaggcgtccccactcccaagggtggctatgttctggatttcaacttttcttctggttgtggatccttctgttttttcttcttggggaggaaagtgaaggacactgcaggtcatcgggggcaggtggccagggactcattgttgtcttgtatttttaactgcactggactgctgtgttcctgtgtgtccttcctgtccgggcgacgttcgtgccactgtggactggg

SEQ ID NO: 573595 - DNA, 1427 bp, Homo sapiens
  misc_feature (239)..(239): n is a, c, g, or t
gttcacagtggggctctctacgactatccgtcttcaccgctcttcgggcgatgccgaatctactgagcgtcttgcgaatagtacagaggagatgggccggcggcgtgcgtcgatatgcaccacatagagattgaggccgatgatgctgatcgctgggctctatgctagtgcgaggcaagctcgctctctgaaccagtcggtgtccatatgccatcagctcagtggctgcatccaagatnatcgcagcggtcgtcataggacgcgagccatggggggcacagtagaggtaccttcgtgactgtgtgcgaaccactgaaggtccgtggagccacatggatcgtgcgttgcacgtggcaacgctggagagtaacgcgcgcacttcgctgcggttgcgtagtcccctgcgcgaaactggagcgtagcggaaccgttgtggagagaacaagaataattgggcgacccccaaccaggcttcttgttagcgaaccagcaagccatgccgcccgttgggccctcacgagcagtgcaggccatgcgctggctcgccgtcgactagaattcgcagcaagaagcgctccactcttgcacaacgctgcgaaatgccgcaggcaacaagcaacaaggacctgaagggtcgagtgagtgtagtgatttccgaggaacgcgtgtggacatgcactcgggtggccatgcgtgacgtttggaagccactgctaggtcccagcgcctgggagcgcgtcctaacgcccatcgtgggtggctgcggcccttcttggggcgctctggtgccaatgggaccttcgtggcgcacgacagagcgggtgtcatgccctacaaactggctggggtctggtcgtaccccgcacgggtggcattcccgtggccttctcgcgccaaccggtctgcgggtccctttggcgggtgctggggaaccccttggggtcttgggacccgggggaccctaggaagcggaagattaaccctacgaatggaaaggaatttctcctcaactttgtaggcacaaagggcttaaacccgacgttataaggcaggccatcgggttctgagatacgcgtgaaaaatttccttttcgccggaagcattcctacatggaagcaaacgactctgtgagctcccccctttcggcccgtgtgcacgtctgaagccctgtgagaatgggcgccccgggccggcaagtaccgcgcgaccttcgtccacgggagaaagaatgccaacggagcttggcccagagtggggcaaaggagttctgccccactggggattacaaccggaactcaagaggaacccgagaggagggaggacacgagcgacaccaaaccccggcggcagatggagcacctgcggggcaccccccaaaaaaacacttcaacaccccgcagagacgagacgccgattcaccccaaaac

SEQ ID NO: 573596 - DNA, 1420 bp, Homo sapiens
taggtcccgtgctgctatttggtttcttcgtttttgttgttgatggtgcgtggatttgtgtcgggtctcgtgtgctgttgctgtgctctgtgtcgtggggtgtgacctctatcttgacggctgttgttgccttgagtcggggcccagcggttgcacaaggcgcttttatgttctctcttttgtgcgtcctggtagcggccgggggggatttcgcccggggatgtccgctatgttatgggtccaccgggtaaaagtggttcccagcaccacttgttcgggaaatcccggaggttttaaataaggggggaagacaccgggttggagaaaagagcccctaaaagagttgttggcacagtggtcacccggatcttcgtccgctcctcttgatgagggcagtttctcccgcgctttttgtggataatgggtcacccctcggatatattacagggtgttgctgccggtcctgtgggtgccctgctgttttattgtatgctggggcttgtagatggggtctcctctggcggggtgtttccaccagtgttacccccacgggccctttggggccggccctactagctggcgtatattctacagctggtggtgttaggatgtgggcgccccccaaggtgatcacgagcctgcgaggcccctatacgtctatgatgagaaatactcacggaggactcttttttggcccctcggggctcgcgataatattataaggcgttgttggtgcacaaaagggggacacgtttctcccacggtaatgagagacccacccccttgtctccatttttagacacactaagagaggttatacaacaccgtgcagacacacccctcttggtggagaaagaaccacaagagaagaggtgtcacacactcgtgttggtggagttttgcacacaacacgacacgtggggagacccactgccgagagtctgtggttgtgtgtctttcttgggccctcgaccccctctgtgtgttgtcggtgaaaaattgggggggttccactctgagtctggcacttatttacaaaggggataaaagtgcacagaactgggggaaagttttatagtgcccccacaggagagaacctcgcacccaccttgtgcgcgcctcttcaacaccacaggtggagaacttcggagaatacacacaaagagcctcttttgggcttaagacttggtggaagactattcaggacccatttaccatgacagatatacgatgagattcccccgttcattggggtggcaatagtccacgggtccttaaattctttgggttcggtattcccccaggcttcgaaaaggcccaagggcttaaggacttgcccctaaactgggttctactgtgaccctgttgagttttttggacattaaaataattgaaataaaaccaattttcccttccaata

SEQ ID NO: 573597 - DNA, 1234 bp, Homo sapiens
ggtcatcatccgtaaagggagagaccactatgcctactcctactacccgaagccggtgaacatgaccgaaggcctacctgtcgacatcatactcgccagtgagaagacgagcacatgatgtatgctgccgtgtgatccgcgagctatctacagaccatgagcatccctgcaggaggactgatgcggctgggcctgctccttcatggagcacccattgtgctactagacaccctccgtgaggatgaccaggcgccaggactgcgtgtggtgtctacattgaagtgcgcatgcctatgctcatctcattggtagtgtgcgcctcctcccgacgggtcagtccccatagctgcgctcggggtacaaggggcttccccccattagcgcacaccgtgaggacaagtcttgtcaagcccttgcctggtatgcgcgttgatcagcagtgaacactttccttgtcacgtcactcagttcacagccaatgagttgacactgacctgggccctggagagggtttaccggggcttgcatacggcacgggaggtagtcgaagacgccttacttctcgaaagggcttggggactgctcgacgaatacgacacgaaaggaccaacggtccaaagcgtgcacgcccgagctaagcgaagctcaattgccgttgccctattgatcctggtacccgacgtgaaacttgcaaccccgattgctgcgtggagaccccaagtggccggactaattgcacaccttagcatagaataggttgaccacagatggtcaaaacctacgttcaataagccactccaaaggggcccgaacgcctgagactggtctagtgagcttcttggccgatattggcagttggcacgggaggctacgtgattaccacgcatcggtccactgattcgacccaaaattcggtcagaaggtgggacaggggtggaacatgctctactgggtaatggcccgtgacagccatcacgaaacctaactgggggacaacacagaattaattgaggttaacaacaggaaagacccaaggggccgaaaaaattgggtgccggcagaactgacttggaaacagagcaagggacaacttgacgtcggaacaggggtccccccgaatacccgtacagacacgatagtacaacaatcgtggtcgacaaaaagtacagcgagccgtcacgataatacaagagaggatagcacaacccacaagaacaaggagcaccacgacact

SEQ ID NO: 573598 - DNA, 268 bp, Homo sapiens
atctggccgacttccctaacaacagctgctcccacatcccctcggactggagcttaagccctaactaaggtgggcagacctaagacctaagaccaaaagattagttaagtgtcttacaagcatctagccactgtccagggccaagagcatacaagtcttgcagtccctttagcaagagcaagcagttgccctgtactgtaccaccaaattgtcaaaaaccccttgcagttagcaagaggtaggcttacctctttactagggattatcg

SEQ ID NO: 573599 - DNA, 556 bp, Homo sapiens
ttgttcttaattgctttccaggggtataacaatatccatctactacacagtgattgagtattagctttgacctttttaagcccttacaatcccacaaaaagcctattcgtagagccatagtcaacacatttggttatattgcataggccattggccctcatgatgtattggctacacttctgaacaacctcaaagttcaagaaaggcagaacagagtttgtaccactgtagcaatagctattgttgcagaaacatgtacaccctttacagtactccctgccttaatgaatgaatacagagttcctgaactgaacgttcaaaatggagtgtaaaaatcgcttaccttcttgtcggaatatattggtgaaatgggaaaagactacatttatgcctgttaacaccgttacttgcacgatcccttacatgcatacgagaccttgtacaccgacagacggctagtgcagtggtacggcacatgtcacttggggttcatggatttggttgtgacgcttcgctcgatcacttgtcgccctatgtttggcccaatgtgtttgag

SEQ ID NO: 573600 - DNA, 329 bp, Homo sapiens
ctgaatgatattccagtatgtgtatatactacattttgtttttccattaatctgatgagggatatctgggttctttccgccctttggtgactgtggataatgttactatgagcattactatataaataactgtttagtccctgccttcgattcttttgcatatatacgcagaagtagaattgctggatcacatagtaattcactgcttaattattggaaactgccatactgttttccacagcagctgtaccactttacattcccagcaaaaatgcacaatggttccaacttctctcacatccttgccagcacttgtttcctgctttaaa

SEQ ID NO: 573601 - DNA, 785 bp, Homo sapiens
  misc_feature (36)..(36): n is a, c, g, or t
  misc_feature (91)..(91): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (114)..(114): n is a, c, g, or t
  misc_feature (187)..(187): n is a, c, g, or t
  misc_feature (221)..(221): n is a, c, g, or t
  misc_feature (272)..(272): n is a, c, g, or t
  misc_feature (291)..(291): n is a, c, g, or t
  misc_feature (297)..(297): n is a, c, g, or t
  misc_feature (303)..(304): n is a, c, g, or t
  misc_feature (333)..(333): n is a, c, g, or t
  misc_feature (431)..(431): n is a, c, g, or t
  misc_feature (479)..(479): n is a, c, g, or t
  misc_feature (481)..(481): n is a, c, g, or t
  misc_feature (519)..(519): n is a, c, g, or t
  misc_feature (553)..(553): n is a, c, g, or t
  misc_feature (555)..(555): n is a, c, g, or t
  misc_feature (588)..(588): n is a, c, g, or t
  misc_feature (625)..(625): n is a, c, g, or t
  misc_feature (639)..(639): n is a, c, g, or t
  misc_feature (656)..(656): n is a, c, g, or t
  misc_feature (661)..(661): n is a, c, g, or t
  misc_feature (663)..(664): n is a, c, g, or t
  misc_feature (667)..(667): n is a, c, g, or t
  misc_feature (682)..(682): n is a, c, g, or t
  misc_feature (706)..(706): n is a, c, g, or t
  misc_feature (708)..(708): n is a, c, g, or t
  misc_feature (724)..(724): n is a, c, g, or t
  misc_feature (758)..(758): n is a, c, g, or t
cgggctgcagccgccctccgcgctcgcctgccagcnccctcgccgcgcgtccgtcctccgtcctcccgggccagccagccagccagccagncgggccggnggcgngnancaggncgtcccgatgcccgagccaggccccaggatgaacggcttctcgctgggcgagctgtgctggctcttctgctgnccgccctgcccgagccgcatcgccgcaagctggncttcctgccgcccgagcccacctacacggtgctggcgccggagcagcgcgncgccggcgcgtccgccccngccccngcccannctaccgccgccgccgccgcggcccagccngcaccgcagcagcccgaggagggcgcgggcgcggggcccggtgcgtgcagcctgcacctcagcgagcgcgccgactggcagtactcgcagccgcagcntggacgccgtcgaggtcttcttctcgcgcacggccccgggaacaaccngnctcggctgcatgttcgtgcgctgcgcgccctccagccngctacacgctgctcttctcgcacgggcaaacgcncngccaaccctggcgcccagaatgctgcagccttnctacaattgcgccctcgcgcctcccgccaatcaaacntgcaaacaatcttnctccctaacgcactacntcggngnntanggcgctcagctcggngcaaagcccctccgagcaaagaancntctacgccgcacaatngacgcccgcgctggcaggcgcctgcgcacccggnctatggcgctgagctcccgagaacatt

SEQ ID NO: 573602 - DNA, 429 bp, Homo sapiens
cccagactccttttccttggccagaaggccgaagaccaactggcctactggaatgggccacttttggaatcggaatcaagcctttccgtttctggaattcctctctgtaagggagatttttatggaaagggaataattccagggaaaatggacccttctaagggatcccaccagggaaaacttggttatggaggaatccaaaacccttaattcggaggatatccctaaggcttggaaagagaaaggacccacaggggtggcccacctgaaccagtttaagccagaaccggacccaatggggaaaaggttggaggatccagaacctccagggcaaaggcagccacccagggatggaagaaggctcttggcctacctgccgaccaagcatggtttaagccaggattattaagatccactttacggatatcc

SEQ ID NO: 573603 - DNA, 743 bp, Homo sapiens
  misc_feature (36)..(36): n is a, c, g, or t
  misc_feature (91)..(91): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (109)..(109): n is a, c, g, or t
  misc_feature (114)..(114): n is a, c, g, or t
  misc_feature (187)..(187): n is a, c, g, or t
  misc_feature (221)..(221): n is a, c, g, or t
  misc_feature (272)..(272): n is a, c, g, or t
  misc_feature (375)..(375): n is a, c, g, or t
  misc_feature (423)..(423): n is a, c, g, or t
  misc_feature (425)..(425): n is a, c, g, or t
  misc_feature (463)..(463): n is a, c, g, or t
cgggctgcagccgccctccgcgctcgcctgccagcnccctcgccgcgcgtccgtcctccgtcctcccgggccagccagccagccagccagncgggccggnggcgngnancaggncgtcccgatgcccgagccaggccccaggatgaacggcttctcgctgggcgagctgtgctggctcttctgctgnccgccctgcccgagccgcatcgccgcaagctggncttcctgccgcccgagcccacctacacggtgctggcgccggagcagcgcgncgccggcaccgcagcagcccgaggagggcgcgggcgcggggcccggtgcgtgcagcctgcacctcagcgagcgcgccgactggcagtactcgcagccgcagcntggacgccgtcgaggtcttcttctcgcgcacggccccgggaacaaccngnctcggctgcatgttcgtgcgctgcgcgccctccagccngctacacgctgctcttctcgcacggaacagccgtggacctgggccagatgtgcagttctacattggcctcggtcccgatcaactgcaacatcttctcctacgactactcgggatacggcgtcagctcgggcaagcctccgagaagaactctacgccgacatcgacgccgcgttggcaaggcgctgcgacacccggtatggcgtgagtccgagaacattatcctctatggtcagagcattgggactgtccccaggtaagatttggcttcgaggtaatgatg

SEQ ID NO: 573604 - DNA, 144 bp, Homo sapiens
ctgtggtttgcgcggaatcgggggtatgtctgttcgaattcatatgaacagggaggttaggaagcaggtcttggtgaagagctgcaaaccagtatccgctgtcaaaccagttatcgtgcaacgcaataccgctgctaaccagta

SEQ ID NO: 573605 - DNA, 272 bp, Homo sapiens
tgtctggcgtctgtccggcactgcccgcctctcctccaggtaggtccttctggctgttccagtactccgctgcaggccgccccagctccgtcaccgcccggaactctcccacgtcgctgtcgaagcgcgcgtactcctgtccggttgtagatgtatctctccaggatagcgctgtgtcccattaaacgcgtagcattcctgccgtaactagtacacgtaattctctggagtggccctgccctggaccacagatgtgagcagcaccaccagga

SEQ ID NO: 573606 - DNA, 367 bp, Homo sapiens
taaatttggcccatctttttttagtcttttgattcaaattcaaaacttaacagcccaaaccaggtcagagttcctttcggttagaatttattgccctttattcctttttataaatttctatagattaaacggttatttttatgttattggcctaaagccacacgtatatgggtttgtcctgagtccgttttcaaatgcccttgtgatagggaaatggttttgtccatgtttttggaaaaacttgggtatgtccaaaaggaagggagggattttttttttccaaagtaatttatgatttttaattttttaatgggccttggatatgggccaaatgatggaaaaaaaccagtaaactttttgtttttta

SEQ ID NO: 573607 - DNA, 280 bp, Homo sapiens
  misc_feature (40)..(41): n is a, c, g, or t
  misc_feature (48)..(49): n is a, c, g, or t
  misc_feature (54)..(54): n is a, c, g, or t
  misc_feature (59)..(59): n is a, c, g, or t
  misc_feature (63)..(63): n is a, c, g, or t
  misc_feature (71)..(72): n is a, c, g, or t
  misc_feature (84)..(84): n is a, c, g, or t
  misc_feature (93)..(94): n is a, c, g, or t
  misc_feature (96)..(96): n is a, c, g, or t
  misc_feature (98)..(98): n is a, c, g, or t
  misc_feature (111)..(111): n is a, c, g, or t
  misc_feature (117)..(118): n is a, c, g, or t
  misc_feature (178)..(178): n is a, c, g, or t
tactagtgaccaggagtggacagcatgcctcactctcccnntacaagnncgggnggctnattncgggtgtnncttgtgattttntcccagccnncntnccagctggactgncttttnntggggaacacgtggacgtttgtgttagaagctccagtcacatccttcaatcccaagcttnttttccatggtgaattacacaggcagtgttttccaaaattgtcattgatcagtacaggcccagagagacactctgacaacccgtcgctattttcaggatccg

SEQ ID NO: 573608 - DNA, 946 bp, Homo sapiens
  misc_feature (2)..(2): n is a, c, g, or t
  misc_feature (4)..(4): n is a, c, g, or t
  misc_feature (28)..(28): n is a, c, g, or t
  misc_feature (31)..(31): n is a, c, g, or t
  misc_feature (44)..(44): n is a, c, g, or t
  misc_feature (54)..(54): n is a, c, g, or t
  misc_feature (104)..(104): n is a, c, g, or t
  misc_feature (136)..(136): n is a, c, g, or t
  misc_feature (143)..(143): n is a, c, g, or t
  misc_feature (155)..(155): n is a, c, g, or t
  misc_feature (180)..(180): n is a, c, g, or t
  misc_feature (214)..(214): n is a, c, g, or t
  misc_feature (249)..(249): n is a, c, g, or t
  misc_feature (264)..(264): n is a, c, g, or t
  misc_feature (268)..(268): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (472)..(472): n is a, c, g, or t
  misc_feature (503)..(503): n is a, c, g, or t
  misc_feature (581)..(581): n is a, c, g, or t
  misc_feature (587)..(587): n is a, c, g, or t
  misc_feature (594)..(594): n is a, c, g, or t
  misc_feature (605)..(605): n is a, c, g, or t
  misc_feature (689)..(689): n is a, c, g, or t
  misc_feature (691)..(691): n is a, c, g, or t
  misc_feature (702)..(702): n is a, c, g, or t
cnanagtgggacagggttttaaccacanatnggggcggcatgcnattcctagtnacttgctggacagtattttttcataattacaggaagtttttatttttaanactgggtctggggtatatttatttgccccatnacctctntctaaaggcccnagtcctagggctgccatggtgacanggagactgatgctcctttagattgtttctctggngccgacatagtgtgggacaaagagtcacctagaangcatccttggtcatnattntctccttcccgcctggccgagagaggcttgaatcccagttgtttctccngntntcacctcccccaggaggtcaggattccactgacgtcctgggcagccagtgaatttaattttccatgagaaacgacagagttaacctgtggcattaggagacctacttcatgtggaccctttttttccttcagtttaacttttctggagcantgtgctgcgtagttcggcctgagtttgtgcngcttgtttaaaccactcttgtgtacgctatgttgaagctcaacaaaagagtcatgggaccacttctagaaatctttcngctttnaggcctnttaatctcatnacagtttgttggttgtgccaaacactttatttgggaaaggaaagcccagatttgaatgggtctttcccctgggccttatcctananaggcatttgtnatatggagaaaataatttttcatttttgctcatttaattctataaattctctttataaaggaaatttgtggtcttaagttctccttaaaagacctttggattaataaaattaaaatccttacctggccgaatggtggctgcagatgatggtggtggaaaaccgggatcattgacccctgtgcttccattccctagagaggtttaatagttacatgagcaaaagctgttgccccaaagtgatggc

SEQ ID NO: 573609 - DNA, 1476 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaaccgcaggtagttcaggccgggtctggctgtggtcttcccccgtaggaaatggcggggagctccaggggacccaggcgccgtcgattcggcggagcctgggttgaccagccaggacaggggggtaaacccgaacaattctgcgcgaggtagggaggccaggcgtcggaagaaatggtctccggggtgaagtcggctggtgatggcctaggagctggactgacgaagcgaagactcgactcccaggtcagaa

SEQ ID NO: 573610 - DNA, 932 bp, Homo sapiens
  misc_feature (630)..(630): n is a, c, g, or t
  misc_feature (779)..(779): n is a, c, g, or t
gagggcctacgcgtggctcccgggcgctacgtgttcgacagacttgaaccgcgaccttgtggcctcagccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573611 - DNA, 867 bp, Homo sapiens
  misc_feature (841)..(841): n is a, c, g, or t
gctgggtatgtccaaaccccgtaaactgaaatattgctttgtaccttatatggtgggtacctggggttgttccattatagaccgtctttcttcccattgtgtagaggatccatccagtgtggagcgtgccttgtgtcgcagattttcgaaagaggtcatagccttacatacccgtgttaactatgcctcccccatagtactctgagacgaattgtgcactctggtgttcccctttacattaaggcccgtcttcgtagaacaattcttcattatgactgtggaaaagccctgtcttgtaggcccgcccgagagctttctgttgttgaacttgaggagcctagtatatacttagcctattatttgagcactaagggatattttcttgctcttagtcttaataacgtggtatggcagctgatacacctgaaggcccccaaatagcataccttgtgctttaactatcgctctgaatagcctgttttcaaattgtgccattttgtgtggaatctttgagaaaattataagagccaaatagtcatacatgacctcggttgggtgagacgacacaacacattttatcgacgactctttggaatttacttgtagaccactcgcccaagatagcttattccttgggaccataagttatgaaaactcatgatcaagatatatgtgtatacatacagtgtatctggtttgtcaggtctaacaaggctaggctgcaaaattaatatctagacattcttttaatgccaccacacgtgtctccgcttctctgcttttaaagtatttataaaatataattgtacattttgtaaaatattatgtgtgatttctatcncttgtcatatcactgtataccagtcg

SEQ ID NO: 573612 - DNA, 957 bp, Homo sapiens
  misc_feature (655)..(655): n is a, c, g, or t
  misc_feature (804)..(804): n is a, c, g, or t
ggacgcgtgggtcgacggacgcgtgggtcgacccacgcgtccgcgccatcttgacccacgcggtcggacccacgcgtcgcggacgcgtgggtcccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573613 - DNA, 155 bp, Homo sapiens
tcctcctcctgtaaatgacgtgattcatctcagaaggtaacacatttccagcaccagctcaagatatattacacagtataaccccttctgggaccttcacatttggtctgactaatttgactattatccctcctcctcctgtaatgcactagaat

SEQ ID NO: 573614 - DNA, 915 bp, Homo sapiens
  misc_feature (753)..(753): n is a, c, g, or t
  misc_feature (756)..(756): n is a, c, g, or t
  misc_feature (765)..(765): n is a, c, g, or t
  misc_feature (781)..(781): n is a, c, g, or t
  misc_feature (793)..(793): n is a, c, g, or t
  misc_feature (805)..(806): n is a, c, g, or t
  misc_feature (810)..(810): n is a, c, g, or t
  misc_feature (817)..(818): n is a, c, g, or t
  misc_feature (822)..(823): n is a, c, g, or t
  misc_feature (837)..(837): n is a, c, g, or t
  misc_feature (849)..(849): n is a, c, g, or t
  misc_feature (870)..(871): n is a, c, g, or t
  misc_feature (876)..(876): n is a, c, g, or t
  misc_feature (882)..(883): n is a, c, g, or t
  misc_feature (889)..(889): n is a, c, g, or t
  misc_feature (893)..(893): n is a, c, g, or t
  misc_feature (895)..(895): n is a, c, g, or t
  misc_feature (898)..(898): n is a, c, g, or t
  misc_feature (905)..(905): n is a, c, g, or t
ggacgcgtgggtcgacggacgcgtgggtcgacccacgcgtccgcgccatcttgacccacgcggtcggacccacgcgtcgcggacgcgtgggtcccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaaaaaaaaaaaaaaaaaaaacaaaaaaaaaaaaaaaaaaaaaaaaaaaagaaaaaaaaaaaaaaaaaaaaacaacacaaacttgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573615 - DNA, 299 bp, Homo sapiens
aggggccaagactcccgctctgcctcgccagttttttttccttccaccggtgcctcaatcacccctttcaagacaccctgcctattcgggcggctcctgaggggtccagccactccgggggcaagagccctccaccacagggtccctggaacccaaagcatgcaaggcaggggcggcgtagggaggcccggggaccaagacccctcctctaccgcggcaggtttttttctaccacctgtgccttgacctcccctttcaggcctccctgacgctttgggcggccgcagacggggcgcgca

SEQ ID NO: 573616 - DNA, 1242 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1212)..(1212): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcacacattanggaggggatccttctagagtcgccccgcct

SEQ ID NO: 573617 - DNA, 1282 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgagacccaccttgctcataaacaaaatgcccatgtgtcctctgcctggacctgtacactcggccacaaataacaaggaccgag

SEQ ID NO: 573618 - DNA, 884 bp, Homo sapiens
accactgaagaatctggctgtcgccatggtccgccgccccgaccgtagttaccggtattgtaatcaatcaaggccgatacccaaagtctcgcttgctgccgaggtgtccctgatgccaacattcgcattttggacctgaggcggaaaaaggcgaaaagtggatgactttccgctttgtgccacatggtgtcagatgaatatgagcagctgttctctgaagccctggaggctgtccgaatttgtgccaataattggtacatggtacaaagttgtggcgaaagatggtttccatatccgggtgcggctccaccccttccacgtacatccgtgatcaacaagatgttgtcctgtgctgtgcgctgatcaggctccaaacaggctctgcgatggtgcctttggacataagccaccaggctcactgtgcggccaggcttcacattggtctaaggttatcatgttccatccgcaccaggctgcagacaattcgaagggatcatgtgattgaggccctgcgcagggtctaagtctcaagtttcctggtcgccatgaatatccacatctcaaagaaagtggggcttcaccaagtgcaactgctagatgaatctgatgacctggtgagctgataagcggttcatccgcagatggcttgtaggggtcaacgtacatcccccaactcgtgcgcccttctggacaacgttggtgggccttgcactcatgagggcttcgatgtgctgccccctcttaatactcacataaatctactttctgtcccctaaaaaaagacaagatacccaaaaggggcgcggtcaatacccccgggggccacgtttctcccccttttttcacaggcccataaacgaaaaaaaaagggacccttaacagga

SEQ ID NO: 573619 - DNA, 1383 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1268)..(1268): n is a, c, g, or t
  misc_feature (1283)..(1283): n is a, c, g, or t
  misc_feature (1285)..(1286): n is a, c, g, or t
  misc_feature (1288)..(1288): n is a, c, g, or t
  misc_feature (1298)..(1298): n is a, c, g, or t
  misc_feature (1302)..(1302): n is a, c, g, or t
  misc_feature (1309)..(1309): n is a, c, g, or t
  misc_feature (1312)..(1312): n is a, c, g, or t
  misc_feature (1315)..(1315): n is a, c, g, or t
  misc_feature (1323)..(1323): n is a, c, g, or t
  misc_feature (1327)..(1328): n is a, c, g, or t
  misc_feature (1330)..(1330): n is a, c, g, or t
  misc_feature (1334)..(1334): n is a, c, g, or t
  misc_feature (1336)..(1336): n is a, c, g, or t
  misc_feature (1339)..(1339): n is a, c, g, or t
  misc_feature (1350)..(1352): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaataaaaaaaaaaaaaaaaaaaaccccggggatttttttgggggggggaaaaaggggtntggaaagggccgggntnnanggtttccggncccnatttttnggnacnaggggganaatnngngggncnccntaagggggggnnnaattgaaaaagccggggttaacctgtttatg

SEQ ID NO: 573620 - DNA, 161 bp, Homo sapiens
gatctaatcgagctctgtacctctcatggaactgagtacacagtacatttgttatagtagattttattagtgattaggaaaaatgataagagattgacatctttcaattgacatagatgccaatcattttaagtattattttttaaacatctttgattctt

SEQ ID NO: 573621 - DNA, 1543 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcggctacaaaaaaaaaaaaaaaaaaaatacaaaaataaaaaaaaaaaaaaaaaaaaaagaggggggggcaaagaaaatttacctcaggggggggcgcagatatttaggaggggtaagcggttttttgtggaaaagggcggccccaataatggaggagatattataatagagagggacggagcgatttatataaagcgctagtgagtggaaaaacgtgatcgtgggcatgtggaagaacgcccttttggggggggaattggagaacatgtaagagttaagcgtggagaaataacgtaggtgatgtgtaaggtaatgtgtgagagtgtaggatttaaataggg

SEQ ID NO: 573622 - DNA, 539 bp, Homo sapiens
ggcacgagctcttacatcagtgcaggggaagtttatccaagtagcagtttcccggggattataaaaatccccgaggcattggtctgggtgtggcgccttttttgggtggtgttttttcacgtccctcccctcccctttctccataaacaagagaggcattaactgggaaggtccgtggaaagtctaagaagcggatgggggtaattggccggccttccctttagttggaacagcgtttactcgggaagaggtcaggggcctttttctgggtggtgatttatgcaagtgttatctgaaggcgagtggagtgagtttacgtgggattggctgttggccaccggtggtggtgcgggctccttccttccggggatgagttccattctctcccggtcggccaggagtgaggctccccagccagagcagtcccccgtgtgcttatccccttccttcgtaaacggcagccattggtgattttccataaccacttttatagacacataataatttcctttgaatcagtttgcatcttaaattaagtt

SEQ ID NO: 573623 - DNA, 959 bp, Homo sapiens
ggagcccactcaaggggatgaggaggtttaagccacaagtggtggctaaataaaagcttagtcagagctgggcacggtggctcgcacctgtgatcccagctacttgggaggctgaggcaggagaatggcttgaacctgggaggcagcaggttgcagttgggctgagatcgcaccattgcaactccagcctgggtgactgagcgagactccatcccaaaaaaaggaccacaaataaaaggggtttaagccagagatttggggagtttgcaggcaaaaaacccttttctggtggcgggggttgggcacattaccgggcctaagggaggcaggggaagacccattagagctcttcctgggaggcaggtgggccaccaggcgaacaagcgaatataaccttgtgggccctttaagggggcacaacctcatagtcggacaactggatctacagcggagaggttaactcactacagaggacggttccccacaggttacacatattaaactcatatacgcgaattattctaatattactcgtagcctaatatagggataacgaaatatcttgtcaggatcggttcaacccaacctaagggctaatcaccctttaacatactcgttggacaattcaaaaggagagttgcgggccaagaaaacagggttggaagataacggcgcttgactctaaattaggccaaaagctgttgggcatttctacaatctgaagccgttaatagaaagagagcctccataaattaacgaacggtttggtaccctgtggtggctcttggcggcaccgacagcggcgaaacagacctcacgtggagcagggcatcacgcgggaccccattttggagcactgtgaagcactgagacaggttcagacgtgtgtatgggacccttctaacaagaaaacaaaaaggggcgggcagggaactggggcggagctagtattgatcgcg

SEQ ID NO: 573624 - DNA, 1357 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaagaaaaataaaacaatacactctcactatacaaacctaaacaaacggcccaattcaattctaaattcggagcagccttatttttggcggcccaattttggactcacttgggccatttcgccttaaagggggtcgtttaacaattac

SEQ ID NO: 573625 - DNA, 604 bp, Homo sapiens
  misc_feature (269)..(269): n is a, c, g, or t
  misc_feature (347)..(347): n is a, c, g, or t
  misc_feature (375)..(375): n is a, c, g, or t
  misc_feature (396)..(396): n is a, c, g, or t
  misc_feature (412)..(412): n is a, c, g, or t
  misc_feature (449)..(449): n is a, c, g, or t
  misc_feature (457)..(457): n is a, c, g, or t
  misc_feature (513)..(513): n is a, c, g, or t
  misc_feature (526)..(526): n is a, c, g, or t
  misc_feature (586)..(586): n is a, c, g, or t
ctggtatcccttcctcttttaataagggcactaatcccaccaagggctccatcctcataatctcgctaaacctaattacttccccaaagcctcacctcctaataccatcacatgggggattagggcttctttaactttttaacttttaagttcagaagtacatgtgcaagtttcttatgtaggtcttgtgttgtggggtttgttgtacagattatttcattacacactcttaagcccagtacccattcgttattcttcctgatcctctntctctaccctccaataggccccagtgtctcttgttcccctctatgtgtccatgcgttctcatcatttagctcacactngtaagtgagaacatgtggtatctaggtntctgttccttcattagtttgntaaggataatagcctncagctccatccatgtttcctgcaaggacatgatctcnattctttntatggctgcatagtactccatggtgtatgtaccatattttatttttcaataccaantgatggcatttangttgatttcaagtatttgctattgcgagtagtgctgcagtgaacatacatgggatatatncttatgatagcgatttgt

SEQ ID NO: 573626 - DNA, 1494 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1332)..(1332): n is a, c, g, or t
  misc_feature (1335)..(1335): n is a, c, g, or t
  misc_feature (1344)..(1344): n is a, c, g, or t
  misc_feature (1360)..(1360): n is a, c, g, or t
  misc_feature (1372)..(1372): n is a, c, g, or t
  misc_feature (1384)..(1385): n is a, c, g, or t
  misc_feature (1389)..(1389): n is a, c, g, or t
  misc_feature (1396)..(1397): n is a, c, g, or t
  misc_feature (1401)..(1402): n is a, c, g, or t
  misc_feature (1416)..(1416): n is a, c, g, or t
  misc_feature (1428)..(1428): n is a, c, g, or t
  misc_feature (1449)..(1450): n is a, c, g, or t
  misc_feature (1455)..(1455): n is a, c, g, or t
  misc_feature (1461)..(1462): n is a, c, g, or t
  misc_feature (1468)..(1468): n is a, c, g, or t
  misc_feature (1472)..(1472): n is a, c, g, or t
  misc_feature (1474)..(1474): n is a, c, g, or t
  misc_feature (1477)..(1477): n is a, c, g, or t
  misc_feature (1484)..(1484): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcggctacaaaaaaaaaaaaaaaaaaaaaaaaaaaaaaaaaaaaaacaaaaaaaaaaaaaaaaaaaaaaaaaaaagaaaaaaaaaaaaaaaaaaaaacaacacaaacttgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573627 - DNA, 327 bp, Homo sapiens
gagaaaacatatatatatagtttcttttaattgatcaggtctaataaatgtgtactaaaaaaaatcagagtatatttaataaagcagaatagtttatttaaagagaaggtctcttccttattgatatcatggtatgcattaattccatttgttactattgtgcacaaaagccctgttcacaggggaatggtgtaaacatttatcctgttttgtacactgtatttagtagacataactgttgaatagttactgaatcatgatgtaaagaatatgtgaccatcttcaggtatgggatttctgaccgtttcaaatttcaatcaatgagca

SEQ ID NO: 573628 - DNA, 843 bp, Homo sapiens
  misc_feature (365)..(365): n is a, c, g, or t
  misc_feature (490)..(490): n is a, c, g, or t
  misc_feature (556)..(556): n is a, c, g, or t
  misc_feature (571)..(571): n is a, c, g, or t
ggagagcgggaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagataatttcttctcatccttcaagatttaacatattggataatatacaaaagctaatgttgttcctgaattaataattctcttaaacaataagcttaaaaggaaancatgcaggatttaacctttctaagagataggaaagaaaatgtgaataaatggagaaacatattgtgatcaggattggaaaaattgactgcaataacagatgtgaaatatctccaagtttaaagcntttaatataatcctaggcaaggttactatatctctacctgtctacatacacaaatatgtataaatnatgtttaactgaacntttattccaaagttcatctgaaagaataaacattcaagatagggtttgaaaagttctgaagaaaaaaagaagaacgaatagagatttgtccgtgtctgatgttaactaaattgaaagtgttctactccgtttaagctgatgggtaggcacatgatgccagccaagccgtccttctgtattacctgtgtttgccgatcattttttattacacatgaatcaacactggatagaatttttcaactgtttggagggaaaaataacttctccatcag

SEQ ID NO: 573629 - DNA, 121 bp, Homo sapiens
  misc_feature (118)..(118): n is a, c, g, or t
ttatgagcatgggcagatcatacaaaactcctccctgtgcctaagcatcgaggcgtacgtggaagacgggagtgagtgggtgtgtgccggcggtgctggggctactgggcgagcagantca

SEQ ID NO: 573630 - DNA, 840 bp, Homo sapiens
  misc_feature (362)..(362): n is a, c, g, or t
  misc_feature (487)..(487): n is a, c, g, or t
  misc_feature (553)..(553): n is a, c, g, or t
  misc_feature (568)..(568): n is a, c, g, or t
aaggcagttcacttcagcagtgtgagcgtcaactgagtggcttggtttggaagtattgtttgaacaagtatcccaaatcataagtttctgatgatcagcaactgacccaaacagagacttatggaacagatgccaggaaacatcttctactactactgtatgccctgtaaagatggtctttgcatccaccacatttccctcctttggaacagcactgatgtcccacgggtagatggtgtgatcatctgaagcactaaataatttcttctcatccttcaagatttaacatattggataatatacaaaagctaatgttgttcctgaattaataattctcttaaacaataagcttaaaaggaaancatgcaggatttaacctttctaagagataggaaagaaaatgtgaataaatggagaaacatattgtgatcaggattggaaaaattgactgcaataacagatgtgaaatatctccaagtttaaagcntttaatataatcctaggcaaggttactatatctctacctgtctacatacacaaatatgtataaatnatgtttaactgaacntttattccaaagttcatctgaaagaataaacattcaagatagggtttgaaaagttctgaagaaaaaaagaagaacgaatagagatttgtccgtgtctgatgttaactaaattgaaagtgttctactccgtttaagctgatgggtaggcacatgatgccagccaagccgtccttctgtattacctgtgtttgccgatcattttttattacacatgaatcaacactggatagaatttttcaactgtttggagggaaaaataacttctccatcag

SEQ ID NO: 573631 - DNA, 417 bp, Homo sapiens
tgctgattgccatggacaagaccgggtgaggtcacaggggagacaagtctgtgtcaaaccggctatcgtcggagatgcgtggcgtggcacgggtcttatctacatcccatagactcaggccgagaccccatgtcagaatctttccagagataaacctgctgaaaattggtaaaggtgtcttgagttccttctaagggtgtcagactcttgatgaactcctggtctccaagacgcaatatcacctggtggctctcctggtcatatgtcacaccaggacatgtagcattagcccaggcttcagagggatccatccagtctttgacattacaaagcaggacactgggtgagctcagcaacccacagatgatggcaccctttttcaaatacacagctggagaatcttgaccatggctcctc

SEQ ID NO: 573632 - DNA, 917 bp, Homo sapiens
  misc_feature (844)..(844): n is a, c, g, or t
ggagagcgggaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacaagctttgataaatgtaattaaagtgtctgaattggatggcagaaaaatgggagatgcccagcctgaaatgtttgacaaggtgttagtgggatgctccgtgttcaaatgatcgaagctggttgttttcttctggactcttcaggaagggcatcctgttagggatnaagttcaaagggagggaattttgcctctttcttacaggttaggaggctgtttaagggtcttgccatttaaggg

SEQ ID NO: 573633 - DNA, 1091 bp, Homo sapiens
  misc_feature (974)..(974): n is a, c, g, or t
ggagagcgggaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacaagctttgataaatgtaattaaagtgtctgaattggatggcagaaaaatgggagatgcccagcctgaaatgtttgacaaggtacttttattacattgtgacaaactgatggacgcccagtaataccactattatgttgctttgtggttgttattttccatctgttctcagacatagcctgatacagtttctcagtaccctggaaaattttgataaagtgaacatggaagcagttttcatttgatggtcagcatggttcaaaggaagcagtaacattgggattgaggattatagantgttttatattggcaggtaactcaaagatactcaggaaaagatcggatattatttgggtcagtactgtattgctttaattcagtaacatttcatatcagagtatggacagttgaaga

SEQ ID NO: 573634 - DNA, 115 bp, Homo sapiens
  misc_feature (21)..(21): n is a, c, g, or t
tgcagcagacaacagcacacnttatgttcatgtggatgttaaagccaacaagcaccagttaaacaggctggttctggagctgctgaggaaagagcgggttcacaggtaaataccc

SEQ ID NO: 573635 - DNA, 1538 bp, Homo sapiens
  misc_feature (733)..(733): n is a, c, g, or t
  misc_feature (1465)..(1465): n is a, c, g, or t
ggagagcgggaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagagacacgtccttgatatgttttccagtctggtcttgaactgggaaatgatcctctcgcctcgtccctgcaaagcatgagccagctggagtacagtggcgcgatctcggctcactgcaacctccacctcctgagttcaagcgattctcccacctcagccccctgagtaggtggggttacaggcgcccaccactactctcggctaattttgtatttttagtagagacgggtttcccgtgttggccaacctggtcttgaactccagacctcatgtgatcctcccgcctctgcctcccacagtgctgggattacaggtgtgagccacctgcctagcccctacagtgactttttaaaattaatttgttccttttgacagtttcttcagccccagtagattctgttttaacctttgcttcacatttggaaaataattatttggaaaaaccttgctttttcataattagataatgtacagttttggtacatgtaaggtattgttccatttcaagaactagtaattatccaaaaaaagtgttcttgtcttaaaaaaagaccttgctaatgttgacgttcagtaaattgtantatcactgtgtgtcagcaactttttcttatcgtcatagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacaagctttgataaatgtaattaaagtgtctgaattggatggcagaaaaatgggagatgcccagcctgaaatgtttgacaaggtgttagtgggatgctccgtgttcaaatgatcgaagctggttgttttcttctggactcttcaggaagggcatcctgttagggatnaagttcaaagggagggaattttgcctctttcttacaggttaggaggctgtttaagggtcttgccatttaaggg

SEQ ID NO: 573636 - DNA, 283 bp, Homo sapiens
gccccggggggcccccccccccccggccccaaaaaagtaccaccccccgggggggggggggggcaaaaccattgtttttccccccccgcccgggccccccaaaagggggcctgggggcccccgggcccccgggccccaaaaggttagttgcctttccccgggggggggggcaaagccccccccccaaaaaaaaggcggggggggttttttcccccctgggggggggggcggcccaaggccccccattaactgaaaaaaaaaaaattttttttttttcccggga

SEQ ID NO: 573637 - DNA, 115 bp, Homo sapiens
  misc_feature (11)..(11): n is a, c, g, or t
gttggaagtgntgaatcctgctgaaaacttccgtgtgctagtgaaacagaagaagggccagcttttagggatgcggctatccagctcataaatcacatcggaacagggttttgga

SEQ ID NO: 573638 - DNA, 402 bp, Homo sapiens
gctactctagaggaccccgacggctgttacctccaacagctgctgcttgtgctgcatgtcgcaccggcaccatcctgctcggcgtctggtatcttgatcatcaatgctgtggtactgttgatttttatttgagtgccctggcctgatcctggatcacgtataactatttcaacgttcttgaacttcgggaggttgactttggaagttcatggattgatgccaacattgtgcatatgccaattggcgatattcctcctttccttcattggaaaacttttttccccccccccgttttttgggggaaaacgttttaaaactttggggttttggcttatgggctacgttaacgggaggcggtaccaaggcaaacgcggcaggccttggatccatcccgattcttcg

SEQ ID NO: 573639 - DNA, 460 bp, Homo sapiens
  misc_feature (2)..(2): n is a, c, g, or t
  misc_feature (18)..(18): n is a, c, g, or t
  misc_feature (28)..(28): n is a, c, g, or t
  misc_feature (55)..(55): n is a, c, g, or t
  misc_feature (90)..(90): n is a, c, g, or t
  misc_feature (149)..(149): n is a, c, g, or t
  misc_feature (358)..(358): n is a, c, g, or t
  misc_feature (360)..(360): n is a, c, g, or t
  misc_feature (362)..(362): n is a, c, g, or t
anccgggggccggaccantgtcccctanttgtgggaagcaaatcgtgggcgcatnacgggcggcagggcctgaagtgaagctatgtttcnagtgtcctctgggtgtttccaagagcaacaggaaacgaataaatctctgatggagtctnactctgtcacccaggctgggattgcagtggcacgatctccgctcactgcaagctccacctcccaggttcacaccatcctcctgcctcagcctcccgagttgcagggactacagcacccgccacaatgcccggctatttttttgtgtttttagtagagatggggtttcactatgttagccaggatggtcttgatctcctgacctcattancncncgactccggctcccaaagtgctggaattacaggcgtgagacaccgcgcctggtctccatcaaatgactttttaaataaaaatacggttctcacctaac

SEQ ID NO: 573640 - DNA, 1410 bp, Homo sapiens
cggacgcgtgggtcgcccacgcgtccgtgggggagcccgcgggagcctgtgaatgttgatacgagctggccagttcctgggcccagctcacgttgtccagactacctgccaggatggctattcactagtgcttctaaagatactattgcatatcctagaggctgggtccccatctgctgtatcgacgtctactggagaagatcctgtcctagctgtgtttatgggatgtgtctctagcgattgtacgaagaaacatgacaaagcgttcctcttgacataggcagcccggaaatgttgcgtgtaggcatcagctcgaacatagtccgcagggtcccatcgttcgccggagggccgctgcgtgtgcccgaagcgcccagagacccacgtctagcagcgtcagcccttgggcgtgatttgccgacgaaacccgggtaaaacgcaagcgccttggtggcagcatgcaggacagcacgaagcaggcgcaggggagaacctgccctctgggatcaccactgcttaggccacagccgtatctcaatcgcgcacgacacgcactgcgacactctgctcccggcacccgcccgcacgccccgcgctgtcccgccgctcccgcctgcgcgcctctgctcgccctccctttcaccgcgcctcgccaccccacgcacccctcgctcgcctccccccgctccctgcctgtctcgctgcgcccctctcacccgcaccctcaccgcgcctgctcgtaccgcgacacttcccctgcccccccacccccgctccccacccccgccaacccgacacgctccctgaccgcgccgccccccaccgcccgcaccccagcgccccccctcgccccccccgccaccaccccacaccccgcacccccccggccccaacccgccaccacgcacccgcgccgccgccccgccccaccagcaaaacgccgcgaccccaccccccgtccaccccaacctcccacgcccacccgcacaccgccccccggacacacgccacccgcgcgacaactcccatccaccgcgcccccgacgccaccacccccgccgctcaacctcacccccgcgccgccctccgcaccacccctccacccccgccgcccacacacgcccgcccacaccaacccccaccaccctccaccccccccacccccacccccccccccacccaaccccccacccccacccacccacgcatccccctcccctcccacccatacaagtccccccactcccccccccccccactccccacctatcctccccctctccttccctctcctccatcctctcttactctcttccctctccacacacatcccatctcttcactccccacccccctccctccatccacacttaccacccccaccaacacaaaaccccacacacaaccctg

SEQ ID NO: 573641 - DNA, 523 bp, Homo sapiens
  misc_feature (6)..(6): n is a, c, g, or t
  misc_feature (21)..(21): n is a, c, g, or t
  misc_feature (54)..(54): n is a, c, g, or t
  misc_feature (65)..(65): n is a, c, g, or t
  misc_feature (93)..(93): n is a, c, g, or t
tgtcantgttgcaggcccccntggaaaatggtggatctagctctggtgatggcnggatcgtgctngcggcccaccaatgtggtctccgtccanctatgggatatgagctgaacccgtggcttgtgggacttgcacggctgcatgcctggagagccggttgttctgcgagtgtctgctaccatcgaaaagatctctggaaggtgagcctcagggactgtcacaacgtgtctgtgttcctggctcccagtgtgctccaactgctggaggacaaactgcaagcagagctccctgtgggggcccgtgtggtatctggacgattcccccttcccacctggcagcctgtagctgtggtgggcgagggcactgacagagtttgggcctatgatgtccatggttctgggccaactgtgtcttcttgtggggtgcccatcaaggccatcccagagtccagttctaccttagtccctagagcccctgtttgacaaactggctgactggataaaataaagactctgtgggttca

SEQ ID NO: 573642 - DNA, 905 bp, Homo sapiens
gctcgtgtgcttatttgctccccgctctcctcttagcgcgggctccgtgtccattgctagcgtcgctgagaatcttcgtcacagggcccgaggactcgcttcgtctcattggccgccgggagcaactccccgcgtgcaagtgccaggttgccctgcttggcaccctcgctcgcgtgtgcgcgtgtgaagctctcccctttctggtcaagaagctggggtttctcgactccagggtcctgtccctagagcatctgcccgctcttgagactgttttatcggagaccccgggattttcgtgccacttcggcgtccccgttctagcgtcttaacctcttgcggggctctctatctattttctcccgttgggcccgcccaacccgtggctccccttccgcggagtctcaattccccaggtccctgccccgtgtgcggtagagtctccccggttcaccaccggggagcccccttttccgcgcccgttgctgacgccctaaccatgcgtgcgtgcccccattgttcgctgcccttctatggtgtgtaaatctttaatcaggggcacccgggtctcgctggttctcactcctcacccccgggcccaagctcgtaccatcttgtgccagcagaaggactcaatctgtccccccaggaggcggtcacccctcacacgctctcatgtcacctctcccgacccccctcccttgctgcgaggcacttccggggcacacttttgacagggtttgccctgggaccctggccacccttccccggcactcccagacgctgcctgaatacccttccctcggatctacccccgtggggccgccggcgtcttctaatagcgcccggggtcccccgggaaaccccccccccccccccccccccataaagtccccccccccatccca

SEQ ID NO: 573643 - DNA, 143 bp, Homo sapiens
acccccgggcccggggggtaaaaacaaccctttggaaaaaggtttcttgccccccgggggcccgggggggaaaccctgcctcttgggccagggagattttttatcaatggtgcccgggggggtgcccccccccctggtaaagg

SEQ ID NO: 573644 - DNA, 308 bp, Homo sapiens
tgctgctgctgctgctgctgctggatctgctgctgctgctgcacttatctgtcttggaactgctgctgcacggtactctgctgagcctggaacatgcgtgctgttgctgctgccatgctgctgctgctgtagcgccgcctgctgctgcgtgctgtaactgctgttgttgctgctgttgcttgcatgctgcctcctgctggagcttgagcttcggtctgtggcgttgccgttgacactacagccatgctgtgaggagccatccccgaggtcccaggaggcggatggccttagagagacattggctgtca

SEQ ID NO: 573645 - DNA, 114 bp, Homo sapiens
gggtacagctggttctcatgcctacagcctcccaagcggctgggcttgcaggctgtgcatcaccatacctggctaattttgtgtatttttatgtagagacatagtttcacctgt

SEQ ID NO: 573646 - DNA, 819 bp, Homo sapiens
ggcaccatgttagccatgtgctggtctctgaagtcctgaactcagtgtgatcacctgcctcggactcccaaagtgcatggggattacagtgcatgagccatcgcatcgggacccgagaatgttagatctctataactttgtgtgtcgtggaagcagcatgggctttagatgtcaggcaagactctgggttcaaatcctgtctggcagtctagtggtgtagacttctttctggtacagaaacctaccttatcctgatgctcagtattccatcatctgtaacacatgggaacacaaaataacctgctttagtggatgattgttcattgttgaccaggtgagtaacatcgatagatgttggataagcatgagagagcaagacaccaagaaacagcaagtgtgcggcactcgagactcacacatgaggaaaactatgtaccaagaaaatagcaaattactcaggggcatatcacacgcatagaacctcacatagaaatcaaggacaagtatcttgggagaaacgttgaccgtaacagagacaaacaacttatcagtatgctaccactcggaacgggccgacatggacaagggacaggacgtgtcgttggcacaggcgtgccggggattcaaaaccgatatatgaccggcaggttaaaacgtggaacccgataacgtgggaacgttaacagggtgttgaaaggtaggaaggatgaccaacccttggttgaaacaagaaaacaaaaagttgacgatacgagctggactcactattggtaaagccatagaatcatacaacgacggggaaagctgcaggaaggcagc

SEQ ID NO: 573647 - DNA, 198 bp, Homo sapiens
acactcgcaccgtgttcgccacccatctgacaggagctaggcaccatccgccttcctgcccacgatgggaaacggatggatggcgccatccacttctgacttccgcaaatccctcgtctgagctgagctgccctcttcctgtatcttgggttcagcctgctcacaccttccccgggtgggaacggtgcgttggcccaa

SEQ ID NO: 573648 - DNA, 163 bp, Homo sapiens
tgccatctttgactcctggactatattgtgaacgagccacctcctaagctgcccaacggtgtgttcaccccgacttccaggagtttgtcaataatatgcctcatcaatgaacccatgcggacgcgtcggaccttgaagatgctcacaagaccacactcttcat

SEQ ID NO: 573649 - DNA, 170 bp, Homo sapiens
acctcagtttgggaccaactgcttggaatctttgaaaaccggttttgaatgccaaggaggagttaaaggcccttcccgacccaccttgtgttcccccttattctgcgccagattgatacacacgtaggagttcgcctccattacaccaaccaccatcaaggtcgccccca

SEQ ID NO: 573650 - DNA, 760 bp, Homo sapiens
  misc_feature (368)..(368): n is a, c, g, or t
  misc_feature (629)..(629): n is a, c, g, or t
  misc_feature (760)..(760): n is a, c, g, or t
taacccctccttagttttatgcgctcaaaaaccaatttaaacccccccccattgtaaagggggggcggtgacaaaagcaaaaacgccgaaacccggctgggaaaccaccagttgtgtgccccccgccatttttttcgcccgtgatgtgggatttgtgtgttttacattcggtgctcccgtgtggcttggggttgagagtttgaggggtggacgccctcctgggggggcactgtggccatgtgaagcccccttttgtgagaacgctcagaggggagtgtggaagacagcgccactgtggtccgcgcctggggcttctgtggggacagctggctttgttcccacagaattcccttgaggcggcggagagngggaggggatggggccgaggggtcctccctcgaggtgtgatacagagagagggttgctctcgaagagggccccaagaggagagggggcccccgtggtgtggaccatgaaaggtcggcgcccagagaggggcgagaaagggggtcgtctgaccgccgcgtgtgcgtgcgtcaaccaccaggagggtttccacatccagcggtcggggcggcagggtggggcgccacgactttccggaccacttgtagaagagaacccctccnccatcttcctctcggggagaatttttggccccggcccttaaaaacctctgcttttgtcctcagggatggtctgaagtctccgggggacccttctggggggcaagtgggttttgatcgccgcgatataaggn

SEQ ID NO: 573651 - DNA, 128 bp, Homo sapiens
ctggctctgagaaggaaacaggaagttggccgatggaagggtggtttttcttcccagggtctccccaagagctgcttcctttgagtcctgctgtgtgtagatctgttgacaatgacctggacggctct

SEQ ID NO: 573652 - DNA, 162 bp, Homo sapiens
tctgcggctgttcttgatggatcccagtttggttggacgtcctttaggcaccgtccagcccagcgaacgacagattgagggcgtcagggcgctggaccacatgcatctcggagcgctagggtttacggtggcgcgcaggagtgtggctgaggtctaggctgt

SEQ ID NO: 573653 - DNA, 138 bp, Homo sapiens
gcctcccaaagtatgttctcctcctcttcttacagatggtgagccttgctactacagcgtcatccttaatgatccaggagggcagctcatcctcctccattaaagcggggcttccgttacgggttccggtgcatctct

SEQ ID NO: 573654 - DNA, 264 bp, Homo sapiens
tgaagagaattcagaaagaatctcacagatgtcatcaaacaagtccatggtggcccatacgagcgctttctccacagaggaactgcgcacgctcctgtccacttctcaaagccaggggaacacatggatgtactatgtgacctgtggcactgtcacccagcgctacttcgtctatccagcacttggacaggacagatacatacagttgagaagttctgcatggcacagagatgcattctatcattacagcagtgtctgcaagag

SEQ ID NO: 573655 - DNA, 161 bp, Homo sapiens
aacaaggtacagtgacatagacagttgtatgaaaaaggaaagaaacttgtcaaaaaaatatattaatctagtaaaagagacaaagataaggaaggaaaaaggtaaaaatacagctatacttcacgaaagataatcaatcgaaaaaggtgctgaaaaagtca

SEQ ID NO: 573656 - DNA, 107 bp, Homo sapiens
taatcgagctcggtaccgccaatcactcttttcttcaatatgtctttcatgatttgagaggttctgaaactttgtttttttctcttcctgcctctttttctcttctt

SEQ ID NO: 573657 - DNA, 933 bp, Homo sapiens
  misc_feature (480)..(480): n is a, c, g, or t
atgtaatggcagttatattttgcagattcccacattaatagaagacctgagaatgtatccccataaagcgtgatgcttaaatatacaacgactgccagtattacatattttttttgttgacacttcagtctcagctgaagactatgaaatatgctggcctatagatgtcttttcccattgtactctacatattatggacttgctctatggaaactgagacatttcctattacaaggtatcttataatttagattggcgctcagcgttcttcagatacgaaagatgccaatcattcgagagatatagggtatattgtctccctagtattactggtttgccccgttgtattaatatccatagtagcatacgtgcaacgaatacgaagatcaaactttctgtcgaatctcagcttactgaaagttcattccacactttcactttggtaactgaattctcttactttatgagcaataaactaanattctcatttgcattctcagttcagtcgcttatagtcctgacttagagatgtttaagtggaatcaaattgtgggtcaacttttcgtggttttccgatgattactccgttatgctataaaggtgcccagtattcttaaaacactacgtcgtatctttgtaaatgtgttaacacgctttttgtgtatggaagtgcctgtattgttatattaatttagaacttggattctttccatttggcatttcgtatcatcgtaatttacaggaggaattattgaacattctgagtcctggcgatgattacctaatacactaatttaacttgccagagggtttttactagcaaggcctcgctaaaccttcgccattaccttttgtggtactcacctctatgccttaaaaaaactttgtgacaaacaaccgatgtgcgtcctggttccctatcgcttctcgcta

SEQ ID NO: 573658 - DNA, 1124 bp, Homo sapiens
gtctccctctcttagcatattagacccatggtgcttcgagtacgaaaacagtactaacaaagtcgaattaagcatcaacaagtgttattatacatagtgcatagacgtgcttcgtacaagtacagataagattttgacatggtagatcgaacaacattcttttcgggggttagattagaaaacccttaggacttcgtgatatgaagcaaataagtaagaaattattctttagagtaatgtctttgaaaggcaaagggaagggtaaagtcggagccagtgtcaaggaaagttgtgtaatcgaggtggaaaaatagccccaagtcagagaaaaggagggtaggtctgcattataattgtctgtgtgaagcaatcatttagttagctttgattaatttttcttttctccttatctgtgcagaacaggttgcttgttgtaaagtgaagatcatgctatattttatatatgaagcccctaatgcgaagctcttgacctctgtgctatgtcgttatatatattacagagtgaaactctcactgctaagtgctcagagatcttttttcactgtaaggaggtaacctttaacaatgatgggtatgacctttgtctcttcataccggttttatgacaaaggtctatggaatctatttgtcgtaagtttctactcccatcaaagcagctttctaagttattgccttggttattatggatgatagtgatagcccttataatgccttaactaaggaagaaaagcatgttatatctgaggtatgttctcaatacatatttgaccatataggttaaattccagttaaaccaaagaagacggtcaggagggagattactaaccctttggacaatgcttagctgggcacgcttgtcggtaaaaatacgaaggtctttaatatcgtttctccaatcaagaaagtcacgtgttacccagggcaggggcaaggggggccacatgaaggggcccacagcggaatacacaccaactctatttcaccttgtaatttagagcccttaccttatattttaaacaaaggtcggcacagttaatgtccttgccgttgtactataacacacacaaacacaagtacaacaagagcccaacaacaggagcaag

SEQ ID NO: 573659 - DNA, 331 bp, Homo sapiens
  misc_feature (114)..(118): n is a, c, g, or t
ttttttaaaaaaaccccccccccccccccccccaaaggaaaaaccgggtttttttttgggagtgttcccccccccagacaaaaaatttataccaaaaagaagtgtttgtttccnnnnnacactttttttttttctctttctgcccaaaagaaggtggtgttttcccccccccccccctaaaggggtccggtgggacccccaaaagggttgtttcaccccccccatccctgcctacccccatgaaagtctgatccttgtttttattggtattgcttttattaataatgcttttattatcattaaaactctagttcttgttttgtctctccga

SEQ ID NO: 573660 - DNA, 2133 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1439)..(1439): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaagttaaaaaaaaaaataaaggacctctgggctacaaaaaaaaaaaaaaaaaaaaaaaaaaaactttgtgtgggcgcgcgccttgggcccccgaggaaaaagctttttaaacccttcggtgtgtgggcgcgcgcgcggggccccgttgggttaggtgtgaaccgtgggtccaaagaggggttcccgagaggagaacaccggggcccaggacacagagggcgcggggaattctcctcacccatttaaaaagagcgcccgggggnggaaacacccgagagcgttctttgtgaaaacaattcccgagagagggaaattccggaggggggccacaactaacggggggagctcatcatcacacaggaggggagcgtcccaaagcgcgaagcgcctcgagattcatctaatattttatacgcccgcggccctgcgggggagccaaaacaagcaacacaaacgagcaaaagcaacaacaagaaagcgaaaagacacacaaagaaataaataaagaagagcaagaacagagaacaacgaacagcagaagaggggagagaaagaaagagaaaaaaaggaagagagcaacaaaaaaaagaagagagaaaagaaaacaagagaaggaagaccggaagagaagaaaaggaagaggagaaaaaaaaacaacagagaagaaagcagataaaagagagagagaaaaagagaaaagagacagaggacaagcagaagacgaaagcgaaaaaagcaaagaaacaacgcaaacgaaaacggaaacggagcgcgacacggagacagagcaagaggaaagagaaaagaagcagaagaagaaagggaaaaacaaagagagagacaaaacaaaaagaaagacaaacgaaaaaagaacaagaacaaaaagggaacgagacaaacagacaagcaggaggaagaaaagccgcaacgagcggagacaaaacgaggaaaaaaaaa

SEQ ID NO: 573661 - DNA, 266 bp, Homo sapiens
  misc_feature (5)..(6): n is a, c, g, or t
  misc_feature (8)..(8): n is a, c, g, or t
  misc_feature (25)..(25): n is a, c, g, or t
  misc_feature (27)..(27): n is a, c, g, or t
  misc_feature (55)..(55): n is a, c, g, or t
  misc_feature (65)..(65): n is a, c, g, or t
  misc_feature (73)..(73): n is a, c, g, or t
  misc_feature (133)..(133): n is a, c, g, or t
  misc_feature (178)..(178): n is a, c, g, or t
  misc_feature (181)..(181): n is a, c, g, or t
  misc_feature (193)..(193): n is a, c, g, or t
  misc_feature (207)..(207): n is a, c, g, or t
  misc_feature (262)..(262): n is a, c, g, or t
gcatnntnctgagcactgtttatanantgtgtaaatacccatatgtcctgaattnaccatcactntcacattnaaagggaggaaaacactctctaagccatagagagagacatattcagggatattctgaganggggctactagaagtttaatatttggaaaaacagttagtgcattnttnactccatctctntaggtgctttaaanttttatttcaaaaacagcgtatttacatttatgttgacagcttagcgtataagtntaat

SEQ ID NO: 573662 - DNA, 232 bp, Homo sapiens
gtgtaccgtcctctagcgtaacacttgaatgtttgccctttttgattattttgaaaaatactgtcatgaacatgggtgtacacgtttctgttagcatccctgtctttaattcttttgcaagtatatccagaaggggaattgctgggtctcttagttatccccccttttttgacatttttagggctgtacccatgacatacggaggtgcccaggataggggttgaatcagagc

SEQ ID NO: 573663 - DNA, 1443 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaagttaaaaaaaaaaataaaggacctctgggctacaaaaaaaaaaaaaaaaaaaaaaaaaaacaaaaacactctcgagaggacttattgttgtcggcggtggcgaaaagaagggtgttacgtaacagtggggcacgtttgcttatgtttttttctttgaaccctttttttgtggtctacaaggtgggaaatattcagccgggatccccattataggaaccggaattattgcaaaaagcccggtttgccgttatttttgcgtgaagag

SEQ ID NO: 573664 - DNA, 1577 bp, Homo sapiens
  misc_feature (381)..(381): n is a, c, g, or t
  misc_feature (735)..(735): n is a, c, g, or t
  misc_feature (1063)..(1063): n is a, c, g, or t
ttagatggggtggacgctaggctagagcccactgtagtggaggtatgtaggccttgtgcaaggtaggccgcagtggcgggaccctggacgtgcacctggttgacctcctgtgcattccggcgatattcggctcacttccagctgcccaggtgtccagactgactacacttgctggcatgaggctagtgtgagaactactatggctgaaggtgattaatgcaaagaacctgcgtgtctcctgaggtaaagtcgttggaaacccttcatttctctccattgtggatgggcgtggggtatgtaaaggaggccctggacgctggacctccataggcatcacacatgcgtaacagcgcgtccattgagtgatgtgcgaagagcgcnttggcgagggggtagtttcgtgcaactatacaacaggggcatggcatatacaatatgattccttggcctttgctccctttgcgcgcacccggaactcgcttggtgaacacactttcctttgtacttcgcgaaaggcgctttgggcgtgcagcctaactttgaggtgcacggaaggcttccacctccacacagggggatgacgcctatccacaatccttcccaaataggaggtgagctccatgtatggacatcataataatctcgcgcgcggtggcgtgcgtgggctaggatgcatatgcggagcagagaatatgcccgtgacgcataatgtcgtggcgtggattccgcagtgtntaagtcccctaatgcaaggtgtttccgattggagcaccttttcatacttcgcattgcccacaattaacacaccaacgcagtcctacctaggcggaactccaccaattggttaagaaggctaaaagctctacaacggatacggtgtctggtgggttgggcaaggcaacacttgttaggggggccaaaagcccctttttccatagtgtattacacccctagtggcataaacacttagcggtggcgtaacccttcttggcttttggacggttgccccttccatgcgcgaagacccctacctgtgggaaccaaaacgacaagcgcataactngggactaatatttggtgggcccttgtgcaaggtttgccccctccccatcgcgaagcgagtaacccgcggcttggtgtggcttgtaagcggcgcggaccccatatatctggtctttaattataatatataaccgtctgtggcaacccttttgggggggacacatctcctgggctgggagttggttacacacttcccatttacttcccattcttacaacttgggcaattccccaagggggtttgtttggggggaaaaacacaaatgtgtgtaagggtgttccccttttgaaacggtagggcgttgaaaactctgttccacgttgggctaagcttttacacaggaaacaaacttggggtgcacaggattggcgcccaagaaattggtttagggctataaattatagtgtggtggacaaacatggttctataagggagagaaacagaaaaaaaaggggtagcccacagattcacaataatctcctggggaatattatcccgggcatagtgatgtgagt

SEQ ID NO: 573665 - DNA, 943 bp, Homo sapiens
gaaataggaatcgaggtatcagactggggtgataattctgaattatgaccgtgctgtagaagcttttgcaaaagggggaaatctgaccctcggaggaaacttgactgtggcggttgggcccttgggaaggaactgtggaaggaaacgtgccctgagaagctccgtggccgtcttcacgtactgcagggtcaaggggactctttgcaggcgtgtcttcaggaagggagctgttgatcgaacaggcaacacagatccctagtagaaaattctgtggtcaggatatccgagcttatgagattccatgggagatacaccgtcggcctgttcaagccgaagatcttatgaaattcttgattccttttactgaacatagtcatgacacattgcaggacaccgaaatcattgcatgaaaagcagccaagggagcacgaggaagtctctctgctaaagaatacctcccaaagccatggtcgaagaccacagcagtcatcttgcgaccagtccaagctggaactctggctctccaaaagcaatttgaatcaacccatagaagtgacgagcgctgtattcctttgagcggacagcactctgggatttgactttaaagctgggacaagactcaccgttcatgtcaaaaaacagatcccttgtggatgggtggcagggacaacttcggaggtcaactggatttgtccagccaactacggtaccataattagagcgtatacatgtctctggcagcattcaaaaattttcctactggcgcgttctatacgccgtgcacatagctaaaatctgttgacaaatttctggtgaagatggctctgtagagccggggactgtaacagttactcactgggcaaacaagcgcagtgtgaacaccggtcggcttggtgaggtgaacattgcggatcttgctcctccctctttcgtatatctttca

SEQ ID NO: 573666 - DNA, 143 bp, Homo sapiens
  misc_feature (19)..(19): n is a, c, g, or t
cggtcaactagagacgtancacacacacacacacacacacacacacacacacgcgcacaccacatgcgtattctctgtctggtactgagtttctcccagagcctggtgcctgggtgttggctataattgtccattccttttct

SEQ ID NO: 573667 - DNA, 1792 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaagttaaaaaaaaaaataaaggacctctgggctacaaaaaaaaaaaaaaaaaaaaaaaaaaatctctcggagggctatctcttttttgggggggcgggaaaaagagagggatatatagagaagggggcgcccggtgtgtgtgctctatgcgggtgtgttcctgtggagccccaggtttcttctgtgtgtgtcacaagggggggagaagatctcggggcgggttctctccctatattgtggtgaggcgtggtattattcttctccgagatatacagccgcccgggggttaccccggggggacttatatatggagatctctccggggggaaagtaggccacaccccccgcgggtgactatatatcctacccccccgcgcgccaacatatttgaacgaggggggcctgtttaattaaagatcgtggggcatgcaggccccaccaaggagggggagaacaactcatctctcgtgaggagaagacacactcctcctgtcattacatcttactgatggcgaccaagacatcataactcgggtgcggagacctacgtagccgaaaacacacaaacaacaaaaagaacccacaaccgcgtcaccaacacacagtggcgagagaa

SEQ ID NO: 573668 - DNA, 1268 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaagttaaaaaaaaaaataaaggacctctgggctacaaaaaaaaaaaaaaaagtcgagcggccgcgaatttagtagtagtagtagtagtaggc

SEQ ID NO: 573669 - DNA, 1303 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1298)..(1298): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcaaaaaaaaaaaaaaaaaacaaaaaaaaaaaaactttttggggcgccctgggccccgagaaaaagtttttaaacaccatttgttggggggccgcgngggcc

SEQ ID NO: 573670 - DNA, 1741 bp, Homo sapiens
  misc_feature (473)..(473): n is a, c, g, or t
gcagccgacatccctgaagtggacttaaagtgagctgctgtcatacttcctctaggcatgtagtgctcccgctaacaagacttgactactactcgagcgctaccgtgctgggagtccgtggatctgcgtcgactttggatcccagctctcgtctacaattggagatctcaggcccgtggttgctcttgtagagacggcatcatcgtaggcgtagttgcctgttaaaaattgaccatggatgtataacaagtctcgcgatagcctgcgctccacctcacgtctagcgcgacttccactctcgacacgacgccttggacgagagcggcaagattcctaggcgatcattgagatgatagcgggagaatgcgatcagcggctgaggtcaaattgttgcctagggaatcttccttgtcctccacctgacattaacgcgcgcatcttgtactcggtgcccaatctcatatcaccatgtntcgtattgtctggcgcacagagaagattcccatggacttggggccataagccccttgaaaaacgagtagagggggaaggcagggggagacgcatagagagccctctctaggcgcaattgcgggcttacaatacacggagcataggagcccatcggtgcgtaaagaaaagcacacctaggtacggtgccgcttttcgccgggtagagttcttaagcccatacgagaggtgtagagccgccgctaacgttgtatacacgggcaaattccctcttggcggggctgcaactctaggggttccccagcgcctaaagggacactttgttcgcaagaggtgctccgtgctccggttggcgtttcgcacaccgtaacgagcctttcaatggcgctatcccttttgaatacaggtgtccttaagagagggggatccccgggggaagatctacggctcccctttttgtacaacgttgccggcgtttttcatcttttcggccctccacggaaggacatatggccaattggaaacctaaggcgttttcttccaaaattcaaaatactcgccccccataggcaagggggagaacaatttcccaaatatgcacttcgcgccgggtggggcatcgctatgcgcctttgaacaagtgagcgccctgttacagaagcatgtgccgtccgtggggggccgacaaagggttaccgagtttttatccagaatttcgcggagcactttttcaaacaggggtgggggacacccgcgcccggttcatttttcaaacccagcaaatgctttttgcctcgacaacaggggtaataccgagcgatcacccatcatggaggagagaagagcccccccagacggggtgtgtatccacgggggagacacaccaccatatgcggactagcagaaggggcccccagatagagcaggattcgggggtgaaactacccggagggacaaccgccacgggggggccgccacaaaggtgtagtaaatctcgcgcgaatacaactcagaggaacaaaaacacacaacctatgttcctatcaaacccctccggtcgttgtcagcccctagtttgtggggaccacccacaaaatgatagaagcaacaccacctccagagtagttttctactaacacggcgggctctccactaggagcaacacctaagtctgagcactgtatgtagtgacgatagacaaggagcgatttatcatcggccataaccagcagctaagcttcgtattcggatagcgacatcgaactgaaga

SEQ ID NO: 573671 - DNA, 377 bp, Homo sapiens
cggcataggctcacttagcctgtctggactctgggtgtagcaccctccatgtcagaaaatacccccgggttcagctcatcacacagccaaggaaggagctccacactgacactaagggtgcatcctgggctcattcatcagggcatgcctccaaaatatttctccacgtctcctccctttgcccacctgcattgtctctgtgcctcagccccggctgggggcctgcaaggattccctatctcctctgcccctgcacggctgggtccaaggccatctgtccacccaccacacctctctcaccttgcacaccacgctccagccccaccgtcctctttctgcttctttcccagcctctgggcttttgcacacgcttgttc

SEQ ID NO: 573672 - DNA, 1436 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1274)..(1274): n is a, c, g, or t
  misc_feature (1277)..(1277): n is a, c, g, or t
  misc_feature (1286)..(1286): n is a, c, g, or t
  misc_feature (1302)..(1302): n is a, c, g, or t
  misc_feature (1314)..(1314): n is a, c, g, or t
  misc_feature (1326)..(1327): n is a, c, g, or t
  misc_feature (1331)..(1331): n is a, c, g, or t
  misc_feature (1338)..(1339): n is a, c, g, or t
  misc_feature (1343)..(1344): n is a, c, g, or t
  misc_feature (1358)..(1358): n is a, c, g, or t
  misc_feature (1370)..(1370): n is a, c, g, or t
  misc_feature (1391)..(1392): n is a, c, g, or t
  misc_feature (1397)..(1397): n is a, c, g, or t
  misc_feature (1403)..(1404): n is a, c, g, or t
  misc_feature (1410)..(1410): n is a, c, g, or t
  misc_feature (1414)..(1414): n is a, c, g, or t
  misc_feature (1416)..(1416): n is a, c, g, or t
  misc_feature (1419)..(1419): n is a, c, g, or t
  misc_feature (1426)..(1426): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcaaaaaaaaaaaaaaagaaaaaaaaaaaaaaaaaaaaacaacacaaacttgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573673 - DNA, 412 bp, Homo sapiens
ctgggaaagcccgtgtgggtttttgcctaggaccacatgtctgtcattctgcggctggcgacatgctttaggtaccgttttgaggccctaacaatcacaaactatgctcaagtcactctctacattgctcataacttccaaaatctattttcttcctcatacctgacacatatacttgctgctccccggctccttcagctgtactcactctttaagtcccacaattaccattgttcctggcccggacttcaatctggcctcccacattattcctgataccacacctgacccccatgactgtatctctctgatccacctgatattcaccccatttccccatatttccttctttgctgttcctcaccctgatcacgcttgcctcgtgctatccccaaactgccattcttaactc

SEQ ID NO: 573674 - DNA, 1584 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaacaaaaacaaataaaggacctctgggctacaaaaaaaaaaaaaaaaaaaaaaaaaaaaactttttggcgccgcccctgggccctctaaaaaattttttaaaccccttctcttttgggcccgggggcccacttgatggttgatagttgtaacctctgtggtcgcaataagctgtgtgttccccaaggagaaatcccccgggtgtcctatgagaacctatctgtcggtctggggtgttttttctccaccacaatataaaaaaaacgcgcccgcgggggggacaaccgcggcggcttttctttgagaaccatctcccagagaggggggtgtcccaagagggtacattccgggggttccctttaacccgggggattccacaggaaagcgctcgatatttaaattttaccgc

SEQ ID NO: 573675 - DNA, 472 bp, Homo sapiens
  misc_feature (104)..(104): n is a, c, g, or t
  misc_feature (118)..(118): n is a, c, g, or t
  misc_feature (121)..(121): n is a, c, g, or t
  misc_feature (124)..(124): n is a, c, g, or t
  misc_feature (129)..(129): n is a, c, g, or t
ccgggtcacacaaaggcatgctggagtacccagcctatcaggtgcccctcttccaaaggcagcgtccgagccagcaagaggaaggggtgctgtaggcttccccncccacccaacgganganaangggcnccccaaaaaagtgagggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagccta

SEQ ID NO: 573676 - DNA, 1225 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaagtcgagcggccgcgaatttagtagtagtagtagtagtaggc

SEQ ID NO: 573677 - DNA, 1613 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (739)..(739): n is a, c, g, or t
  misc_feature (745)..(745): n is a, c, g, or t
  misc_feature (1311)..(1311): n is a, c, g, or t
  misc_feature (1460)..(1460): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgaatttactttantttggntttttcccctttccccctttaacggggggcccccttttttctaagggaaaaaaaaacaatttgggcgttcggttccccttttttggggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573678 - DNA, 2020 bp, Homo sapiens
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgcgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 573679 - DNA, 1022 bp, Homo sapiens
ctttggcccacgtgttctatttccatgggcttcattgggggcttaaggtgcctcccccatcatggcctggtccccttgagatctgggcctcacaaaccgggtaaaatttttagcttgggaccctggtgtatctttcctgttttcccggctggcctttgccactggggaaccagggcgcgctttccctgggaatttaagagtcccatcccgagacctgggggaaagctttttaaggggtacccacgttgacttgctttcacgctccggatttgcttggatgtctaccatggggcccccctgtggactatcctgtggttacctccctagggcccggaacccggttaggttaatctgatccaggattggatcaacagcctccttctcttggggacttctcaaggagcctgtggttcatcctagaacgatagatagatttgatttctgggttccctcccgtacagaggtgtcccccgtctctggtgcacggctccgtcacttaacactaggggacttggttttagaactctgtatgacggaacgaaaatggccccgggggaaggaaaacgtgactgggaaggacccgaaacctgggaaaggggaatgggtagaaccagactgagaaatcccacatgcttccagaattcagagggttcaaaggaatggtttcggatattaggctctccctgcgtcccgtgtcttcttaccaggaatttcttgtggaaacatatccagaagcaccaaagtgtgtggaccaccctgagtaccccactctctgtgaataccatacccccttcttggccccggtggccaaacactggttcttcccggtgactgtagagaccagttttagaccctttgtgatagaactataatgctctctgtacatctagtctcctgcctcctcagctttgcaagatagttttagtaggaatgaagatggaagatcccggcttgggttgcctaactaccctgtttaaaatattgtgtaatccctttataaatttaactttggatttgtttta

SEQ ID NO: 573680 - DNA, 1195 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgtatagacctagttccctatgattcatggcatacaaacgggggggaaaaaaataaagcttg

SEQ ID NO: 573681 - DNA, 2047 bp, Homo sapiens
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgcgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcagccgctggtgacgagccccctcctcagggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 573682 - DNA, 326 bp, Homo sapiens
cattcaacggtgggcaggacatgaatagacttggcataaaacgatgacatacacatggcctacacgtatagtaagaaaagctcagcatcaccagtcatcagagaaatgcaaaccaaaaccagaatgagatgtcatcttaccccagtcagaatggctattattaaaaagacaaaacaacaacaacaacaaaaagaacaacaagtatttgcacggatgcagagaaaaggaaactcttaaagattttcggtgggaactataaattacgtactacgcttctatggacacacacaaacagtgatatcttaaagaaaagataccgataattt

SEQ ID NO: 573683 - DNA, 444 bp, Homo sapiens
ccatctgtgacaattttaatcctcatttgatcatattttatggtaaatgagcttaactcgatttttttttaatttagatgcctcctaatgtactataacaggtgctatgataagaaagatgaatgagtttgtaaaacccagggtaaataaggagtttactacaagaatacaacttcccatatgcaagatggggctgggcaaggctgtgagagcttctcttgaattgagcctaagaggatgaggagaattccatgattgaggactcagaggtggacctcccaaacaaagggacaaagttgtgaaagtgcaggtcagattcagagaagagctaatcgtggaatttaatttaaaataataaaagaaaaggactttgatgaacaaccataccgtttttagctcttacatcgtgtagttttccaagtaaaaatgctttgaatgctgaaa

SEQ ID NO: 573684 - DNA, 482 bp, Homo sapiens
  misc_feature (447)..(447): n is a, c, g, or t
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgaggccggggcccgggacgcggggcggatgggaccctggcgccgccgagacgcctgcaaaggcagcagcccggccccacgcacccggggatcgccgcgcccggggctccctcctggagagcgcgaggaggnccccgacgcccggatggccgatcccgggtggccct

SEQ ID NO: 573685 - DNA, 152 bp, Homo sapiens
  misc_feature (58)..(58): n is a, c, g, or t
gaggaaagtaagaaagaaagaaagaaagagacagagagagagaggcaggagcaggcgntgggaagaaagaggacagaaaataacaggtttcagagatgaaaggtgagcacacaggcagcatggggacagccttgggcggcaggggccaccct

SEQ ID NO: 573686 - DNA, 2500 bp, Homo sapiens
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgcgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgccaaaaaaaaaaaaaaaaaaaaaaaaaaaaaaaaaaaaaaaaaaagggggggggcccaaaaaaaaaaccccggggggggcccaaaagcgcctaccccaggcttctgtcggtagcagcagaggggggccccaatagaggaggggacgcggaaatcaagagaacacaggagcaggagggcccgcgtgattaaaaacaccgcgggcgaggaggcgggaaaaaacagcggccactgcggggacacccgggagaagaaggcaacccactcaccgctggggcgggggggacaccactaagggcggccgcacacccacccacacagaagatattaaaaggtctacagggggacaaacaataaccgcaacgcagtgtaccaaaccggcgcgtgcacacccacagccgctatacggcggggccgtgagaaaagactggcccaccgcgtgatcgagccgcgaaaacatttcaccgcaggtataatcaaaaagt

SEQ ID NO: 573687 - DNA, 2441 bp, Homo sapiens
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgcgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgccacatctgttcctgcctgcgctgcctgcccgctggctgccttgctgtccagaccagcaggaccccctgcaccccctaaggaggaccgggccaaggccttttggggaggagccaggtcctcgctgtgcatttggatgaaggaattggggaagtaggaggaaccaaaaccggtgtggggggaagggaacaagacggtgaggctggggttgagggtctcagacacaggatctggctctgtcattcagactggagtgcagtggccgatcttggcttactaacctgggcctcctgggctcaaaccagtcttctacctcagcttccagtagctggtgctaggggcgtgtccatctaccggctattggtggttgggagcgggccccctgttcccgggggccatttggccgggctccccctggccccgagc

SEQ ID NO: 573688 - DNA, 2265 bp, Homo sapiens
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaagggacagccaaggggcgttgttttctgaccgtgtcttgccacagagaacaaagaagaaagggcctgaggctttgcacagtctgcccagcaggccctgccctgtgaacctggctgtggtcactgggcagccgcctgtctaggggacctttattttagcagcctgtccaggggacttgtattccagcagcctttgaggggactggctttactaatgagcaacaatgctggtcgctgcgtgaaggccaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgcgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtcctgctacgaccaggccaagcagctggtccttagcaccgggtacctctctgacaacatcttcactcactttgtcgccagctttattgcaggtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 573689 - DNA, 256 bp, Homo sapiens
  misc_feature (68)..(68): n is a, c, g, or t
  misc_feature (76)..(76): n is a, c, g, or t
  misc_feature (226)..(226): n is a, c, g, or t
ggccagcctggacaacgtgatggaaccccatctctactaaaagtagaaaaaattggccgggcatggtngtggatgnctgtagtcgcagccactcgggagagggcgctggagaatcacttgaactcatggtgcgcaggttgcagggagccgagatggcaccattgtgctccagcctgggcaacaagagcaaaactccatctcaaaaaaaataaagaacctgcgagtnagttcccacacgttttcctaatgggctgct

SEQ ID NO: 573690 - DNA, 1928 bp, Homo sapiens
gcggccgctttaaggcgccgggcccgcctcaatcgcagggggcgtggcctagcggtcccgcccccggggcgcgcgcgcgcattggctgtgcggggtgcgggcgcgcgggcggcgctttgaaccgggcgcggggcgcggggcgcggggcgctgcggccggtacacgccggggtagggccggggtcgggttgtggtcgggccgggattgggctctcctgggccatggcagccgaggcgcgcgtgtcgcgctggtacttcggggggctggcctcctgcggggccgcctgctgcacgcacccgctggacctgctcaaggtgcatctgcagacgcagcaggaggtgaagctgcgcatgacgggcatggcgctgcgggtggtgcgtaccgacggcatcctggcactctacagcggcctgagcgcctcgctgtgcagacagatgacctactccctgactcggttcgccatctacgagactgtgcgggaccgcgtggccaagggcagccaggggcctctccccttccacgagaaggtgttgctgggctccgtcagcggtttagctggaggcttcgtggggacgcccgcagacttggtcaacgtcaggatgcagaacgacgtgaagctgccccagggtcagcggcgcaactacgcccatgcgctggatggcctgtaccgcgtagctcgtgaagagggtctcaggagactgttctcgggtgcaaccatggcatccagccgaggggccttagtcactgtgggccagctgtggatgtgccacgttcctgtgccagcccctggatgtgctgaagactcgcctgatgaactccaagggggagtatcagggcgttttccactgcgccgtggagacagcgaagctcgggcctctggccttttacaagggcctcgtcccagctggcatccgcctcatcccccacaccgtgctcacttttgtgtttctggaacagctacgcaaaaactttggcatcaaagtgccatcctgaccagccgtgggaatggctgggctgccaggccagacacgctaggttcttccaaagagtcccaagcccagcacctgctcctggggccacgacctccctggccgtggccacccgtcctccgcagcaggcccctgctgtccccccacctgctggctgagctcctcctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagagtgtgggtgcagcctggctgttgctcacccaagtgctagctctgcacttcgtgtctgctgagagcaaccagaccttccatgtcctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 573691 - DNA, 506 bp, Homo sapiens
agcggggggtcggacccctggccgctgccgccatcactgtcgccctgcccaatcgcccctcagcacatccccctttcgcacggaaaaaggggaatacagagattaggattcatacaaagacctcatagagaagtagtaggcatagtatgagcagtataggtagttggtggtaagcgatcgttaatatactagataatatgaggacaatgagtaagaaaaggtaaatatgagactgaagtaggagacacagtaggaggaaagatatatgtgaaaccacaataaaaggaaaaaaaaaggcaaaaagaggaagagaaaagaaagagaagagaaaaaaagaaacaaaaaaaaagaagaacaaaaaaaagacaaagacagagacagaaccgacaagcaaagaaaggcggaggaaccaaccaagagaacgaacaaaaaaaaaggagcacaaacacaggtaacaaaaaacagaaggggcacaaacaggcggcacgagggaagtgagacgaaaa

SEQ ID NO: 573692 - DNA, 493 bp, Homo sapiens
  misc_feature (279)..(279): n is a, c, g, or t
aagaaccacccaaggaagtgggaacggccctcctcggatgaggaaaatgagaacggagacttcacggtggaaaagtgcccgggccgggccccgcccggggaaatggaggtgccaaccctctgttggaccaagccgcactgtccgggcccctgccggcccccagttcaccgcttgaattgccatgacctggaggcagacaaacgcccacctgctccccaaccttaaggcccccggggaggggcagggcctggagcttcccactaaaaaaaagttttaaanctgggggcttttggttgggcctcgggctccaggccctgggacccctttcaagggaaacccccaaacctttgggccaggacacctcctggtcccctgcacctttcctgttgggtttaaacccccaaaatggagggggaaaggaaaaccgtaaagagcagaaaaggggggggaatttaaaaaaaaaaaaccaattaaagtccatttcagaccggca

SEQ ID NO: 573693 - DNA, 522 bp, Homo sapiens
  misc_feature (7)..(7): n is a, c, g, or t
  misc_feature (61)..(61): n is a, c, g, or t
  misc_feature (63)..(63): n is a, c, g, or t
ccatagntgcttagtcttcttgccccgtgggcggcgtggaggggcgagagcgcgaggcctntnccgtggcgctcgggcagctgcaactccccgcgagaccccgcagctgggtgggatgaacaagcaacgcagaccacaagcgagtgcctgggagggagtggcccagggtggttctggagccattgtgggtgagggtcgagggccaccgaggtcccgcgcaccgctgcctgccctgcagtggctttaacagttagttttgccaaagcctctccactcaccagcaggcggtctctgtcttcagggattgtgcctgcgtccctcgggcacctgggcccccccgcttggctccctgggggaatggcccaggcgggccgcggttcctccttagggccttctccccgacaaggagtccgacggggcggatgctgcatcctctgcctccctggtcgctgggcttcaccccacctgggaagggcagtgtgctctgtgggggctgcaatcaataaatgccgggagctgcca

SEQ ID NO: 573694 - DNA, 82 bp, Homo sapiens
gacagcagcttctacatctgcagtgcccttcggagggtctccaacgagcagtacttcgggccgggcaccaggctcacggtca

SEQ ID NO: 573695 - DNA, 310 bp, Homo sapiens
gatgctgtcagagagtcccacctaggctgataccactgtctcgcgctgtagtgaaatagtgatgggagtgtacatgtctctttgatgttctggtttcctttcctgggaataaatacccagtagtgggattgctgcatcatatggtagttctgtttttaatttttcgagatacctccatattgttgtccatagtggctgtactagtttacattgtcaccaacagtgtgcaagagttcccttttctccacattcttgtcaacatttgctgtcgttcatctttttgatagtagccattctatctggggtgagg

SEQ ID NO: 573696 - DNA, 162 bp, Homo sapiens
tttatatttcaatagtttttcagaaaaggtaaatgtttaagcctttcgatggggttggacctttgcttatattactacaggtatccctctttgacatttaaatgtcaatattttgtacatattttcaaaccacttaataaactatttcaataaattttcaca

SEQ ID NO: 573697 - DNA, 436 bp, Homo sapiens
gtgtgcgcctgcgtggtgttgtccggcgcagcccacgccggctgcagctccgcggagcctgagccggatctcgagcggggtacacgggctgaggctggcggctggcggcccctgccccgtgggctccagttgttaacggcggcgtgcggcgtctgtctggcttgttcacggctgcgcctccatgtcgtgcccatggctgccgcggacagaggacgcgatgctgcttgccgagtgtggcctgtgccttggagccaactgggaacgacgttacattaggttcgacactttccggttcctacttttccttttgaaagcgtccgttgtgaaccccacgttgacacgtagtctcaagctcgttccaaacccttggttccagggggcacgacacagacacggccatggttgacttaagccctaaagcgaatttccttgcgta

SEQ ID NO: 573698 - DNA, 260 bp, Homo sapiens
gcacgaggtgatttgacccaagaaaacagatctaatgatacaaccacctctccacatcaaagcgatggcagggttgtttagtttccagccataagtagcagcagcttctctgttcaacatgaaaccttgagcgtaagaagtaatcttggaagcatacaaagcttgttccaaatcatcgacaaattgttctctgtccttgacggcgtcttttggaacttctgggcctggtaagaccttggaggctctaattctctcgttct

SEQ ID NO: 573699 - DNA, 400 bp, Homo sapiens
tttggggtcttgctccagtcctatggcagaaaacgtgaacattccgcaaagtattattgtaacaaaacacgtaactctggtaaatgttctgtcgtgattgttaacattccacagattctaccttttgtgtttagtttttttttttttacaatggttttaaagccatttcaggttccagtggtacgatagggaaaggtgataatagcggtttcatcatggtcttcaggagagctttccagagtggatcatttctcccaaagactcccaagcctaaaaaatgattcagcaaagtgtcaggataccaaatcaaggtacacaaatgacgggcatttctatacacctggaataacattcaacactggaataacatttaagcaaagaccccaaagggggtacggag

SEQ ID NO: 573700 - DNA, 453 bp, Homo sapiens
ggtcccgtacagaaagctgtggctcaagaggctggtggcagccatgtctgggcaagactagcaaaggcctccaccagggagccccatctcaaggccatgggcattttgcctggttccctttcccctgggaacaatgggtgggaaggcctaggtgggtcccaggccctgagagactcccttggccatagtgcaccctagtgaaagatcactcccagcactgtaattctttggctattggtgcctgagatggccagtgctgggatggtccaccatcttaaagaagaagatgtgctgtctggggccctgtggggcctaaacccagactttactagatgagattgaggcaacaccaggcctggccaccatgagatactatgcacccctgaggacctcatttgttgtgtctatgtctcaaaggatcagatggttgtcttgaacctgtgatcgtggtaa

SEQ ID NO: 573701 - DNA, 454 bp, Homo sapiens
ggtcccgtacagaaagctgtggctcaagaggctggtggcagccatgtctgggcaagactagcaaaggcctccaccagggagccccatctcaaggccatgggcattttgcctggttccctttcccctgggaacaatgggtgggaaggcctaggtgggtcccaggccctgagagactcccttggccatagtgcaccctagtgaaagatcactcccagcactgtaattctttggctattggtgcctgagatggccagtgctgggatggtccaccatcttaaagaagaagatgtgctgtctggggccctgtggggcctaaacccagactttactagatgagattgaggcaacaccaggcctggccacctttcggttctcatacacctcatggtctggaaatctctgctgaacatacctgatctagaggaccatgattctgtccctttctggggtgttt

SEQ ID NO: 573702 - DNA, 101 bp, Homo sapiens
tctgtcactctaaggatccccagatagtgtggtacttcaaaatgtcatccacgctgtcggaggtcatgtcctttaaatcactgccgtgtactacgcaggga

SEQ ID NO: 573703 - DNA, 220 bp, Homo sapiens
ggaaggttaggagatactataatccagcctgactgaggaacacaccaatatcatcactgtagccatagaacatctttacagacaccatgaagtgcttgcgcatgtctgagtcagatatatacgatgttaaggctgtgcaatagttctttccttccaagttatagctgctgcatttcttggatcactatttcctatcccaataaatgcacacagtagcgaa

SEQ ID NO: 573704 - DNA, 715 bp, Homo sapiens
  misc_feature (5)..(5): n is a, c, g, or t
  misc_feature (231)..(231): n is a, c, g, or t
ggttntgagaacagagtgctgttttagagctggcagcagcgtctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacantgggtatcattcattacattttggagttttttggggttttttttttttttttggaagacagtctggctggtattggcccaggctgggagtgtgggtgggcacaatcacagctcatggcatcctcaatcacccagggcctaagcaatcctcccacctggtagctggggactacagctcacagcacaccgggctaaaatttttttttgggtgggaagacgggattctctatgtggcccaggctgggtctcagggctccggggctcaagagggtcctccggcgctcagtttccaaagggcacagggccaagtggtacgctttggtccctggccatcaggcccaacaagaggttctataccttttaaggaatggacttccataaatgggtaatgtgggtgggcaagtcttaaagcgggaattggtaaattcctcctgaaagtgttttccatgcagtcaccattgaactaatcgtaccaatacaggatg

SEQ ID NO: 573705 - DNA, 120 bp, Homo sapiens
ggatccgtcacactgggttcgagttctagaatcgggggtcagacagggatgcagctctgggacatcagcaagaaggacattatcacaccggacaagaaaggaatccaagcaagtcctctg

SEQ ID NO: 573706 - DNA, 479 bp, Homo sapiens
acttgtgaccctgtatgacgtgcaggggcttatgcgggagttgtgatctgtccagattgttgctttagccggagatgggagacactgagcaggtggtccttcagccataagcagccccgcgtgctggtccagaaccgtggagctcatgggaaatgtggtgaccacgtgagttcacgctgacgtctcaaagtttggaagttttgtccccagaagctgaaaggcaaaatgggtgctgtcgggactccgactaattgcgtaaatcccagcgtcgtgggccttgattctgcccaggcgcgcacaccttactccccagtcttcccgtcttagatgtttatctggccagacagtactggctgtgggaaatctgttcccatcgggagacaatcggacacagttgacaaagcgggtgtggtcgccaatcgtaacttgaacttgaatgggggtcctcagagaatgccgggcagtttcatcgctccccg

SEQ ID NO: 573707 - DNA, 177 bp, Homo sapiens
gccagcttccccaggtttatgtctgttactccatccacatctttttctggtttcaaggcatttaggactttgttgctaaacaagttcctcagagatctgaagggcaaggccatgtactcttggtatcttccattgacctttaagattcacctataatctcggctccactcctatctg

SEQ ID NO: 573708 - DNA, 1133 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgccttgagctgctggaacctattccctatgaattcatggcataataggtgtt

SEQ ID NO: 573709 - DNA, 1471 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1169)..(1169): n is a, c, g, or t
  misc_feature (1318)..(1318): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatgggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573710 - DNA, 1477 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1175)..(1175): n is a, c, g, or t
  misc_feature (1324)..(1324): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcactccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573711 - DNA, 277 bp, Homo sapiens
  misc_feature (25)..(25): n is a, c, g, or t
  misc_feature (100)..(100): n is a, c, g, or t
  misc_feature (240)..(240): n is a, c, g, or t
  misc_feature (253)..(253): n is a, c, g, or t
  misc_feature (275)..(275): n is a, c, g, or t
aaacttgccctggtgttaggcaacnaaatgttttaaggcaattttttgtagcacagcccctttttttttttttttttttttggaaacagggactcactanttttgtatttttgaagggaaggggtttcatcatgttggtcaggctggacttgaactcctgacctcaagtgatctgcccacttcggcctcccaaggtgctgggattacagacattagccaccacgcccagaaagcacagancttttttcaaaanaaatttgtgatgttttaataanaa

SEQ ID NO: 573712 - DNA, 1253 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1091)..(1091): n is a, c, g, or t
  misc_feature (1094)..(1094): n is a, c, g, or t
  misc_feature (1103)..(1103): n is a, c, g, or t
  misc_feature (1119)..(1119): n is a, c, g, or t
  misc_feature (1131)..(1131): n is a, c, g, or t
  misc_feature (1143)..(1144): n is a, c, g, or t
  misc_feature (1148)..(1148): n is a, c, g, or t
  misc_feature (1155)..(1156): n is a, c, g, or t
  misc_feature (1160)..(1161): n is a, c, g, or t
  misc_feature (1175)..(1175): n is a, c, g, or t
  misc_feature (1187)..(1187): n is a, c, g, or t
  misc_feature (1208)..(1209): n is a, c, g, or t
  misc_feature (1214)..(1214): n is a, c, g, or t
  misc_feature (1220)..(1221): n is a, c, g, or t
  misc_feature (1227)..(1227): n is a, c, g, or t
  misc_feature (1231)..(1231): n is a, c, g, or t
  misc_feature (1233)..(1233): n is a, c, g, or t
  misc_feature (1236)..(1236): n is a, c, g, or t
  misc_feature (1243)..(1243): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcaaaaaaaaaaaaaaaaaaaaaaaaaaaaaaaaaaaaaaaaaattgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573713 - DNA, 866 bp, Homo sapiens
agcgaaatagttcattagaattttctgcttgaaaattaagtagtttccttgctagcttggacagctgaaaaatcgggtggaatctatggaaaaaagattaggcaagttgatttattactgattttgcaggactggatagacagttaaatcagtgcttctccaagtgatccatgggccacctgctgataaatcacctggcccactatttttaaaaagtgattcagggcccctatatcagacttctgaaccagaatctctggatgatcccaggaatggcagcattgtggatttggaaatgattcttaggcacactgaagtttcaaaacagtcatttaaagtgtgcctattacctatagctgtcaaactccaggttaaacattttcttcctcttgaacctggaaactttttaaagctgtcatgataattggcttcattctgaggtgtaagctcttaagatctaaattccatctaaattagttattttagatctgatcactgtgttactgcactcttgtcttcatctagatttaggattagactggttaagctgaactgttaatgttcttttacaacttgtggcctatatgttgtattcataataacttgttttaagaaaaacagaaatttaggcttttaaggtggcgacttagtgggaagtactctagtagtaattcctaattagagtaaatctgactaatttacatcagttctcatatccggataggggaccggtttcaatatccgaaaaataggataaacaaaggttgggagaggattaggaaggcactggggtagggtggaaaaaaaatggtattgagaaccttcccagggtgggggggtaggagagagttaaaagtaaagatagc

SEQ ID NO: 573714 - DNA, 172 bp, Homo sapiens
ctgtgccagatgagcatagtggcatgatcatactgtggctcacctcctggatcaagtggatctcccacctcaactcttgagcagctggggcacaggcatataccatgccagctaatctcttcaatttctggtagagacagggtctatgttgctcaggctggtctcgcactcc

SEQ ID NO: 573715 - DNA, 183 bp, Homo sapiens
  misc_feature (163)..(163): n is a, c, g, or t
ggtgatgattcgggaggtgaggaggagaatcccttgaacctgggaggtggagtgtggtgagctgagatcacgccattgcactccagcctggcagcaagaaagaaattccgtctcaaacaaaaaaaaacaacaacaaaaagaacttgtgcctcctgatgaaatnaggcccacccctgtttcaaa

SEQ ID NO: 573716 - DNA, 1712 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1364)..(1364): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaggtgatcaggaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaggagaaaaagagaaaaactcgggactagtgctctccaacgggaacgggtcccagctgaggggtaggcaggtcggcgggaaggccaaggcgagggcttaaaaacgccaacagggttgcacagccaaggagtgcaagaccaaatataatagccgagtggcccagatgtccggggagaagacccngcagctggggagtgcgggcctggataggcatgggaaggacttgggatagaaacatgagaagggcgccctatcatcccaagaagcagagggagctggatcctcccagagaacaataaagccctggcgggtatgcgccaggccaaggggggcctcaggggaaccagagagaacagcccgggtaacgcaagacgagggcgcgggaaacgcagagaaatgtggccacaaaaaaaccgggggggacccacagcgaaaggccatgggcagagaaagcccaacgggagacagaacgcggcgacaaaaagtcgcggcggcaaaaagagacgggcgaatggagcacccacaaaagga

SEQ ID NO: 573717 - DNA, 422 bp, Homo sapiens
  misc_feature (99)..(99): n is a, c, g, or t
  misc_feature (161)..(161): n is a, c, g, or t
  misc_feature (191)..(191): n is a, c, g, or t
  misc_feature (300)..(300): n is a, c, g, or t
  misc_feature (312)..(312): n is a, c, g, or t
tccgtcccaggcagtggattaggaggccagaaggagatcccttccacggtgctaggctgagatggatcctctcagggcccaacagctggctgcggactnggaggtggagatgatggccgatatgtacaacagaatgaccagtgcctgccaccggaagtgtntcctcctcactacaaggaagcagagctctnagggcgagtctgtgtgcctggaccgatgtgtctctaagtacctggacatccatgagcggattggcaaaaagttacagaattggctatgccggatgaagagcctattagnaaggtgcccccnaactcttgggcctgatgagggccctttcaatataccccctggggggttgtccccacccccttcccactttaattaaactgcctccgtgtgggggggtacttttgtgaaaa

SEQ ID NO: 573718 - DNA, 1364 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtggggttggaggttatttccataacaaattgccactattaagttgcttaaaacgacacaattttattatcttacagttctggaggtcagaagtccaaaatcagtctcattgatttaaaatcaaggtgcccttgggactatgttccttctgctacaccttttaggagagaatccagttcctcaccttttccagcttccagaagccacctgcattccttggctcataaccctgttcctccgtcttcaaagtcagcagcctcatgtaacctgccacgtaacacctacatttgatgactacagatataggtaatactcagagatcaactcaaggcctggggtaggagtccccatagccgt

SEQ ID NO: 573719 - DNA, 227 bp, Homo sapiens
atggccagttgcttctagtacctgatgcatttttacatattggcagagctaatagacccctcagaggtactcgtagtacttggatgctaatatgctggcagcttttctcgtcgacaaatctgggtccacaaatcctttctctaaaagtctaaattctggtaaactctgaactctcctctcttgtctccccagctccaggggttgtaagtaatcttgtataaattaat

SEQ ID NO: 573720 - DNA, 1432 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1270)..(1270): n is a, c, g, or t
  misc_feature (1273)..(1273): n is a, c, g, or t
  misc_feature (1282)..(1282): n is a, c, g, or t
  misc_feature (1298)..(1298): n is a, c, g, or t
  misc_feature (1310)..(1310): n is a, c, g, or t
  misc_feature (1322)..(1323): n is a, c, g, or t
  misc_feature (1327)..(1327): n is a, c, g, or t
  misc_feature (1334)..(1335): n is a, c, g, or t
  misc_feature (1339)..(1340): n is a, c, g, or t
  misc_feature (1354)..(1354): n is a, c, g, or t
  misc_feature (1366)..(1366): n is a, c, g, or t
  misc_feature (1387)..(1388): n is a, c, g, or t
  misc_feature (1393)..(1393): n is a, c, g, or t
  misc_feature (1399)..(1400): n is a, c, g, or t
  misc_feature (1406)..(1406): n is a, c, g, or t
  misc_feature (1410)..(1410): n is a, c, g, or t
  misc_feature (1412)..(1412): n is a, c, g, or t
  misc_feature (1415)..(1415): n is a, c, g, or t
  misc_feature (1422)..(1422): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatgggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcggctacaaaaaaaaaaaaaaaaaaaaaaaaaaaaaaaaaaaaaacaaaaaaaaaaaaaaaaaaaaaaaaaaaagaaaaaaaaaaaaaaaaaaaaacaacacaaacttgtgggcgcgcggccttgggccncgngaaaaaggnttttcaaaaccactcncggtggggcggngggggccccagnnaggntataggnngacnnggggccaaaagcgnggtcccaaaganaacacccggggcaaggcaacnnagggngctggnnttctcncacnantanaaaaaanggcgcggggg

SEQ ID NO: 573721 - DNA, 1241 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1236)..(1236): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatgggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggcaaaaaaaaaaaaaaaaaacaaaaaaaaaaaaactttttggggcgccctgggccccgagaaaaagtttttaaacaccatttgttggggggccgcgngggcc

SEQ ID NO: 573722 - DNA, 723 bp, Homo sapiens
tggctctgctgctccctgaggtgacttaacctgcgccccgcatcatgtcaaagctcgccgggcccccggggcctcaggaagcccgagagaggcgtttccctcaaccgttttgcccaggagttccatgagaggcccaggacctcaaggaaggcattcctctgcctacccagattttagtgaagcctgaccggacctttgaaattaagattggaccagccccctgtttcctacttcctgaaggccagccaactgggattgaaaagggggccccggccaaccagggaaagaggtgccagcctggtgacccttgaagcatgtgtatgagattgcccgccatccaagctccggatgaggccatttgccctgccaggatgtacccctcgtcgtctgttgtccgctccatcatcgggtctgcccgttctctgggcattcgcgtggtgaaggacctccgttcagaagagcttgcagctttcccgaaggacgagccatcttcctggctgctcagaaggaggcagatttggctgccccagaagaagctgcccagaagtgacccttgccccccccagctcccagatttcaaaggaggtagttgccaaagctgtgcccaccaggggaggaaggaggtcacccccatatgatgatggttttcatgactttgaatgatatatttttgtacatctagctgtattcgaggcatcaggcctgaataaacatcctttttta

SEQ ID NO: 573723 - DNA, 1534 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (936)..(936): n is a, c, g, or t
  misc_feature (940)..(941): n is a, c, g, or t
  misc_feature (950)..(951): n is a, c, g, or t
  misc_feature (956)..(956): n is a, c, g, or t
  misc_feature (1232)..(1232): n is a, c, g, or t
  misc_feature (1381)..(1381): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagantctnnccaagaganntaatngtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573724 - DNA, 175 bp, Homo sapiens
aactctgatgcttagactcctgacagtctcctgcctactcctccctgaccagtcctccagccctaactcctccctgaccagtcctcctgccctaactcctccctgaccagtcctcctgccctagcctccctaaccttgccaagaggcagtctggagagtctgaaggcagtctgga

SEQ ID NO: 573725 - DNA, 100 bp, Homo sapiens
attccattctataggtttggtcctagcctttcattagctcttagtaagattacacatgcaagcaatgctgtccctgtcctgcccaggttctatgttcttg

SEQ ID NO: 573726 - DNA, 1542 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (893)..(893): n is a, c, g, or t
  misc_feature (899)..(899): n is a, c, g, or t
  misc_feature (923)..(923): n is a, c, g, or t
  misc_feature (1240)..(1240): n is a, c, g, or t
  misc_feature (1389)..(1389): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttaccaagncatgcntgttggccattggtgtgtcaaacnaacacacagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573727 - DNA, 387 bp, Homo sapiens
ggcgaggttgtcgtacagccctggacctataagtcaaagcttatctcaaaatatatttattacccaagctgctcccgacattaaattaaaactccaaaaattaaattccggccctcaaaccccacaacaggatttaattaacctcgccttcaaggtgtacaataatagaaaaaagttgcagttccttgcctccactgtgagacaaaccacagccacatctccagcacacaagaacttccaaatgcctgaaccgcagcggccaggcgttcctccagaacctcctcccacaggagcttgctacacatgccggaaatctggccactgggccaaggaatgcccgctgcccgggattcctcctaagccacgtcccatctgtgtgggacccca

SEQ ID NO: 573728 - DNA, 131 bp, Homo sapiens
gacttagcgatgcttatgtctcgatcgttatggggcgagtagtctaagatctctagctaggaagggtgaccagagagggcagacagcagtcctctgtcccaggtcttctatagcaaggaacacggagatct

SEQ ID NO: 573729 - DNA, 109 bp, Homo sapiens
aggatccccgagctgttcttcaagaatagtattgtcagatgacgaaatatacctgcgtcttccttttggtgtttctccaattatgacggtggtctggtttgtatggggt

SEQ ID NO: 573730 - DNA, 693 bp, Homo sapiens
  misc_feature (63)..(63): n is a, c, g, or t
  misc_feature (66)..(66): n is a, c, g, or t
  misc_feature (122)..(122): n is a, c, g, or t
  misc_feature (196)..(196): n is a, c, g, or t
  misc_feature (202)..(202): n is a, c, g, or t
  misc_feature (209)..(209): n is a, c, g, or t
  misc_feature (215)..(215): n is a, c, g, or t
  misc_feature (303)..(303): n is a, c, g, or t
  misc_feature (376)..(376): n is a, c, g, or t
  misc_feature (382)..(382): n is a, c, g, or t
  misc_feature (411)..(411): n is a, c, g, or t
  misc_feature (431)..(431): n is a, c, g, or t
  misc_feature (484)..(484): n is a, c, g, or t
  misc_feature (527)..(527): n is a, c, g, or t
  misc_feature (542)..(542): n is a, c, g, or t
  misc_feature (558)..(558): n is a, c, g, or t
ggcggcgacggcggcgaccccaccgcgcatcctgccaggcctccggcgcccagcgccccacgngcncccgcgcccccgcgcccccgcgcccctttcttcgcgcccccgcccctcggcccgcnaggcccccttgccggccacccgccaggccccgcgccggcccgcccgccgcccaggaccggcccgcgccccgcangccgcncgccgcncgcgcngccatgggagtggagggctgcaccaagtgcatcaagtacctgctcttcgtcttcaatttcgtcttctggctggctggaggcgtgatcntgggtgtggccctgtggctccgccatgacccgcagaccaccaacctcctgtatctggagctgggagaaaagcncgcgcncaaaaacttctatgtaggcatctacatcntcatcgctgtgggcgctgtnatgatgttcgttggcttcctgggctgctacggggccatccaggaatcccagtncctgctggggacgttcttcacctgcctggtcatcctgtttgcntgttaggtggccgcnggcatctggggctttnttaacaaggaccagatcgccaaggatgtgaagcagttctatgaccaggccctacagcaggccgtggtggatgatgacgccaacaacgccaaggctgtggtgaagaccttccacgagacgcttgactgctgtggct

SEQ ID NO: 573731 - DNA, 193 bp, Homo sapiens
atcgagctcgtacctgtaatccccatacagagtaacgcgacgattaatggacagactgatgttggagtctatgctcatctggatgtacattccagatcaaactcaatgccccgggctccgacccataggggaatgcagcgggacataataagctcagcagtggcccagcccagggcagcaaaccatgatctcg

SEQ ID NO: 573732 - DNA, 988 bp, Homo sapiens
ggcatcacttcctctcaagaacttgacgtatgtgaggtgggcgttacacgcggattcaacatgcgtatcgaaaagtgtaattgctgtctcagggtccagtctatcctgcgtacaagatcatgcatgttcagtaccgtctgacgattagcaagggtgttcaggattttgcaagatctaacatgtcatagaaaagcgttccattgaatgaagtcgctagatcctcgtcaacagttaggatgtgacccaaatgcattccggcaaagcagctggtaatagagctgtacagtggataagttcatttgaatttgcatgaaacgtatcaatatgaacctatcaaataccagcgagagctatggaataacactattgatgcgatgaacgagagtgtgaagaacaatcactccagcaagcggccgagcttaaatttcagtaatgaaaccaagattggacggataaaatgaggaggacgctagccggacaagtccaggatactcaagtgcaaggtcaagcaaatagggatccatcttatcgcgagccccctcttggcgggcaaagggaaacgaaggttgcaagagacattggtacagcctgttaactcagaggacatgtgagagcttggaagatgctccttatgaatctctgtcaagcatttctgtgatagtacctgggaccaatgcccttgtggatacttggagagctggtaaacttatgattagttggtgaacacttacgggtccgtttagaattgaagacccgcggatttacaaaggaccttcttttcgctgcattgtggccatccttacaaaagtactcagatatccagggatgtagatttgcttgtccagttgttaaatccttgtagcggggataagatgtacataaggtaaagtcagttgaaaaatcctacttcggacacttgaagaaggtgaattgtggccgtcacaagggtgagctacggacaaggggctcagcagggttgatagtatag

SEQ ID NO: 573733 - DNA, 83 bp, Homo sapiens
agcggaggtctctcgtcgctgcaggcgcctcagcccagccgcgtgccttggcccatggccgcctactcttaccgccccggcct

SEQ ID NO: 573734 - DNA, 409 bp, Homo sapiens
cagtgattaggcttcaatgacagcatccaggattaccatatcctacacacctctcttcttgtgggtcgacaaagctgctcccgtccacgtagagctcccagtctactgttgtccaaggatggtctcggaggtcgggcctgctagaataaactgactgcaacacctctacacagttatgttcaacgtggctctctgataccaggagcaaggtggcggggttcagggtgtagcaaacttcaatggttatgcggggattctcacagagcaagctttggtacctagttagtctagcattcgttagccagttacgtccttgggtgttcattagtgttaccacagcatggggaggcctttatgttttttctttttttttgagatggagtctcactctatggccccgggccgaatg

SEQ ID NO: 573735 - DNA, 249 bp, Homo sapiens
gctcgacgcttttctagcatggctaataagttctgtgtttgagcagcttagacctcaggctactagtatgttgaaatcaattatgcaaagcccattcattttgatacaatgtactaaactgctgctgtcaccacagtagaatggctactcagattggtttcttggatttttccctccctcctctgctttttttttttttttttttttaaaccatcacaatgttttcatccattgccaaagttgtcgacg

SEQ ID NO: 573736 - DNA, 383 bp, Homo sapiens
gggtacagtggtgtgatctgctcaccgaaacctccacctctcgggttcaagcaattctccctgcctcagcctcagctgggattacaggtgcccgccaccacacttggctaatttttgtatttttagtagagacggggttttgccatgttggccaggctgctctcaaactcctgatctcaggtgatccgcctgccttggcctcccaaagtgctgggattacaggcgtgagccaccgcgcctggccgagggaggtgaaactttacaggctccaagactagtgtccctggaaggcagaggagccttgggctgctctgttgggttctgggcccctggccgcaagtttctgtatttcctgatctctagtactctgatcccgggtgttc

SEQ ID NO: 573737 - DNA, 554 bp, Homo sapiens
tccacgttttcagcgggataccccccctctatgagagatccccggcacactccctcccgaaacgtttcaagagtcttggggtgtaacaattgccgccacttgtgtcactggtgccgagatagatatgtagtagagtacaccttcttgctgatgccccacgcacccgctagtgatgcccgtaacccctctgttgttccgccgcttagctgtaccacgcggtcaacaaataccacaccccgggcatgtgctcatgctatcgctggccacacacagtgggtggcaacaatcggagaatctaccccgcgggagtagaaatcattccttgtctcgaccaactctatcgggagcataaatcctaatccagtccccccgaagcttgacctccgcctgcccgtgcagagggatggtgacacgcctcccccaaggcggagtcatcatttgggaaactatactgatgaaataacaagactgatagtcagaagcccttggtctttcaccccctctcctcccaatacataaagggaaaacccaataaaccccacccaaacaaaaca

SEQ ID NO: 573738 - DNA, 852 bp, Homo sapiens
tctcctgtgtcctatccctttatgtccccccctcacagaggtccagtctcacaccccaataaaaacacttcgggaaccaccaaacggcctataaaatctctagaactcaccttccttgtaaaattataccgcttccctaatagcgttccttaacgccccttatacaaatgtgtctaaaccccccgtcccttatatttatacgaagtagttgttgttactattccaaacccctatttttctcttttctccgacacccgacccctctctgtgaaatttggcccccctctaattggccgcagccctgttgccccccccccaattatggggcctccccccctaataataaaaatgggcccctcttccttaagcccccacccaacagggagtcttccttaacacgggtgtttatctaccaccagttggatattgctgaacacgaacaccatgttgaaacattgcaagaaaacttattttgccgaaaaaactttcagcgtataactcttggcaggagccacactacaatctgttataaacaagagtccttttatcccccacgcgccagtgtaaccactgtcttctcctctccaacttccattctgcacatctcccgaaggcaaaaaatcggccacggtcaactcattcaatacttctttcctgtgaaaaatattcaccacgaccattttaacccccggtcgatagctgatgggcccccgaagacctaagagggaagcccattcccaaagtgtctacccatagacacaccaaaagccaataccatattccccccgtttctcccacatttttctaggaccccgagccatgccaaatcccctttcacggttcaaaaaacca

SEQ ID NO: 573739 - DNA, 200 bp, Homo sapiens
agtcaatagccctatgctacatcaaaaagtctgaaaaagcaccaacacacaatctaaggtcacacctcaaggaactagagaaacaagaacaaaccaaacccaaacccagcagaagaaaggaaataaccaagattatagcagaactaaattaaattgaaacaaaaaaatacaaaaagataaatgaaaccaaaagctagttt

SEQ ID NO: 573740 - DNA, 379 bp, Homo sapiens
  misc_feature (13)..(13): n is a, c, g, or t
  misc_feature (23)..(23): n is a, c, g, or t
  misc_feature (29)..(29): n is a, c, g, or t
  misc_feature (32)..(32): n is a, c, g, or t
  misc_feature (87)..(87): n is a, c, g, or t
  misc_feature (379)..(379): n is a, c, g, or t
ggaccctctaganctaagatggncaccanganggcaccccaaccagagccctatgttagctgagcggatgaccacacgagaagagtncacttcaggccagactaacttagagacagctgtggtggcccttacttaggaccaggccttagaggcaggcacagggggagccactttggcccagaccatttctgaggcagccattgggggagccatgctgggccagaccaccttagagggctgtcgggggagccacttcggaccagaccaccttagaggagactgtgggaggagccattctggaccagaccaccttagaggatgctgttgggggagcccgctgggccagactatctcagaggaggctgtatgaggagctacn

SEQ ID NO: 573741 - DNA, 1015 bp, Homo sapiens
  misc_feature (250)..(250): n is a, c, g, or t
agcggcgtgatgcgcacggctcccatgcaggcaggcgcgctcggcgcgaggtatgagcagatgtggcctggtgaacgcctggtcgcgccgtattcttctgaggtgccacgcgtgccgccgccgcacagctcagcgcatggccctagcctgcgttgtgcatttctaggaggtgggacgctggaagagcactctgcgtgagcttgtgcacgttgtgaaggagttgatgctgaggtcactctgctgtcctcgntcacgtgtgcgctgcacatcctgcgatgtgtacgagacgtactctcgcgaaggaagaatccttgacatcattcgtagtgtcacagacaacgttactctagggtcactggagtcaagtccatcacctgtagtgtggaatccagtgcagagtctgctatggtctcttggagtggagtttggtagacttggtcctcagtcgtactgctccagctttaatcttgtgtgataccccagaatgcattccagcaagcatatctagaaacgcagagaaagatagcctctgcttaccatcctaggcggtgcagcgatagtccatcgctctagtcccagtctgattagtgatcgcctaaacgtccgcgccatcgtttgacggcctctgtcatgacgcaccagatggaacgctaagtcctagtcggcactgacgcgtgtaaccatgtcctaccagtcactcgaacggctagtccggacttgttgcaatggctccagcaaagtaaccaggttatcagcacaccttggaacattgcgccgaacctaggacatgcgcaagctagcagagagcgtcgcaagaaggcgatctgagcttgcgccctgagtgagccacttgtatttgggcgcctatttcccattggcattggccgaccatacggaacccccttgcgagggaggatctatgcttgccctcgacctactagagtattggcggcaccagatcagccttgctgtggtgtgaatgggcccatgtcaacgatcgattcagttccagcct

SEQ ID NO: 573742 - DNA, 101 bp, Homo sapiens
ctccacattctcttttgaaatgccccccacgcactgccaggcaatctttcatccccactacactactaaaaatactctaactaagatcaccaacctccctg

SEQ ID NO: 573743 - DNA, 170 bp, Homo sapiens
ccaacacgctcggcgtacaggtacacagcacgcgcaagatgaagacagagacagcagatgcgccgaaggctgtggagtacttgttgaccccactcaggagtccctcaaagatactccagttcatggtggacccacgcgtcagctgctaccgactgcttggattacaagga

SEQ ID NO: 573744 - DNA, 194 bp, Homo sapiens
  misc_feature (175)..(175): n is a, c, g, or t
accatactactcagagaacctcagtgtaccacgagagcagagcactggagcacatttctgtcccagcgcagggggcaggattaaggatgtgccagagcctcaagatccaatggctggccccagcatgatgggctgggcccaggggattgtaaggagagaccaggcctccagctgngtatgggacagatgtcggg

SEQ ID NO: 573745 - DNA, 1487 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1185)..(1185): n is a, c, g, or t
  misc_feature (1334)..(1334): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573746 - DNA, 243 bp, Homo sapiens
agccttggtggcagagtgagatcttgtctccaaaaaaaaaaaaatttatgttaggcttggggacagttggcaatgtaataaattaagtcgggggtggcctctttagtaaaatttgagcaaaaacttgaaggagggaaaggattgggccagggtgctgaggaaagagctttgtaggttgaacaaccagaattagggtgtctgaggtgtgtctgaggctctgaaaggagcggtgaagcactcatt

SEQ ID NO: 573747 - DNA, 469 bp, Homo sapiens
ctctgagatactcaattaagtcaataaacacatctacaccatcacactcacatagttaccatttagtgtgatgagaacactatatgatctactctcttagcaaatatcacgtgtacaatacagtattattaactacagtcaccatgctatacactgggtccacagaacttactcatcttacataactgaaagtttgttccctgtgaccaacatctcctttcccccaccccctggcaaccactgtacggctctgattctatgattttgacttttttggatttcacatctaagtgagatcatgcagtatttccctttttgtctctgtctcatttacttagcataatgttctccaggtttatccatgttgtcgcaaatgataggatctccttatttatggctaaatgatattccattgtggatatgcaccacgttttctttctccatgtatctgtcagcgagtacttaggtt

SEQ ID NO: 573748 - DNA, 1547 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (967)..(967): n is a, c, g, or t
  misc_feature (969)..(969): n is a, c, g, or t
  misc_feature (971)..(972): n is a, c, g, or t
  misc_feature (986)..(987): n is a, c, g, or t
  misc_feature (991)..(991): n is a, c, g, or t
  misc_feature (996)..(996): n is a, c, g, or t
  misc_feature (998)..(999): n is a, c, g, or t
  misc_feature (1002)..(1002): n is a, c, g, or t
  misc_feature (1006)..(1006): n is a, c, g, or t
  misc_feature (1008)..(1008): n is a, c, g, or t
  misc_feature (1019)..(1021): n is a, c, g, or t
  misc_feature (1245)..(1245): n is a, c, g, or t
  misc_feature (1394)..(1394): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgtnantnngcacattaattctnntggnaggantnntgncttnangatgagtgtgnnngaagatgatctgaaaaagaatgaaaccaagagagaacggtaccgtgggttcgatagtagagagcgctcgagtctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaaacccgngggcatcaaatggcggggggcgggaaaaaaggggtactggaatgggccatgggccaaagcggttccctggacccagttttcctggtccaagggggaaatcggcggggccccaaaagggaggcggaaaaattccgaaaagccaggtaccnggtagagaatcggcgaccaaggccgccgggaaccaagacacccgcgctagtgacgcggtctataggggggacgcaagcgagtctggagagaccacgaattcgcgggcgcagaacagcggccagagaacaaaagaaaaaccagccagcgccgac

SEQ ID NO: 573749 - DNA, 1023 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgccatagcactctaggccgatagctctgacgttaggaatgtcagaagagagcaagaggt

SEQ ID NO: 573750 - DNA, 1016 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1011)..(1011): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttatacaaaaataaaaaaaaaaaaaaaaaaaaaaaaaaaaaaaaaaaaaacaaaaaaaaaaaaactttttggggcgccctgggccccgagaaaaagtttttaaacaccatttgttggggggccgcgngggcc

SEQ ID NO: 573751 - DNA, 1008 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttaaactccgtctctactaaaaatacaaaaattagccgggcatgatggtgcgtgcctgtagtcccagctactcgggaggctgagacaggagaattgcttgaaccctggaggcagaagcaggaag

SEQ ID NO: 573752 - DNA, 190 bp, Homo sapiens
  misc_feature (1)..(1): n is a, c, g, or t
nctcaccgcatcacacctgaaggaaggcaagggcagaaacggagacaggttgctactgcagtacaacacgtgaaggctggaggtcgcttggactgagtcagaacagggaaactgatgggaagctgtcggagagaggatgagaaaaccagccaagaaaaacgagaaggatcatccagtaaagcataaaaag

SEQ ID NO: 573753 - DNA, 1286 bp, Homo sapiens
  misc_feature (537)..(537): n is a, c, g, or t
  misc_feature (545)..(545): n is a, c, g, or t
  misc_feature (548)..(548): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (596)..(596): n is a, c, g, or t
  misc_feature (624)..(624): n is a, c, g, or t
  misc_feature (1286)..(1286): n is a, c, g, or t
gaggtcagtctcgctatattgcccaggctggtcttgaatgcctgggctcaagcaatcctcccaccttggccacctgaatagctgggactacaggcatgtgccactatgcccagctaattttttgtatttttagtagagatgaggcaatatttttaatatagctaatgcatgatgttaaaaactttgcatatggaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcattatacaatacagacaaaagtgagcttttccagttnaagtaggngtntgatntnaaacacacccntggccccaacaaaacaaataaaactcccantcttattttaagagcttgttgaagaganttattaagtaacgccgcccttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgcaaaaaaaaaaaacaaaaaaaaaaaactgttcggttggcgccgcgccttcggccctctgagaaacacgctttttcttacacaccacttccggtttgggcacgcccgcgggccccaatgctagggttacgatgtgaaccacagggtgggctaaaatagcgatgttccctaaggggagagattccgggggctcaagtgcaatattggtgtgctggagaaatctcattcacaacagaccatttttggaaaaaagcgccccgcggggggagcaacaacccgcgaacgtgggtttctctatgaaaagccaatttcccgcgagagatgggagagtcacacgaagaaggctcaaatcagagggggaattcatgtcaacgacggggagattgtttcaaaagagaaaacatcgcagaataattcaaaatataacgccccccgcccggtgtgatn

SEQ ID NO: 573754 - DNA, 564 bp, Homo sapiens
  misc_feature (148)..(148): n is a, c, g, or t
agactccttagcatactaggtcacatggaacttgcggtcattcccaggctcccctggaaactctctgtgggtggcagcgtgaggaggacttacccgaggccgatgagccacagaagcgggactgaggttgcgtcacaccccgtactgncacctgggaattactctggagattctttttttattttttattttttagagatggggtctcactctgttgcccaggctggagtgcagtggcgcgatcttgctcactgcaagctctgcctcccgggttcacgccattgtcctgcctcagccttccaagtagctgggactacaggcgtccggcaaaacgcctggctaattttttggtatttttagtagagacgtagtttcaccgtgttaggatggtctcgatctcctgagctcgtgatccgcccgcctcgggctcccaaagtgctaggattacaggcgtgagccagcgcgcccgggcagaattgttcgtaggtatgtgtgaaacgaaggagtccgcgctccgtgggcccgggtgaagtgcagtgggcgatctctggtcactgtaactcc

SEQ ID NO: 573755 - DNA, 758 bp, Homo sapiens
  misc_feature (228)..(228): n is a, c, g, or t
  misc_feature (273)..(273): n is a, c, g, or t
  misc_feature (279)..(280): n is a, c, g, or t
  misc_feature (287)..(287): n is a, c, g, or t
  misc_feature (289)..(289): n is a, c, g, or t
  misc_feature (293)..(293): n is a, c, g, or t
  misc_feature (309)..(309): n is a, c, g, or t
  misc_feature (335)..(335): n is a, c, g, or t
  misc_feature (416)..(416): n is a, c, g, or t
  misc_feature (419)..(419): n is a, c, g, or t
  misc_feature (452)..(452): n is a, c, g, or t
  misc_feature (462)..(462): n is a, c, g, or t
  misc_feature (467)..(467): n is a, c, g, or t
  misc_feature (469)..(469): n is a, c, g, or t
  misc_feature (472)..(472): n is a, c, g, or t
  misc_feature (474)..(474): n is a, c, g, or t
  misc_feature (476)..(476): n is a, c, g, or t
  misc_feature (478)..(478): n is a, c, g, or t
  misc_feature (480)..(480): n is a, c, g, or t
  misc_feature (497)..(497): n is a, c, g, or t
  misc_feature (508)..(508): n is a, c, g, or t
  misc_feature (518)..(518): n is a, c, g, or t
  misc_feature (525)..(525): n is a, c, g, or t
  misc_feature (530)..(531): n is a, c, g, or t
  misc_feature (544)..(544): n is a, c, g, or t
  misc_feature (546)..(546): n is a, c, g, or t
  misc_feature (548)..(548): n is a, c, g, or t
  misc_feature (721)..(721): n is a, c, g, or t
  misc_feature (725)..(726): n is a, c, g, or t
  misc_feature (731)..(731): n is a, c, g, or t
  misc_feature (736)..(736): n is a, c, g, or t
  misc_feature (740)..(740): n is a, c, g, or t
  misc_feature (742)..(742): n is a, c, g, or t
  misc_feature (751)..(751): n is a, c, g, or t
  misc_feature (755)..(755): n is a, c, g, or t
ggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgcccgatcggagggggcgaaattgacgccagtaagaacgaggaggatgaaggncattcaaactcctccccagacactctgaagcagcgacggcacagngggaannatggganantgtntataggaggccttagntgggacactacaaagaaagatctganggactacttttccaaattgtggtgaagttgtagatgcactctgaagttagatcctatcacagggcgatcaaggggttgggnttntgtgctatttaaagaatcgggagagtgtagatnaggtcatggntcacnangancntnantntgaatgggaaggtgatngatcctaaaangggcaaagcnatgaaancaaanngagccggttaaananantttttgtggtggcctttctccagatacacctgaagagaaactaagggagtactttgggtggtttggctgaggtggaatccactagagctccccattgggacaacaagaccaataagaggcgtgggttctgctttattaccttttaagggaaagaagaaccagtgcagaagatntggnnacagnaattnccanangtggtcttngtanatg

SEQ ID NO: 573756 - DNA, 339 bp, Homo sapiens
  misc_feature (284)..(284): n is a, c, g, or t
  misc_feature (319)..(319): n is a, c, g, or t
aaaggaagtcgccagatcttaccccgcctgtttacccaagacgtcacctctagcatcaccagtattagggccccgccttcccagtgaaacatgtttaacggccgcggtaccctaaccgttcgaaggtagcataatcacttgttccttaaatagggacctgtatggatggctccacgaggggtcaactgtctcttacttttaaccagtgaaattgaccttcccgtggagaggcgggcatgacacaacaagacgaggagaccctatggagccttaatttattaatnccaacagtacctaacaaacccacaggtcctaaacnacccaaccttcaataaaaaa

SEQ ID NO: 573757 - DNA, 690 bp, Homo sapiens
  misc_feature (160)..(160): n is a, c, g, or t
  misc_feature (205)..(205): n is a, c, g, or t
  misc_feature (211)..(212): n is a, c, g, or t
  misc_feature (219)..(219): n is a, c, g, or t
  misc_feature (221)..(221): n is a, c, g, or t
  misc_feature (225)..(225): n is a, c, g, or t
  misc_feature (241)..(241): n is a, c, g, or t
  misc_feature (267)..(267): n is a, c, g, or t
  misc_feature (348)..(348): n is a, c, g, or t
  misc_feature (351)..(351): n is a, c, g, or t
  misc_feature (384)..(384): n is a, c, g, or t
  misc_feature (394)..(394): n is a, c, g, or t
  misc_feature (399)..(399): n is a, c, g, or t
  misc_feature (401)..(401): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (410)..(410): n is a, c, g, or t
  misc_feature (412)..(412): n is a, c, g, or t
  misc_feature (429)..(429): n is a, c, g, or t
  misc_feature (440)..(440): n is a, c, g, or t
  misc_feature (450)..(450): n is a, c, g, or t
  misc_feature (457)..(457): n is a, c, g, or t
  misc_feature (462)..(463): n is a, c, g, or t
  misc_feature (476)..(476): n is a, c, g, or t
  misc_feature (478)..(478): n is a, c, g, or t
  misc_feature (480)..(480): n is a, c, g, or t
  misc_feature (653)..(653): n is a, c, g, or t
  misc_feature (657)..(658): n is a, c, g, or t
  misc_feature (663)..(663): n is a, c, g, or t
  misc_feature (668)..(668): n is a, c, g, or t
  misc_feature (672)..(672): n is a, c, g, or t
  misc_feature (674)..(674): n is a, c, g, or t
  misc_feature (683)..(683): n is a, c, g, or t
  misc_feature (687)..(687): n is a, c, g, or t
ggaggagcagttcggcggggacggggcggcggcagcggcaacggcggcggtaggcggctcggcgggcgagcaggagggagccatggtggcggcgacacagggggcagcgccgatcggagggggcgaaattgacgccagtaagaacgaggaggatgaaggncattcaaactcctccccagacactctgaagcagcgacggcacagngggaannatggganantgtntataggaggccttagntgggacactacaaagaaagatctganggactacttttccaaattgtggtgaagttgtagatgcactctgaagttagatcctatcacagggcgatcaaggggttgggnttntgtgctatttaaagaatcgggagagtgtagatnaggtcatggntcacnangancntnantntgaatgggaaggtgatngatcctaaaangggcaaagcnatgaaancaaanngagccggttaaananantttttgtggtggcctttctccagatacacctgaagagaaactaagggagtactttgggtggtttggctgaggtggaatccactagagctccccattgggacaacaagaccaataagaggcgtgggttctgctttattaccttttaagggaaagaagaaccagtgcagaagatntggnnacagnaattnccanangtggtcttngtanatg

SEQ ID NO: 573758 - DNA, 498 bp, Homo sapiens
  misc_feature (497)..(497): n is a, c, g, or t
atgcccagcctaccacatctgtgtattacagttcaccatgagattcgggtggggtctgtagggcgtgtgactggattagtgagggtgcatttctcgtgactggtaaaacactatctccttggtactcctcgatgatagcatggtgagctctcacaagtatctggtatgaaaaaatagtgtgtggtatctccccccatcactctcttgttccgtgctttcacgtgtgtaacaatgccatgctcccgcattcacaattctgccagataaattgtggcaggtaatgagtgtgtgtaataaatgagtgctgataggatgaaagatagaaaatgatataagatagaaagaaaatcattctggaagctttgagtcttcctttagtaatcatatgtaggttcttttttaccatcccctgttacagcacttactgacctggagtctgtctcacaaatgactaaatgtcatatacgattctaggatgtacactagaactgaaaggng

SEQ ID NO: 573759 - DNA, 1265 bp, Homo sapiens
gaatatacgaccatgagagtctcctccccgtgggtgtcaccaggtcgtacatcgctagtagaatccaaaaatcacagtagcagagggatgtgatcgaggtagtgcatggtgtaagacgaggacatgcggtagctgattaaatgagtatatggtacgtgccaagagcaaaccgggtagtgtcgagtcaaatcagctgagtatctcaccttctctgggaaggcgactagagctagctagagtgctgagggtcaagagttcatagtgcatgagttgcttggaatcggagacaacgaatgtcagggaagaaaggcaggcttgtccgcgtctcgatccccggatcttttgcagagttagccataggattgcgacagacgcagtggtcgtcggagtcgttgcagacatgcaggtataaggagctaaacgctgtggaaacctggtggttggctcctcgttgtggtggtcatcacgagacattgggtgcattgggtggcaccctgatagtgggtgcaagatggtgtgctacttgaaggggatatggaaacaaggcgaatggctcgacgtgtcacagtcactgggagcttcttagccgttgaccaacattgcacgtatcccgcttgaatcccgatgaaagcttgaagctatcaaagagatgcacatctctagaccttgcatccgcttataacatccctggtaccacttgagcgtgtgtacagcatgcgtgaatgtatacgacaggtaaagtaccaaaacagcgagtctagtgaagacatcatttatcgcaaagtacaacaagggtttggttcgtggcaaccaagggcaacagattacaaccgaatgagatggaaatgaggaaggccttaagtcacaagtacggccaaagacggtaagacgggcatggacccatggacaacaagggcgcatccccagaccggggagaaaaaaacgaagacaagcaacggagagtcggaataacagcccttaaaggatgagagacacatccacatggtcggggcaaagagcggggcgagaagccctgcgacgagacggaatgtgtgagcagcacatgcatgacaggtaagcccaaagcagggcgtcacagggcacaacacaggacgaaagatatagactacagcggtcagaaacgagacagccgacacagtgacatgagcatacaacagtacgcgacaagaacgacagatgagccagaacagggacccacaacacgcacaatgaatcaacgacatgcaaaagctacggcacgcaca

SEQ ID NO: 573760 - DNA, 923 bp, Homo sapiens
ggtgccgggtaggggccgtcgggtagagggtgaatagcagttgccgagcggaaaggaatcgatggtgattgatagtgtgtatgtggtgaacaaagctaggcagggattgagtttaccagttgtggacacggtacgacgaacgaggggggctgagggctgaggaagaggtttcagtttatacggctggatctggtggtcaaggctagatcgaggagcgtgtgtggttgcattatggggcagaggagaaggaaatcgcgattggggttcagtgccagtgactggcctagtctgggtggtaatggacgtgatatggacaggtataacggccggggggaaagaggtgctggggctatctgtggtaaacccatggtaagatataagcgcggagtcccaattacggatttatggccggaccccggtctcactgctaatgaagaaggtctatggtggcctccatgttccactcgccttctgtcgccattgcggtttcccagtgtgtctccttgacatcaagagtaagctctacggcacttgagatgttggagaacatgactggattcggacattgctacttgtgacgagaccactgtggagtggatcaaagttagggtctagggagatcctaggtaagttgggatagagactcttctccgaaagatcatgagattaatgcagactttgcctcaagaatcatgctatgctttagaaagtgctataagtgtgaagtcttgacagtaactgagctactcctggaggggcggagaaggcggcaacttggaccggtccatggtcgagcgggttttggcccccggtctgagggtccgggccagaaacagggggtgcccccgggggagccagtggctggctgtccgcagggggacctgaccgcaatgttgtgcgcacaggggcccgccgcaagggca

SEQ ID NO: 573761 - DNA, 852 bp, Homo sapiens
agagccggtggtgtccgcgctaccgggagagctggtggacaaatgtataggatcatgaattcacatcgtgatgaagagtgataaggaaatggtggtactcttcttgaggatcgatgatcttgtgaaataatggtatctggaaggatgtcacttgaggtttgaaaatcatgatccgagagggaacatgggacttactaacatttagatgagattttgctagactggagaataatataactaaactgctggttccgtgaaggtacgaagggacctgaaagtgtggaatgagttttccgttgagtgacacatagattatgtttggcgtataagtgactaggaaattggaatttttgtttcccgagtttctaaatgtttacattccgataaatgataagtttccgcgttgagagggaagtgttggaaggatgtgttagccagtgtttggtaaggtgaatcagtgattatcctggtgaaactgaataacagagcttcttcttgtgcagatgaaagataagggtgttggggttagatgtcatgtgtgattgtaatggagtagccacgtggaacaaagtttgtagtttgttctgcagtcgatttccggtgatgatatgtttatttggaggtcatttacgtggcattgattctgagaatatgtgtgtgggcaaacaaatggtgaactttgattgaacggggcctgtgaacaaccggaatgatcatttgaaaactcaatgaagggggggttgggaaaaagaaagatacaaaatattgtggggggcgggccgaaaggtttacacatggggggggggagagaggaagggaaatgggtagagacgcgggaatggggtccaagcg

SEQ ID NO: 573762 - DNA, 184 bp, Homo sapiens
acgttgtggttcgttcacagcttcctatgtatgattgtttgcacgagagggcgctcctgtttttaaaagcatttggatgacccctggctgagcggtgctctgcctctaactccctcctcacactccagaattacccttcctcatctgtgcccgtggtcccacctctccccgttgtcccacctct

SEQ ID NO: 573763 - DNA, 648 bp, Homo sapiens
atgtgagtgcatgtacttggaaaactctgaggctacactgtatgaatgttgagatgtactattaatccacatggacctgtccacagagaaaggattatgatgcttttcttgtaaaaacctttatttaatctctattcttctctgtcttaaaaatggggagatttatgtctgcttcttagattcctaagtccatctgctcattcagccacactgctaaactgtcttctaaaaaattttcagtagatttggaaagatatatcatgaagataattttgtcttcttcaaataatgacagtttggtttccttctttccagatgtagacttttactttcttttttcttatcttattgcattggattggacctgcaggacagtttaaaataaaatcagtgatacttagaacccttgtctcgttcttaatcttagaacaaggtttgctttacgtttttagtagatatttatggccaagataagaaagtacagtctatacctggcttgtttggtttttaatcacaaatggatcctgaagaccttgactggctcttgcttgactagcagtagtcttggaatacaattccctgtttcctttcgttctctgcattcccaatcttaaggcgctctggataagcagcttctttctctcggag

SEQ ID NO: 573764 - DNA, 108 bp, Homo sapiens
  misc_feature (20)..(20): n is a, c, g, or t
ggatcgtacgacggagcggntagtggactgtcctcctcctgtcattaacttacaagcagcacactccagttgtcactgtagtcaaaactgggagtctgtgagtggacc

SEQ ID NO: 573765 - DNA, 352 bp, Homo sapiens
gtctgctggacgtgttctgtatgcgggtgacgccgtgcccggactagtgaggctgtccgtcctcccgacagtagccgaggtcaccgcacgctcggggtccacgtcctccggcagtctggcacttgtgtagtcgtaaggtgtttcatgtacagtgtccgttcagccgccagctttctcagccccgcacctcgatgttggtttgtttggaggtggtgacaatgatgtcttcaggtgagaagtctctcacgtccaccgcaaactcataggcgtctcctagggtcttgatgttgcctgcccaccggggcttggttgggatgggctctttgacgaggcatggacaggccttcattca

SEQ ID NO: 573766 - DNA, 283 bp, Homo sapiens
  misc_feature (2)..(2): n is a, c, g, or t
  misc_feature (7)..(7): n is a, c, g, or t
  misc_feature (19)..(19): n is a, c, g, or t
  misc_feature (28)..(28): n is a, c, g, or t
  misc_feature (31)..(32): n is a, c, g, or t
  misc_feature (47)..(47): n is a, c, g, or t
  misc_feature (60)..(60): n is a, c, g, or t
  misc_feature (62)..(62): n is a, c, g, or t
  misc_feature (67)..(68): n is a, c, g, or t
  misc_feature (76)..(76): n is a, c, g, or t
  misc_feature (90)..(90): n is a, c, g, or t
  misc_feature (109)..(109): n is a, c, g, or t
  misc_feature (128)..(128): n is a, c, g, or t
  misc_feature (131)..(131): n is a, c, g, or t
  misc_feature (165)..(165): n is a, c, g, or t
  misc_feature (174)..(174): n is a, c, g, or t
  misc_feature (179)..(179): n is a, c, g, or t
  misc_feature (189)..(189): n is a, c, g, or t
  misc_feature (200)..(200): n is a, c, g, or t
  misc_feature (210)..(210): n is a, c, g, or t
  misc_feature (212)..(212): n is a, c, g, or t
  misc_feature (227)..(227): n is a, c, g, or t
  misc_feature (247)..(247): n is a, c, g, or t
  misc_feature (264)..(264): n is a, c, g, or t
  misc_feature (266)..(266): n is a, c, g, or t
  misc_feature (276)..(276): n is a, c, g, or t
gntttantgcaggaatccnccagacacntcnngcccccgcacccccntcagccgcccgcntntcccnnccagcccntccaggcaggcccngtaggccgtagaccataancaaaaccctaaagaggggnacngttcagcctgtgggaggggagaagaggtgctgtnaacgaaaanctatnttaagaacanattagaagttnacaaccaagngncagccttcagcgctncggggaaagtcaaccgaccnctatgtcacctctagcngnggaaacctcngaggccc

SEQ ID NO: 573767 - DNA, 367 bp, Homo sapiens
  misc_feature (365)..(365): n is a, c, g, or t
cgatgagtctcaagctgccgcccgtttggtacaacaatgccaaatttggcatcttcatccactggggcgtcttctccgttcccgcctttggcagtgaatggtactcacgcaacatgtatcaacagggatcgaaagaatatcaacaccacctagccacctatggcccacaaaacacattcggctacaaagacttcatcccccagttcaccgcatccacattcgacccaaacgcctgggccacactcttcaaacaagcaggtgcccgctatgtcgtcccagtggccgaacaccatgatggatttgccttgtacgactcccatctctcggactggaccgcagtcaagaccggccccaaacggcgtttntt

SEQ ID NO: 573768 - DNA, 625 bp, Homo sapiens
  misc_feature (88)..(88): n is a, c, g, or t
  misc_feature (116)..(116): n is a, c, g, or t
  misc_feature (118)..(118): n is a, c, g, or t
tgattcatcacaggtagatccagcgtttacattgcaatctcgttacatgcccaatagcagatgatagcgtgtcatgctagcagacgtnctcactctacatctgcagggtcatctantntggcaatgattgatatctgactccacagtgtacttcagaatgtactggtccgaatagatggtaaagtggctatccgttgcagcgatttctgatcttcagactcagatctgtgagtgcactcagacaatacttgcatcttctacatagaggtgcatctagtgctgtaactttgtcgcctggtttgaagtaggacactgctgggcccatactttacacaatatgtgtaacgtgatggccatcgatcactgggaaagctaggacctgaactttagaatcgatacagtcggcatcagtatgcgtcagcaacgtagcaatgatctgaatgcgtatcacatgaaccttggagtaagcgaccacagcctattccattcagatggtctcacctgcttcctaggaaatggatgctcagcagtagatagcattgcccatggcggccatttttcattgggacgctgtgttggaagctactctcgcagttcaaacagcgtcaaactcttgcccaggtag

SEQ ID NO: 573769 - DNA, 425 bp, Homo sapiens
  misc_feature (154)..(154): n is a, c, g, or t
ccgatgaaagtgccaggcccaagatttgaacccaagccctggtcctgtaggggctgcctcgtgttctcattctaataagtgaccatgactgagaattcaccatgggccagacactctgagatagaagttaccagccccttggccaggcgctggntgtcacgcctgtaagtcccaacacgttgggaggccgaggcagatggatcacctgagatcgggagttcgagaccagcctagccgacatggcaaaaccctgtctctgctaaaaacacaaaaattagccaagcatggtgcacctgcctgtaatcccagctactcaggaggctggagcaggagaatcacttgaacccaggaggcggaggttgcagtgagctgagatcatgccattgcactccagcctgggcgacagaatgagactcccatctcca

SEQ ID NO: 573770 - DNA, 521 bp, Homo sapiens
ggctcggtacacgatacgctcctagacgggtgaggaaggcatgctgaaagctaaaataggcctcttaaggcaaacagtaggccaagttgtgaatgcaaaggaaaagttcttgaagaaaaatcaaagtgctactccactaagcatatgaataagaaagtgaaacagctttattgctgctagggagaaagtttgaatggtctgaatagaagatcaaagcaaccacaacatttccttaggctaaagcctaatccagagcaaggccctcgtttcaattctgtgaagcctaagagaggtgatgaagctgcagaagaaaaattggaagctagcagaggttggttcctgtggtttagggaaagaagccatctccatgagtgcagaatgaagcagcaagtgctgatgtagaagctgctgcaagttacccagaagatctagctaagatcattgatgcaggtgactaaacagattgtcagtgtagaggaaacagccttccattggaagaaggtgccgtctaggagcgtaat

SEQ ID NO: 573771 - DNA, 123 bp, Homo sapiens
ttctctaggcacagccaccatcatagactataagagccgagtcaggtcttaaagaacgagcaggacatctatacccatctggtccaatctctgctggaatcagacagtatcaaccagctgcag

SEQ ID NO: 573772 - DNA, 192 bp, Homo sapiens
ggtatctgtgaacatgttaagagtaatttagatgtgggggtgggggtggagaaaggggaagtggtccagacacaaacaacccattggacatgctaagccgaggaggcattcttctaaagcagactatatatgtcaacagcaaaggtaacatatgagtattcaaaaagaaaaacataactactatacttttaa

SEQ ID NO: 573773 - DNA, 223 bp, Homo sapiens
aagcagatggatgctggccagtaggcattgtccccttttatatctataacttcactgaccttcattttacctctagtagagacttgtcccattaattcggggtaccgcatccatcagagattccggaatcatgggtcctggcctagtaggccttgtgtccattatatatctataacttcactgaccttcattttacctctagtagagattgtaccattaattg

SEQ ID NO: 573774 - DNA, 361 bp, Homo sapiens
agcggagatacccccggagctccagccgcgcggatcgcgcgctcccgccgctctgccccgtaaacgttcctgcactggtagccgtccccagttttcagagggccaaggccgaaagtttgaagttttccgttgtaaacaaagcccagagagaaagcgttggaaaaccccgttccggaggcccaaaacccggtgggaggccaaacacaaaccagccggtcacatgccagtttccaccccggaccggcgacgcggaacggccggccaacggaacacacaacagcaacacacacagaacgcccgaacaccacgaaagaggaacgagacagacgcagaacacggcgcccggaaccaagagggagca

SEQ ID NO: 573775 - DNA, 160 bp, Homo sapiens
cgatgtagaccaggctgagtgcagtggtgatcttgtgtcacgagctcagcccctaggccaagtgatcttcatctcaactccaagtgctgggaccacaggtgcacaccaccgtgtccagctaatatttttattttcgttaagaaagggttttaccatcttg

SEQ ID NO: 573776 - DNA, 896 bp, Homo sapiens
tgtagtttgcttaggtccttttctttctttctttcttttttttttggaaacggccctctctctgtggcccaggcggagtgcagtgatccccgagatcgcaccattgcaccccagtctggtgcaacagagtgagatcccgtctcaaaaaaaaaaaggaagctggaaaaaaaaatagaattaaaacctctccccttgtctcacccgccaatgaaattttctggacacatccccaaatcacatgttggaatatttcccaaccacaaatttaataaggtataccaaatattttacctctcctaaaataggaaaaacatatattaaccttaaaaaagcgccctcagggggtatataataatcttcctaaaacccaggataacatactccatgtgcgcggttaacattaaacccccacatatatttgtcccctcatagtttttgaacaacacaaattaaggcccattatcaccactggatggagaaccctcaagggcgcattacatgttgggtttcgcaccatttacaatattcctgaagatttcaccccttggaatttggagaaacccatttccgttttttgtgttacacccatttgggccaagaatttctacacaaagggcctcgtggaattaatagggtaaatccttgtgacataactttatacaatagggatgccaccagattatggacgggcatgcgggtgcacctatcggtacagtaggtaccccgattttaataaaaccctccaattaattggctgtgattttaccacaaatccttcccgtttcacacgttaacttttttcacaacacatggggaactcccaaaaaggctatatgtatggtcccaacacctgtttcaactatttgtcgcttacaacaatcttgttaaatttccca

SEQ ID NO: 573777 - DNA, 552 bp, Homo sapiens
gcgatgcggaacaggaagaagagggctcctggcttactctaaagacacctgtctggagactcgagcgggacctctctgtggtatccaaaggtcatctcgaccacaagaacttggacgcgagcattttacatggaggtgaagcagaggggtcgggccaggtctgggacccagagctgccatgcactcccgcgctctcacagacttctgatttccaacctgcacgtcagagccccctcctgccagccggatgggggcctggatccagtgggaaatcacatgggaatatggctggcaaactgcaaagggccagatgagtgtcaggttacagaataaatctttactaactcaaagaagaaaagggctgcggataaaacaggaaaggttagatggaggaaggcgggcagacgggcctaagaacaagggccaaaatgagaatacagcatcggccaaagaggaccgtggctgtctctcccctggcaaggaggggcccttttggcccaggacagaggcagaggccagtgggtacaaccaggtcagatgtgcaaggagagc

SEQ ID NO: 573778 - DNA, 116 bp, Homo sapiens
  misc_feature (14)..(14): n is a, c, g, or t
  misc_feature (88)..(88): n is a, c, g, or t
  misc_feature (115)..(115): n is a, c, g, or t
gtttcctgcaacgntcacgaacatgaacatcaaaggttcgccatggaaagggtccctcctgctgctgctggtgtcaaacctgctcctntgccagagcgtggcccccttgcccatnt

SEQ ID NO: 573779 - DNA, 145 bp, Homo sapiens
tccagctttatacttcctccaagctttatacttctcacgctttatacttcctcaacgctttatacttctctagaggtccacgcatacttaatattatacttgaattcaatacggaagtataaagcgttgaggggtaccgagctcg

SEQ ID NO: 573780 - DNA, 497 bp, Homo sapiens
aaacgcgaaaaacacgtggcccccccggtggcctatttctaaattagtttctcccggtggccaaaaggcacgggtttcccccccacccccgaggtccccgtaaaccgcccgggaagaaacgggtgtttttacatggaggaccccctccccggtaaaacgggggaggaaatttttggccccattggcatggggccccacgccaagaacaaccgggacttgggtttccccctcgacctggacttcaagggccagttgggggagttgtcctgctcccccgactaccggatgggttaaggcccggttttcccccccggcacgagcccagggggtgggggttcctagggggtttgggggcccccccttcctttcccccccccccccaaaagggggttttaggggcctgggctggggggatggggggggcccctcgtgactgtgttttttaaaacttatgtttttaaaggggggcatttaccccaataaatcccccgctggga

SEQ ID NO: 573781 - DNA, 747 bp, Homo sapiens
gcaaccgttccaggtgtggtggtgcaggcctgtaatcccagctactcagaaggctgaggcaggagaatcgcttgaacctgggaggcagaagttgcagtgagccaatgatcgcgcctactgcattccagccgtgggcgacaaagcgagactctgtctccaatagaaaaaatagagacaggcacaagcaaagtcccggagaatccgtgatgttaacaaggattgacgcgaactcggatgcccagctcccacatccggggactggggctggacaatgcctgtggagacctcggcaaggcttcgcaaggcattggtgggtcagctggtcggcaccggcgggacggtctggacgatgggtgctggagatgactccgggaacgggaacgattgccggatcgggcagttcctgtatggcttggcgcagccgggcacggcgtgaagacggccgatcggccatgggctatggcgcaggcccgtggagtcacctgtaacgccagttcacagccatcagccgagcagagaaatcgttgatccctggaggagtgagcaagaccagaggcggctgaccgcagggccttcccggcagggccatccgcgcgaacggcatcacgcggagcgagactggagaatcactcggaagggacagagtcggtggagattccaagactagactccgagcatgcaccacgggcatgggagaccacaagaggttggagcagctcggggcccgctcaaggaccaagagacgaa

SEQ ID NO: 573782 - DNA, 221 bp, Homo sapiens
tagcgtatctcataacggaagtaacatctgtcgaacatgcaccatgagctttgagtgatgctcttcctggggacaaatgtgggcttcaatgtcaatgaatgtgtctagtcagggatgtacgtcgtggcaagtgttgcatagtgacagcaaaaatgacccaccaatggaagcagactggcttcactgctcaggtgattatcctgaaccatccaggccaaata

SEQ ID NO: 573783 - DNA, 109 bp, Homo sapiens
gaaaagatgtctgactcaagacctcagttgattctgtttgccttaagtttgggtcagtgataggctgcttctaacccctatactccttcaagaatacagtatgaaatca

SEQ ID NO: 573784 - DNA, 457 bp, Homo sapiens
cgtgatttcgggtgtatctcgaggatctccgggtgtgacttcgacgatgttcggcggcgcgacttcggcggtcacttcgagaaccgacccgaccacatccccggctgactcgtccgcgccgactggattaccaccctccggcagcacgaccggctcggtcacgaacggcgcaaacttgagaacacgccctgctccggatgtccgttacgtagacattgccggtcatgtcagtggcgatgccgccgaacggtatcgaactgggtcaggtcggtcggtgtgtcggaaggctgaccgaacgagccgacgcagttaccgagcgtatcgtaaaccagcacgcgacccgcgtcaggaatcgccgacgtacaagcagaatgggcgattcgtcgattgcgatatacgggcggttgccgagatcttcataccagccgcgtaccgggaaagtgaacaacgctgtgcc

SEQ ID NO: 573785 - DNA, 117 bp, Homo sapiens
gacacgggagggatgacaagatggagagccatgactaggcacggaggtcagacaggcagccgggcaggatggttagtggcccagtgagagagctgcaaacctggggacgcaaggggg

SEQ ID NO: 573786 - DNA, 293 bp, Homo sapiens
ctcccattgaacggagtcatttggtttggcacaagtggatgcgcactgtgacataaaagcagaataggaagcactcccttctgggggctgtcggagaggatgtgtctggaggaggaaaagactgggattatcggctggctgcgtggatgataccttcgctgagcctctctggccactgttattgcttgtttgtatatcacgctgtactttaccattctcaatattgtgtttatgcagcgagtgtggcaccgctaggggcattaactttctcacgctgtgatacatggacgaaa

SEQ ID NO: 573787 - DNA, 200 bp, Homo sapiens
cctggcaggctctttctgctgtggttggtggttgggagatcgacgactctacgcctgtacctgggatactcgtgtgatagatggcgatgcaacgtcctgccacgccgccgtgggctggactgcaggcggtgaatatccccatgggccgtgtctcttcaaccatgacgggctcctgcacatttgatgaatattttcgtcac

SEQ ID NO: 573788 - DNA, 922 bp, Homo sapiens
ggcggatcacggtgaaaaggagaaccccatgcgtggaacttctgcatccgcaaactctgtcttcaacatctgtgttgcgggagagtgtgagcacagactgacgcgagcagccaaggtgttggacgcagctcacagggcagacccctgtgttttccaatagctagatacactcgtcagaatcctcttggacatcccggcagcaatatgcaaaagattgctgtccactgcacagttcgaggggccaaggctagaagaaatcttggagaagggtctaaaggtgcgggagctatgagttaagacacataaactaacttctcagatactggaaactttggttctgggatccatggaacacactcgactctggtgtactcaagatagttgacccaatgcattggctatctacggcctggacttctatgtggtgctgggtaggccaggttacagcatcgcagtacaagaagcgcatcgacatggctgcattggggccaaacatcagaatcatgcaatacgtaggaggccatgcgctggattccagcagaagtatgagtgggactcatccttcctggcaaataaacttcccgtttctatccaaagagacgcaatacacaagttttcagtgatcaataccccctacaacatccactgaatcgggggtgcgccgtccatacatgtattcctcctcggggggcaccaacgttctggcgctgtacccacagcttttctgccggtctcccatggtggggctcccttcatgtggcagcaccgctacaattgtcccctgccccacgaccaggcacctgaccgccctttgccctgcctgcttctcccgggcgcaccttcggctacccctggtcgccatgcgttacagcgtaccctggccatccgcgtgtctaccactggactctgacgcacttccccg

SEQ ID NO: 573789 - DNA, 139 bp, Homo sapiens
tgaggaccccgaggcgtctgtaggagacagatgctatcaaatgaggactctggggtgttatttcagaaccccatttctagaaaataccacgccagagtcctcatttgatagcatctgtctcctgcagacctcatcattc

SEQ ID NO: 573790 - DNA, 112 bp, Homo sapiens
cgacgaatatataacgcctgcacaaaagaagtcaaattactaacggaacgtggcagaagattgtagagatactaattttagtagaagttcatggtattggcaacagtgactg

SEQ ID NO: 573791 - DNA, 521 bp, Homo sapiens
ttatggccgggggaaaaaaaaaaaaattttttttttaaaaaaaaaaaaaaaaaaaaaagaggaagtttttttttaaaaaaaaaagagccccccaacaaaattttaaaaaatattattttttttaaattgagaaaattcgattagttaaaaatttaaaaacaaaggtaattttattttataattccattgtatttaataaaaattttttaacattaaaagcaagcaatctaattgtaatgaattttgtcccgccaattttaatttacatttcacaaacattgctttttattttacttttttagctgttaacttttttatatttaaaaaagtttataaattttaattaattttttttcttttttaaataaaaaaattattttaaaaaaagggcctgcctttccttttccatttggctatttttttggctttgcagggacggaagtatttttttttttttttattaaaaaattgggttttaaaaaatgggttgaaaaaacattaaaataattttaaaataaaaa

SEQ ID NO: 573792 - DNA, 585 bp, Homo sapiens
acgctctctgtgtaggttgggtgtgtcagcaggagatagtatggtgggtcttgtggggtgtgagaactggggaaggggaaccccagtctcagatgacagacacacagaaactggcttggagacctcgcttcaggcacatacgtgctgcacaaagatcaccagacagtaggagtggagacaggaaatagagatttgcatctcaggataggagacagaagatggtggtggtgagttgatatgtcctgctctagctctcctgttcttgaaccaaatgggaagaacgtcaaggactatggatgttggattcacccagggatccatggaatcagaggtgtaagtggggttgtcgtgatgggcatccatggacaaggtaggtgggtgtcctcaagaatttgggaatggcactcagtgggccttggaagtttggctagggaatctcttctatctcctctaagaagtgttcgctcgggatgatgcaggcttgggtttgacaagacgctcatcatttctaactgaccatcaagactgattcggttccttaccaggtctcttcatagcattgagtcacccattctggatgagatg

SEQ ID NO: 573793 - DNA, 433 bp, Homo sapiens
cagatgaagaagttcacattcattcgattcagtgagcctgctgctgtccctgctgcgtgggagtcgctatgggccgccaggacctgggttctgcccgtagtaagcggcctgctgtcaataattatttccccaggcggcactgtagtctggctgggagcctgggggagctcctggacccctccggtggccacttgcgcttgcttcttgtagtactcctcccaagccttcgtgtagtcctgctgtgggggcgctccggtctgctggggctgctggccgatctttttgtaatactcttcccaggccgtagtagggtccgtctgtcctgtgggtgggggctgaggggctcaccctgagccggtgggcgcaggggccggtgcggggccggggacggggcccgggggctgctggtagtagtgtgagtagtaggcggccc

SEQ ID NO: 573794 - DNA, 280 bp, Homo sapiens
gaaaaagaagaaaaagaaatatcaaattgtatgtacgccgagttccatcatggatcactgtgaggagctaatccctgaatatctgaacttcattagaggggtggtagaatcggaggcatctccctctaccacatatcccgtgcagatgtagcaacaaagccaacaattttgaaagttcatccaggcaagccatttggtccaaaaatgcttcagacactctttcactgcaactggctggcacgataaagcgaactacaagaaattctatgagcagttctct

SEQ ID NO: 573795 - DNA, 1359 bp, Homo sapiens
tggctagtacgaggctgcgtggtttaattcggccgaggctcgctctgcccgtgtaccagacatggctgacatcctcgtgccgcgctgccccgaatactcgtgtcgcggtgtgccctgggccccgggcgctgctggttgggctttctcgtgtgaatgtgcgaccccctggcctgctctgtgcctgagcctgcaggactgcttgtgaatgctgcgactgtgccctatcatgatcctgctgagtctggagtgacatgcacctgattatcaactgcacaagatttttgaatagagccctctcaatgcactcttgacttcattcacatgtcaatggaacttgtatttacctgtgcagaagcctcttctgatgcccgatgtaccatactggtgacacaaatgctggctgtctgtgcacatgtgtttatgtgacgcctgtacatctatatgaggatgcctgcctgtgcaccaccgacatcatctgacactgcgaacatgaccagccacagcaccatcacagctgtgactatgaactatcacctgcccacaatggcctaccagcacatggggccactcacttcttgctctctcattacccccctgcaacccctggcacgccttcctctgtaaccttcgcctttgccgacccactgtgcccggtgaccttgctgtgccgccgtacctgccccaccacctccgcctaactcttcacggtctctgctcgtggcattcccttgcccaacacccgcagcatgccctcactcctttcttgggccccccaccctgtgtccctcgcccttgcctggaccccatcaactccacttcttccctttggcaacccactgtgcttccagaccaaccgacttcatatcttgcatgcccaccacctggctagtgccgcgtgttgcactgtcactggaccagccatcgcccatctgtggcacttggcgcacctgtcccctccaacccgcttgggcggccctccgactggcaccatcccaccctttggcatcccccccttggcgctccactacacccttaacgcgctggcttaccccgggccaccttcgccgcagcttcctcccgaacttgtccccttctgccgccccctccctccccctggtctgtgccttcctatccctacgccacgggtgcgctactcaacacttgtgtgccactcatggctcctccactgccgtgtccccgctcatgcactttcatacggcgatccccctcactccgccccctgccccagttctccactccagcgcacccccgcgagtcatcctccaccggctccccgcccatcgcttgtgtcgtgtcgcctcccttgatatctgccacgtgcccgtctcgtcacatcta

SEQ ID NO: 573796 - DNA, 849 bp, Homo sapiens
  misc_feature (116)..(117): n is a, c, g, or t
  misc_feature (125)..(125): n is a, c, g, or t
  misc_feature (147)..(147): n is a, c, g, or t
  misc_feature (188)..(189): n is a, c, g, or t
  misc_feature (196)..(196): n is a, c, g, or t
  misc_feature (258)..(259): n is a, c, g, or t
  misc_feature (287)..(287): n is a, c, g, or t
  misc_feature (383)..(383): n is a, c, g, or t
  misc_feature (510)..(510): n is a, c, g, or t
tcggcacgaggagcgtgctgcgcgctggcgctctaggacgtacgacatggctgcgctgagctgctgggcgctgcatgctgtggggccgccgcctgcggcctttgctgcgggcgccnngcgctggnggccgtgccgggaggaaaaccnattctgtgtcctcggaggaccacagcccagttgggccccanngctgaancccagcctggagcttgcaggcaggacgactgttcagcactgcagaccgccgaggacaagganngaaccccgtgcactcgattatcagcatncacagagagcgtgcagggttccacttccaaacatgagttccaggccgagacaaagaagcttttggacattgttgcccggtccctgtactcagaaanaagaggtgtttatacgggagctgatctccaatgccagcgatgccttggaaaaactgcgtcacaaactggtgtctgacggccaagcactgccagaaatggagattcacttgcagaccaatgccgaganaggcaccatcaccatccaggatactggtatcgggatgacacaggacgagctggtgtccaacctgcggacgattgccagatcggggtccaaggccttcctggattctctgcagaagcaggctgaggccagcagcaagatcatcgggcagataggcagtgggtaactactcagctttcatgggtggctgacagagtggaggtctattcccggtcggcaagcccagtggaagcctggggtaccgtgggcatttcagatggtaccggaactgtctcgccactcgcgaagcctcggaagtccgcaacgggaccgcgcttattaatcacctgcacacccgactgc

SEQ ID NO: 573797 - DNA, 392 bp, Homo sapiens
atggttccaaagaagcacccaataatgtaagaacatctcataaagtatccctcaggagtattgcatcaatgacagatgaagagagatttaatatgagaattaagaagtttggtattacaagtaaagaattcagaaaatcaccagtggcttcttgctttggactgcctctgtcaactggaaaaaaaaagaaggcgcctggaacgttttggactctcatgattcacttctgcatcttctctccaggtttgctatgtaaaaaaaagatcccagttccacatatcaaatcattatcatcagttctttaatttttcccactgacattggtttatactgataatgtcactgctgtaatttataaataaaaacagacattcatatctcctataaaaaaa

SEQ ID NO: 573798 - DNA, 888 bp, Homo sapiens
  misc_feature (661)..(661): n is a, c, g, or t
gacagtataatggcaaacagaggaactggggcagcaggcagctcgcagactggagacgctctagggaaagccctagcttcgatctattctcctgaccacacgaacaacagcttttcctccaatccttcaactcctgtgggctcccctccttcactctcagcaggcacagctgtttggtctagaaatggaggacaggcctcgtcatctcccaattatgaaggacccttgcactcactgcaaagccgaatcgaagaccgtttggaaagactggacgatgcgattcatgttctccggaaccacgcagtgggcccgtccacagctgtgcctggtggccatggggacatgcatgggatcatgggaccctcccacaacggagcgatgggtagcctgggctcagggtacggaactagtcttctctcagccaacagacactcgctcatggttggggcccaccgtgaagatggcgtggctctgagaggcagccattctctcctgccaaaccaggttccggtcccacaacttccggtccagtctgcaacttcccctgacttgaacccaccccaagacccttacagagggatgccaccaggcctccagggccagagcgtgtcttctggtagctctgagatcaaatccgacgacgaggggcgatgagaacctngcaagacaccaaaatcttctgagggaccagaaattagatgacgaccaagaaggattccaaatccaatttactaggcataacgatgatgagggaccggaccccgagcagaaaggtgagcgcgagaaagaacggggatgggccaaatggccgggagcccgagggtccaaaatcacgaggcgtagaagtggcgctgggggcccctaaaggagagcccaacaagcggatcc

SEQ ID NO: 573799 - DNA, 487 bp, Homo sapiens
gtttccgcccgatccccgcctccagcccgtgccccagagctccaggtcgccgacccgggccctggggagtgactcagcgcaaggatggtggcgacttgcgggggctggagattcgaactgttcaaggccttgaatgcagggatgagtggggtgaacgcgagccctcggagctggtcccggggctgtgccagagcgtggggccgggctggggtggacgggagaggaccagattcggagaccagggcagggcgggagaagccacggctgcggaggggcgcgctggggcttcgacctggctgcactaacccaggctcctcctcgccccggcctccgggtctgggaaattgaggggacggcaggcccggctgccctggaactgggagacagggagaatcccctgccggggtccctggaaacagtgcccaccccacatcactacattccctcggcccgtgttagtgaataaagtattatatactcaccccaa

SEQ ID NO: 573800 - DNA, 170 bp, Homo sapiens
  misc_feature (31)..(31): n is a, c, g, or t
  misc_feature (58)..(58): n is a, c, g, or t
  misc_feature (60)..(60): n is a, c, g, or t
  misc_feature (100)..(100): n is a, c, g, or t
gcacagtggtttgaatatgaacaccagtagnattctcgttcgttgttagggtaagagngntttgtagaatgatctccaaaagaagcagtcctcaaaaggnatttaccagtgatatcttttaatattcatgtttatttaatgatgtaagatagaattaataaactactaag

SEQ ID NO: 573801 - DNA, 311 bp, Homo sapiens
cttgacggtggtgatgctacaattgtggatatggtatccaggacgcgcccatgtttgattgagagcttctcatactatccacctatctgggtctgcatttgctgtccgtgatatgagacagacagtgtgcggagggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccattcaacgcctccg

SEQ ID NO: 573802 - DNA, 229 bp, Homo sapiens
gttaaaaactttcctgtattctcgatcctcctttcttggctggaagctttcaactgcaaccgtgaacttttttgctctgtgcttcctttataaaagtgctgctgtgtgatatgcagaaagttacggcgtgtagggtagtgagactcacgtttattgtctggcgccttcagctcacaggtgtaggactttgggcaggtatttgtcactagaatttctgtgcccgtgtccc

SEQ ID NO: 573803 - DNA, 628 bp, Homo sapiens
gtacacgtatactgaaaactggagggcctatcaaggctctcatcgctgctcagtacagcgggggctcaggtcctgcgtgctctccgcaccaccccactatccataatatggccaaaccaacctgcacccctagaatttctccgccaaatttcctgcacggcaatggtcgccagcactaatgaggtgtgatgactggattctagatgtgtattgacgcagcaacatgccattgccctactattgtgagcacattgagtgagcttgcgggggaagtaactaccagagagcatgacagcccagagtagtggttgcacgtatgggtagagctatttgcttgatatcctgatatatgattgccccaggctcagtaccttgtggttgttaccccacactatgggcatcatgcgaccacaaaacaaacatggccaactgagaatgcacaaggaggaaccgtagcgggcgacactatcttgtggggccttggcctgcgaccttggcccttaccctttaggataccgagcctgaatgtgcacctatatatcctttgtgtttgtgggggctgaaaaccagaacgtagaccacttattgggcgttgaaacacttcaccacagttatgggacttgccacc

SEQ ID NO: 573804 - DNA, 216 bp, Homo sapiens
cgtcgtcgcgtcgtctgcttgtctcttactttaaccagtgaatagacctgccgtaatgaggcgggcctaacacaggaagacgagacagaccctaatgagctttaatttattaatgcaaactgtacctaacaaacccacagttcctaaactaccatacctgcttaaaaaatttcggttggggcgacctcggagaaggaacccaaactccgagcagca

SEQ ID NO: 573805 - DNA, 899 bp, Homo sapiens
tggtgtacctgctgcgcagccgcgtttgtacagtctcactgattgatgaggttaggcatccagaagtctcgtcgaagagggacccaaatagcgtggacagatacgtagcccagggacgtcgtgtgatagaccaactacaccagagaccgccttgtagtgtacaatcccgataggtctagatccacgttcgtatgcagaggtacatggacatgagctgtaatgaagttattactagaccgtatacgtatggaaatacatcatgcatactaacctcacagtctgtcctgatgggacacacgtatcctgggacacaccaggtccagatccggttgcatgtcactgtcctatttcatgactacatgcgtgcaagggagtggagtgatacttgattatgactgttctccaaggtggacccgtggtattgctttgtgcacaaatgatctccggataattgcgattaaggcactgaaggagtgccataggggtatattgtgtatccactcattgaatgattagcagatgtggcagaatgatcgtcatattggccatgttggacttaatagatataaggcgtattggagggataaaaaactggtgttgggtatctacgcaagcgggtgtgcaggccagaattgcccgaactacatgggtaacgcgccacgggcccggcccacttgaggttcagcttcctttaaagcccgacggtggtccagaacggggcgaaaatggactagacaaccggcctgagaatgcatatcacccgaagggtggtcgcgatacagacagagagcagcaatacatacaacgaaagtgcacagacagacacacaccccacatacagaaacacacgcggggggcgaagcgaacaaaacaaataagaaaagagcactctcgactcc

SEQ ID NO: 573806 - DNA, 345 bp, Homo sapiens
  misc_feature (243)..(243): n is a, c, g, or t
accagaggcagaaaagcctgaaaattcctacaaatccagagcgccctgtccccccctctaaaggaatgcagctccctcgcccagcaacggaacaaagctggacagagaatgacgactttgacgagttgagagatgaaggcttcagatgatcaaacttctctgagctaaaggaagaagtttgaacccattgcaaagcagctaaaaaccttgaaaaaagattagacgaatggctaactagaatanccagtgtagagaagtccttaaatgacctgattgagctgaaaaccacggcacaagaactatgtgacaaatgcacaagcttcagaagcctatttgatcaactga

SEQ ID NO: 573807 - DNA, 298 bp, Homo sapiens
ggcgcctccctgaccctcgtccgagtcgtccctgcgcttccgcacgcgcgcgctcgaggcgttcacgagaagatcgtcgtgtcgttcagaactcatcttcgaccctttgctgtgcagtaaggtgatgacctgcttcctgctgcatgaggattatccatatagattcaaagagaacggcaggaagacccttaactactgtccaagggattcggcttgattggattaacgaaataaaagaactagtggaaggcgttagaaaaaagttctggccttgcatgggttacctggtaatttggac

SEQ ID NO: 573808 - DNA, 145 bp, Homo sapiens
gtaggtcctgcgtccctgctctcatgtgtgtctttcctgacatcacccaaacctcctgtccccatgggctcactagaactgttgcctgtgagggcctcggcaatcctcagccactttcatatccgcggctccccagatcctgtca

SEQ ID NO: 573809 - DNA, 121 bp, Homo sapiens
gaatcacttgcaggtctcactcatgaagatagtttgcaaaatcctaaacaaaatatcagctaacccaatctagcagatataaaaaacttaccatgttgagattatcccagctctgcagtgg

SEQ ID NO: 573810 - DNA, 235 bp, Homo sapiens
  misc_feature (93)..(94): n is a, c, g, or t
  misc_feature (100)..(100): n is a, c, g, or t
  misc_feature (118)..(118): n is a, c, g, or t
  misc_feature (130)..(130): n is a, c, g, or t
  misc_feature (177)..(177): n is a, c, g, or t
  misc_feature (223)..(223): n is a, c, g, or t
gggacatgtttctaaaattctgcttctctgcaaaagcaatgtctttcttggttgatatttgagttttaaaagggtcaaatctttctaattttnngtatcnttaggagggcagcaactnagaggaatccangcagtcttattccaaccattaggaaacttaccacttccttggatttncacagatttaaaaaatctctttccgtgtcccttctcttttaatgtnaaatcaagattt

SEQ ID NO: 573811 - DNA, 430 bp, Homo sapiens
tgatgcgcgtccaatgtccgcgccaggcgtgctggtgtcatcgtcgcatcgcggcactggtttcctcctgtgacgttgcttcatcgtgttcaatctccggcgcgatgttgatgggcctccgtttacaaggtctcaggacatgtaaacatggtaggatagaaacacgcccaggatgccacatgtgacagacaaagggcaggtcacccaaacttgggatgtccagacgatggattcgttgagaagcttaagcttctcaacgggagcgctgccacctttatccccaggcctttcccacaacggcgagcatctactaggcacccacttaaagcccctcaacagacatgtgtccattcggtcctcgaacctaacaaactagtgttcaccccacactgtacagataagcgaacagggaatggacgttgagaagctt

SEQ ID NO: 573812 - DNA, 309 bp, Homo sapiens
  misc_feature (15)..(15): n is a, c, g, or t
  misc_feature (68)..(68): n is a, c, g, or t
  misc_feature (127)..(127): n is a, c, g, or t
  misc_feature (208)..(208): n is a, c, g, or t
  misc_feature (298)..(298): n is a, c, g, or t
cggttctacgagganaagcgcaagctggccagtatggccggctgagccgctatcccggcagccggatnacctgggcggcgtaggccaggcccgcgccgtagcccaggagtagcgccaggctgccggntttggcctcgccgctgctcagcagggtgtacatcgccagcggaatcgaggcggccgacgtgttgccggcatcctgaatatnttgggcaacaacagtttccggcttgagctccaggcccttggtgagtagctcgttgatatcgccgttggcctgatgggggatgaacacctngatgtcgtcga

SEQ ID NO: 573813 - DNA, 104 bp, Homo sapiens
tctccgtggttttttgagaacctctctttcagcctgcatcatcacaatgccaacacatttgatccagaataaagccattattaccctccctgtcccccccccca

SEQ ID NO: 573814 - DNA, 414 bp, Homo sapiens
ataccgggtggtgggttcacgaagcatgcctcagtgttctggggaaaactgttccatgacatgggaagatggcacctttcagtaagcagcactctctggtgctggaacttgagcactagaatgggagaagcaagccaggaactcggaaatgtgtcctttgccttgtttgttgggaagcagaagtcctgttgtccgcctggcattttatgaagggatccaattcagcaaccatgagaaggcagtgcagtttagtgcgcattgggccatccgggtcaatgagacctggctgtggagccttgtcagttcccaccagatcctgtttgcccatttattcattgttcatttcacaagcatttctgacacactttctttgtgccaggtttatgccctcaaggtgatcactgcctagaatgt

SEQ ID NO: 573815 - DNA, 249 bp, Homo sapiens
agcggcagttgcagaagactgctggtggattttatccggtactgggtttgccctcagttctaaagctgcccctagcgggcacttatatgcagccaatatgaatcgctgttaacaaatagagaaaccaaggccaggctaacatggtgtcctcgtaatagaatgggtgcgaggatgtttcccgtactggatcaagagaatattgattctcttgactcaggatccgtgttctcaaacctcacgatagactgc

SEQ ID NO: 573816 - DNA, 379 bp, Homo sapiens
  misc_feature (29)..(29): n is a, c, g, or t
gtcggcttggtctacacccccaggatganccaaggacagcttggaggttagaagcaagatgaagtctactgtcggatttctcttactgtcttaattttgcaagagcagtttcatatttaagggtttcaacatgtgctttttaaataagtaaattactaaaacatctttgtataaatagttattgcctttatcataattcaagctgcaacttaatgtcaccagaagattaaacagtaaatatacagaggctcatgaactacaaattgtaaaacagctctcactgtaaattaaaatacaaataaataatttctacagatattcgtttataaattgaagaaactgctcccataattatagagttactttaaggacatacggc

SEQ ID NO: 573817 - DNA, 673 bp, Homo sapiens
  misc_feature (6)..(6): n is a, c, g, or t
  misc_feature (66)..(67): n is a, c, g, or t
  misc_feature (71)..(71): n is a, c, g, or t
  misc_feature (74)..(74): n is a, c, g, or t
  misc_feature (85)..(85): n is a, c, g, or t
  misc_feature (95)..(95): n is a, c, g, or t
  misc_feature (108)..(108): n is a, c, g, or t
  misc_feature (111)..(111): n is a, c, g, or t
  misc_feature (136)..(136): n is a, c, g, or t
  misc_feature (147)..(147): n is a, c, g, or t
  misc_feature (149)..(149): n is a, c, g, or t
  misc_feature (180)..(180): n is a, c, g, or t
  misc_feature (186)..(186): n is a, c, g, or t
  misc_feature (194)..(194): n is a, c, g, or t
  misc_feature (226)..(226): n is a, c, g, or t
  misc_feature (267)..(267): n is a, c, g, or t
  misc_feature (278)..(278): n is a, c, g, or t
  misc_feature (281)..(281): n is a, c, g, or t
  misc_feature (300)..(300): n is a, c, g, or t
  misc_feature (313)..(314): n is a, c, g, or t
  misc_feature (323)..(323): n is a, c, g, or t
  misc_feature (330)..(330): n is a, c, g, or t
  misc_feature (350)..(350): n is a, c, g, or t
  misc_feature (373)..(373): n is a, c, g, or t
  misc_feature (379)..(379): n is a, c, g, or t
  misc_feature (409)..(410): n is a, c, g, or t
  misc_feature (458)..(458): n is a, c, g, or t
  misc_feature (495)..(495): n is a, c, g, or t
  misc_feature (498)..(498): n is a, c, g, or t
  misc_feature (518)..(518): n is a, c, g, or t
  misc_feature (520)..(520): n is a, c, g, or t
  misc_feature (532)..(533): n is a, c, g, or t
  misc_feature (536)..(536): n is a, c, g, or t
  misc_feature (550)..(550): n is a, c, g, or t
  misc_feature (562)..(563): n is a, c, g, or t
  misc_feature (572)..(572): n is a, c, g, or t
  misc_feature (590)..(590): n is a, c, g, or t
  misc_feature (598)..(598): n is a, c, g, or t
  misc_feature (612)..(612): n is a, c, g, or t
  misc_feature (638)..(638): n is a, c, g, or t
ggtggnggaggtatgggggcgggtggcaccgctcactcgagtttcacagaacatggcagccgcgcnngggnggngtggcgggggntcgtcctgtncagcttcatttcnagntaacagttacagtagagttctagtncgtgagctggnanggtatgggtctccgaggacaaaagtgctagntggccnggcctcgnggcccagacccctgtctttcagggcggccttnggtcaccctggcggctaggtcacaggccggggccccggttngcccgacaagnganagtgggaggggcgggccanaaggtcctttggnntatgcaccncggccgnggccgtgcaacaggggccantgccccctgctgggccctgggcnttcagnacatcatggcacgtgaagatgaggtcccannggggtggggtgtagagcaggtgcatacgggttggagttgcagccccgnccctcaatcccatgggtgtcgggctttcgccaaaccnttnacgttgcccaccctgaggcncnttcaccagccanncangggcagaggatatnggctaagggtannctgggtcantgcggccggacgtcttgncacctgtnacagggcaatgaanttggacaagccttcagagaaacaganccggggcttgccagccctagcagtgtgagtccggc

SEQ ID NO: 573818 - DNA, 1857 bp, Homo sapiens
taaaaaccctcatcaaaaaagggagatcatacaaaaatagtcaaacccctatctacaaaaggccagtatcaggggggcggcttcgaagcccaaaggtgagtgtttgggatgtgtataaaggtgaaacctatttacggtggggcggatgtgaagcacgaataggtgaggaaagttgtgagcccaattaatgtgagcggtgaagtctccggtggaagcccgtggtggtctaccaaaaagagtggtgtgccgaccccgtgtcagaagtcgccgtgtgcggaacagtagtgtgtgtgacagcaggggagacactctctgacagagaatcactctctgtgagaggtcttgtgtgtaagagagaggtgttcaaaacactaagagagacacccccgagtataaacacagtgtgggtcaattaaagccgagagttgcttgtgcaaaatatatatgtgtgggggggtcatcctgcgagagtgtgggatttctccataatatatagacaccccatatgtgtgggtagaagggcccctccaccgtgggtgcacggtgtggagtatacacctcgctgtgaatagtgagcagaggagatataaaatacgcggggaaagtgtgtgtatataaaaggaggacaggggtgggagacccctctacagtaggggagcggagaaaaatactacaaacgcggggggagaggagtagatagttgcccctgtagtgtaggtgggggcgcccaaagtggtgcgccatcccccatacaaagtgggcggggagggcgaccaaagggggggccaatacagggcgagtgagagcgcgggggacaaacaaagggggcgctcaaagaacaaaaaaaaatccccgggtgggcggcaagaaagcaacacaaacaaaaatctactccggagagagggggagaaaacactcaaacacgctgacgcggggaatataaactaccccggcggaataaactacgaaaggagggggcgccccttcaactcgtgggggggcacccacgcggtgcgcgggcgttgtctcgctctgcgtgggggagccccctggaggagggaacacagtgacgagcgcaataaaacacacacgggggacgttaacaaaacaaacgactccggcgcggccaccaacaaacacaatagtgggggggcacacaataaagtgggcgggcacgaccagcggggagtgtgcacgcagagcgacacaaaacaaacatagaagagcgaccccccaaagagaaattaatgagtaaacgaggagcaacgcccggataaaagagtgggacgaacgcgtgggggagcaacagcgtggtgataatatactaccacaccacgcggtgcgcactaaacgtgcgcaccagggaagcagaagagacacaaatacaagcaagacagagagcggggtccaggaacaacgaggcggggctccccccctggtataaaaaaaggagagaggacacacaaagggaaggacacgggaggaggaaataatacaccccaccccaaaatgtggccacaagcgccgctgagaaaattgaagaagccgcaacgacagagcgaaaacaaacacaacagacgagggccatgagtggaaaaaaaagacagcgggacccacaagggggggccacaccaccccccgcgttgtgaagaaacgaaatggtctggcgcccctatcggcacacccggtcgataaatgcgcccgagtgacggaccaaaaagagacgaggaagaccacactaaccaagtaggtcaagacaaaatggaaggaacagcacacccgcgagaggctgatgagggccccaccaactgacgagcaacgcgacacatgaagatagacagcaccacgcggaaggtc

SEQ ID NO: 573819 - DNA, 827 bp, Homo sapiens
ggactgctaaaggtctcccctccgcagctggcattgctctacacagtctgtgagtctcagtccttgcacaactctgcctcttcccccgctgactgtgcctctgcagagatgtgggcagctggtcaggatgagccacttcggtgctcatgcatcagacaacgcatgtcccacgactcagacctgggcgaacgcaaacacgggtgcttggacagtgcccagcgagatgccttgtcggacacctgatcctgagatcgttggtgatgttcgcttgcagagtggcagacagggacatgtgcacgtgtctgttgcgcctggaaggctcattgcctacagagaaacttctgcagcccgacgctgcgactggaggccctggggatcctgtctgaacaacaagtactcgcgagggttatcctggcaagagatacctatgggggagcagaggtggatgcgagtgacaacaattagagcactaagagcgatggccagataggcccagtcgaaccttttatagcaagcccatattgaaccctgagatcgcatccacaagatgagagaactgtcacgctgtccccagcctcttaactcccatggagtccacccacgccaaacctagacacacgtctatcacaactagatcccattatcctttatacaacacatcaacataaacctcgatcaatccaaatacaaaacaagaaacccctacacccagaataggtcaaacaacaattcataaaacaacaagaataccatcgtacccaacagtacacaaactaaatatccaaacacacaattccatactataaatacgaagtcaaatagcccaa

SEQ ID NO: 573820 - DNA, 166 bp, Homo sapiens
gacctatgtcttccaaagtgctgggattacaagcatgagctcaccttgcacagccaaatcaagtcacttttaaaatacaaatttattatatgtctaaggacattatcgataaagtgaaaacacaacccacagaatgggagaatatatttgcataccatgtatctga

SEQ ID NO: 573821 - DNA, 201 bp, Homo sapiens
  misc_feature (132)..(132): n is a, c, g, or t
tgaacgcttcatcacgagttacaaggctttggaatctttgccctgataatattgaagcctgtaaatcagagacaagggaacacatgtccactttggaggaattctcttgaagaagcccattgtaacaggcangacctgtgaaaatattggtggaaacatgaatatataggctcgtgtaacacattccaaattatggttggc

SEQ ID NO: 573822 - DNA, 804 bp, Homo sapiens
gggcggatccgcagcccccacgcccgcagctcccgctccagcccaggcccggctccagccccggaggcatgtcccggccccagccgcagcccccgtcccggctgccgggtgcccgctcggactcgtggcctccgggccgtcctcgtgactcctgtgcccagaagccggctcgcagcgcctgctgtattctcactgacctggtgtcgggccgttacccgtggctccgtgcacttcgggctggtgcgcctcatccactggcggaggactcggacctcgtgagtggcgacggatgtcgatgtggccgcgggggatactctggggttgctccgaagtgccggtggggcgcaggtgcccaacagaggggatgggcctgggccagccccccttgtcaggccgaggattacagattgcgagcttccaagatgagtaccccgtgagaggcgtcaacgcaagcattgttgacagcgagaaccaagctgaaacctagaaggacctgtacttgtgagtgcccctgaagaatgtggaccggaacaatgctgatccacctgacagtcacgtgtggcacggtgatcgaccgtcaaccatcgactgtgccgtcaaaactcatcggaaaccaattgcaataatctatcccgtcacagcaaggacctgcagcacatctggcccttcatgtatggggactacattgcctatgactgctgactgcggaaggtcatacacttgaaagaacaaatcatctgaagtaatcaaacggagcaagtgctcatgaacacggagatgcgccagctctaaaagttgccgaat

SEQ ID NO: 573823 - DNA, 1160 bp, Homo sapiens
ccccctctggggtgtatttcccaccggggcgatttcaacgggagccaccctttgtccccagcggggagggtgttggggtgttctttcccccgtggtgttgtcctgtaagatggtgtggggccagccccgcgggagtgttagtacacaacagggagtgttaccgccgccggcggacatttctcgacagatgtcctgccgaagtagtctgtggggcccacataactcctctcttcgtaaaaaggagttgggagttgtgcgacacacaaagggctgcggggaaagagtattttggtgccgcccaaaagagaggcctgtcccaacaataggcgctcacccccgaaatatggtgggcgcgcccccccacatgtaactgcccgggtgtacccccattatagtggcgcacccccaatacctcttcgggggaggaaaacctttacccctcaagaagacgcagagaggtaaaggggggcacattcgcacgtgggtggtcccttgagagagaaaatgtgaaacggagagtttttcaaccgtcccaggccatcggatacttgccacaggagaactgagattcccccctattgttgagaatggccttgtgcggacccacattcggtgccactgtgagtgccactctctcaagagaaagtcacgagaagaaaggcccaacactgagcgggggcaagcccacaatagtgacaccgcacggctcgctcacatgaagaggcgtgtcacccccctgagaagaaaacacacgcgcctcgccaagagacacactgtgagggtgtcacccgcatatgtcttcgagaacattgcctgccatccgctattgtgaccacggctatctacacttattctagttctcgctgaagattgtccaagaagcctggcgcccaccacgcacgggaaaccacaggcaccccattgtgattccccctgacccccactttgactgcggtatgctcgacgaagggggaacacgtgccacatgtaccacacaccacagatgttctctgttctcctcgcactgggcaataagggagcccactcacgggagtgactagaatgaaccactgtaataaagcatttttggggagtggcttaggactcttcctcagttttctttccccgggcttgaaccccccctctgaggtttttcctga

SEQ ID NO: 573824 - DNA, 1060 bp, Homo sapiens
  misc_feature (70)..(70): n is a, c, g, or t
  misc_feature (72)..(73): n is a, c, g, or t
  misc_feature (84)..(84): n is a, c, g, or t
  misc_feature (95)..(95): n is a, c, g, or t
  misc_feature (552)..(552): n is a, c, g, or t
gattatacaatgacctattaaatattatatgattaagtagattatgtaaaaagtgctgtgggacactgtnannaatcatttagnactatgtgagnaaatcagtcaaggtttaagagaggagttaccagttacagataacaatgtatttttttccactgacctaagcctttcaagcaaaatcagaaaactgtaattttcactaaaataaatcatcaatggaatgacctagtttaagaccctttgggaagacagatagagtcctagaaatctctactacatcaaaacaaatcagagggataggcaaacatgccaatataactgaataaagagcccagaaagaaaccccttcaaacatggcatctttatatatgacaatcaatggcaaagagtgcatatttcagtaattgatactagaacaattactacctatatggagaaaaattagattcctacctcagatgtaggaaagaagtccaagttttatgaagccaaaaacttataatttggggattcctaaggaaattccaaaataaattaactttggaaaatttngtaaaaacacaaccatgtgaacattacttggggcttctcccagagccttgaaaaagagcttatacaagtgatggtagagtaaatctacctctgttcacaacgaacacaaaaataaatcaaaaatggttacacaattcaatatttcttaattcttagagaaatcatggacacaaatgtgatgcctcagagaggaagggaatcttacataggtaaggccccaagacataaagggccaactttcatggaaaggccttggaggtttttcattaaattaacacgcttgttctccagaaactgtcaattacggcctgtttaatacaagccacctggtgcgcgtttccacaagttcctccaagaaagacccttttatactacataggacagcgcgaaccccttctaaggaccacgcgtttcacacgtcgctctcgaacataaagcactctccacgaattttgtcgagcaaatcgcacacaacggcacaaataacggcgcagggcgcagaaacagg

SEQ ID NO: 573825 - DNA, 105 bp, Homo sapiens
gctgctgatctattgttggcatgacaggtacatcgacatgatcccgttgtgtgatgttctgtaagtaaagtccaaacaaaaaaaaaaaattgaagaaaagcagca

SEQ ID NO: 573826 - DNA, 713 bp, Homo sapiens
  misc_feature (89)..(89): n is a, c, g, or t
  misc_feature (134)..(134): n is a, c, g, or t
  misc_feature (150)..(150): n is a, c, g, or t
  misc_feature (179)..(179): n is a, c, g, or t
  misc_feature (211)..(211): n is a, c, g, or t
  misc_feature (218)..(218): n is a, c, g, or t
  misc_feature (225)..(225): n is a, c, g, or t
  misc_feature (307)..(307): n is a, c, g, or t
  misc_feature (341)..(341): n is a, c, g, or t
  misc_feature (521)..(521): n is a, c, g, or t
  misc_feature (567)..(567): n is a, c, g, or t
  misc_feature (583)..(583): n is a, c, g, or t
  misc_feature (622)..(622): n is a, c, g, or t
  misc_feature (625)..(625): n is a, c, g, or t
  misc_feature (679)..(679): n is a, c, g, or t
ggaggtattaacagacaagggaacagttagggatcccttctttcccctatacatacacagacatacaaacacacgcacccgagttaatnacagggaccatcaggcgacaaattgaagggcagagggaggcagcnccctccgagatttggnccggacccaagggtgggctgaaacctggnccaggggcagccgtcccgaggggttattcctnaccagtntggagangaggtcctgggctcccgtgggcacagaagcggggaactttaggtccaccttgacgatgcggcgataggcctcgttgtgtgangcactttcaaagggtgggttccccaccagcagcncatagcaaagcacttcaatgcaccacagacccaccttctcattgtgcatgcgccccttaatcatctctgggggcaggtagtccagggtgccacaaattgtcttcctcctcagggagggcgcatgcccagaccagccgaagtcagccatcttcagctctcccttgagccctaagagcagantttctggctttatgttttttttaattaccttcttcccatggcagtncattagagcatcttcnaactcctccatgatcgtggcttttcgctgctcgtcaaangtncagctcttctgcagccccttgtagagctccccgcggggggcatactctagaatnaagttgatcctcctccggtcataaaaatagttgt

SEQ ID NO: 573827 - DNA, 299 bp, Homo sapiens
  misc_feature (37)..(37): n is a, c, g, or t
tatttttttgggggggcgcccctgttcaccccagagngcctttttttcttttttcccccaaaaaataggggggccctttttttgtttttgggttttttttttgggtttttcagccccctaaccccaaattttttttttttttttttgggggggtttttttttcctttttttttttttcctttttttaaacctttttttttttttaaaaaattttttttttttttttggccctttttttttttccccctttttttttttttacccccccgcttaaaaattaaacctttaattttttttta

SEQ ID NO: 573828 - DNA, 354 bp, Homo sapiens
agtcaccgcgtactttagccaactgatggacaagctatcgagcgcgaagatagaaatgccgctcgaaggatacacatcgtccagtcgggtttcgacgaaccccaaaaaaaacccaccgtaaggtgttttttaactccaggcgtcaattcagttacgcaacggaagaccgtggtttgcccgggctgttgtcgtagaaaagtggtcacttccacggcgacggttcatggcgcggccgtagagaacgctggcccgttatcggccacccggggggaatttcccctgtggccattaaacccccttgggttcaacggatacgggcgagaataatccagggcctttgttagagccccagtt

SEQ ID NO: 573829 - DNA, 916 bp, Homo sapiens
  misc_feature (50)..(50): n is a, c, g, or t
ttttttgtgttattttttcgttgtggttgatctgagagcgaacccctagnatactgaagactaggcctgtgcttgtatcaacattcgtgctgttaatatagcatattaatcggaggcattatgaacgtcagaacagatgctggctataaaggatgaaccataggccaagattaaacgctgacgagcacatgttgctgcataggaaaggcaatatctctaggtggaaaaaactcgtctacatcgacctccgtttgtacattccatcacacccagcaatagctgtacattgtagtcatccaccattatagtttgagtgttttttcacgactgaacaccagctgctatcaagcaagcttatatcagtggaattatatgaattacgaaatgtggtgataatgatttcatatatagtttggggattagagaaaaggtcatacgatgtaccacaagagactcttagaccttataaggaaccttgggtcccattgttacaaagttaaaacttttaccccaacctgaatccattttccagtctcttttcaagctgtaaaaaagataaaaaccacgtgtgattcttaggacatcagatgcttcctactgaaaagggttgctgtagcaataacgaaccctcctttaagaaacaaagtgacccttaatacttatttttgatattacaactgagatggtgtccttactaagtgatacttgaaggaacaaagtgctttctatctctagaaacataaagtttagcaactgggcacagccccgacttaaatggctgaacctttggcttcatacacaagttctagaccttcaactcaaaatgatatgtatacttattattacagagtatacctattatatcaaatgtcttataaagcttgttaactagtctactattcgcatttatagggat

SEQ ID NO: 573830 - DNA, 921 bp, Homo sapiens
  misc_feature (333)..(333): n is a, c, g, or t
  misc_feature (405)..(405): n is a, c, g, or t
atagcattgacaagtgtggatcgcggggaggcgcgccagaggagtccctatagcgagctacgtggagccccataatggtccttcttcagcgcgtgcccaggtcactctctcagtacatctggtaggtgtgggtctccactgcgtaatacctgattcaatttgtaaccgacctgcctacctcctcgattctcatggagagcatgaggagtgaagcgtcccaaagaagcgtcgcatttggtagtgtagctgctctgggctcgcgtgaactcacgcttcttggatcgtctgcgttcgtaccaaatgtcaacacctctacttgatccatgcctcttnctcagacgctgcttggaactcttctcacatccaagaaatcttcttctagaagtcgacatgaatagctaatcntagctaggtccgaaatgtccctccaacacaaaataccaaagttaggcgtggagcctttctggccttcttccttgtcgagatctctgtatagtggtcataaaatatgaataattggagctatgtcaacgatctaggattattgctcaatgcttcatgctcagagggagacttgaaggggatgaagaaggctaagagattggttgactcagagagggttgaagttgaaaatggagaaagtaggtcactacggactatgtgacaagtaatggaagaattgacacactatgaggacggtttcgctatagaaaaaggcaggccgtgtagaattaccagtaatgccggaataatgaggtcagaactgatttggagtgaagagaagttgacactgagatggctgtacctataacggaactgaagggaggcgggggcgtgagaaatatcaggtgagacagtttgactaggaatagtgcgtccaaaggaaaggggtggagggagattgaggtaatcaagaatacg

SEQ ID NO: 573831 - DNA, 423 bp, Homo sapiens
  misc_feature (60)..(61): n is a, c, g, or t
  misc_feature (313)..(313): n is a, c, g, or t
  misc_feature (331)..(332): n is a, c, g, or t
  misc_feature (334)..(334): n is a, c, g, or t
  misc_feature (336)..(336): n is a, c, g, or t
  misc_feature (345)..(345): n is a, c, g, or t
  misc_feature (352)..(352): n is a, c, g, or t
  misc_feature (355)..(355): n is a, c, g, or t
  misc_feature (357)..(357): n is a, c, g, or t
  misc_feature (368)..(368): n is a, c, g, or t
  misc_feature (382)..(382): n is a, c, g, or t
  misc_feature (389)..(389): n is a, c, g, or t
  misc_feature (407)..(407): n is a, c, g, or t
tgggctcctccccccccgtgttttgggggcccccggaggagggcccttctcccccccccnntttttttgggggaatgggggtcccccccaggatggggggctttttgtttccccccttttgaccccgggtttttgttccccgccccttggggccagggtttttctccaaaaaaaaagttttttgtttcccctaaaaaccccttcccccggggtttttttttgctgttccccctggggcccccccccccccttttttttttgttcccggggggccccccttggggggccccccccccccggtttccccttgggntttttttcgggctttttnnangnaaaaccccnttggggnaantnggaaagggccnaaaaaatttttttnttttccntggcccccggggggggtngggggtttttccaaga

SEQ ID NO: 573832 - DNA, 513 bp, Homo sapiens
  misc_feature (29)..(29): n is a, c, g, or t
  misc_feature (217)..(217): n is a, c, g, or t
  misc_feature (284)..(284): n is a, c, g, or t
  misc_feature (292)..(292): n is a, c, g, or t
  misc_feature (305)..(305): n is a, c, g, or t
  misc_feature (326)..(327): n is a, c, g, or t
  misc_feature (337)..(337): n is a, c, g, or t
  misc_feature (348)..(348): n is a, c, g, or t
  misc_feature (373)..(375): n is a, c, g, or t
  misc_feature (388)..(388): n is a, c, g, or t
  misc_feature (391)..(391): n is a, c, g, or t
  misc_feature (437)..(437): n is a, c, g, or t
tatcgccaccacggaaaaatcgcccgccnctataaatttcgcttaattagagtaactcccaagagagtaagaatggctgaaatttaccataaagtaataatttccataatctttagaattctctcccaaccactgtgaaataggaagaaggaagttcttgccccgaatcttaggaaatcccccctcgttcggttataatccctgcctcctcgaatcnttgaggagtcttttaaattagatttttgttttgttgtctccccagttaatattatatttagatatcngagagtcnggccaaaaggaanacttttatctctagggaaaannacatttaganaaatgtattcngtgtatctaatactgaaatgcgggnnnaaatttaatgttnaanaaaaactatagacattgacatggaaaagagatttaatgttttgaanaaaaactttatattaactgagtaacatcctcctgatgagaagtactatattaaatataaacccattatgttataaa

SEQ ID NO: 573833 - DNA, 386 bp, Homo sapiens
aaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggcccagggcagtcaggtgggatcacctgaagtcagggatttaa

SEQ ID NO: 573834 - DNA, 191 bp, Homo sapiens
  misc_feature (89)..(89): n is a, c, g, or t
  misc_feature (152)..(152): n is a, c, g, or t
attgttgtttaatttgccgttccctaatgacatatgatgttcaggatctacttatatttatcacctatctgtatatcttgttttgtgangtgtctgttcagattttttgtccttttcttttttcttcttttttccccctgcccttttgtctncatttttaaaactttggttgttttcttattgttgagttt

SEQ ID NO: 573835 - DNA, 683 bp, Homo sapiens
  misc_feature (26)..(26): n is a, c, g, or t
tgcaggaattcggcacgagcgagttntttttttttactttagccttctttctatgaaaaccagccccgagcggacagagttccccacagacttacaagagtatgtggtgtgcaaacagaccttatggtaacaggtaccaagtgagacacccaaggactgtgcaagtattctagctcgctaaggagagttttttatggtgtggccacaaagtgtgttgaatctgaagtcagtggcaaccatattatacctgtccgtcaatttcgtgctgtgccagcgtttgtggggcaagacttgatccaaatattattcaccaaatttggttgtgtgttttaaaaaataacttccaattatgtttttttttccctgtgtttttagtatgccagacccgcgaaatgtgcttcactttccttaaggagcagatcggtggaaattgttttccgactgtaaaagtaaagattatgtttctttctcgtgagggcttttacgaggaaaaaggtctatcagggataagaaacccgggagattttcactgtccttgggtgcaatgtgggacagggtgtttttactaataggcccggcgatcttaatcctgttcgttgggaccaaatttgaacgttttaagggggttggcctttacccacattgcttgaaaaccccttctttgaggtgcctggatggggtgg

SEQ ID NO: 573836 - DNA, 442 bp, Homo sapiens
aaactcctttcttaccgtaggtttctcccctcccgtccgcccgggctgaagcgacacggctgcgggcgggctagtaaaccatggggccgattgagcgtgaactcctagtagaacacgtatgtgccaaaaagcaggttgtaacagaccgcaagcctagataatctccgactcactaagtagggaccatctctcgatacagagaaagacttgggaacgcagtaagctaggccccacgagggaaacatctagagcggccgcctctgtatgagaaacaaaaaaaggtaattgtaaaaagacgacacatagtaacacaaatagtaataaaaaataagataacaacagaaaaaaacacacacaccaaaacacccacagaagagaacaaaaacaggacaaaaacaaaaagagaagaaaaaagaggccaaacaaagtgaaacaggagact

SEQ ID NO: 573837 - DNA, 255 bp, Homo sapiens
gtttccctttagcaggagagacagtagagtatgggggcagcggaggagggcaaggagtgatgttcgggtagaagtggctgagctgggcacaggaggagtgccaggtcagtaccattgctcagtgacagacctcaaacttggcagtgctgaaggtacacacgggtgtgtgtgaggcaggctaagcgggatggctgccgcaatggagctgtgggagggccgggctcagggctagccctctccgctctaactgatgat

SEQ ID NO: 573838 - DNA, 145 bp, Homo sapiens
acccatatccaccttaataaccagacaaccttagtaaaaccatttacccaattaaatgttaggctaagaattgaaactggcgattagttatgcaccgcaaggaaagtggaaatttataccagtatataagcaggaccacccttaa

SEQ ID NO: 573839 - DNA, 2113 bp, Homo sapiens
  misc_feature (327)..(327): n is a, c, g, or t
  misc_feature (2113)..(2113): n is a, c, g, or t
gccgattcctaccatccttggatcgccgacgatcccttggactggcgctcagaaaaatggctacaaaacttcctagcacatgacgaagatctggattcgaccaagcttcaacactaatgaccgcaccgccacacacaacggacgactctcctaccgcacgacaagactgacaccagcgagaccactgcatgccgccacgcgcatgcccactccacagacccaacgcgcaccgccacaccggcgaccggcacaagcacgctgcactacacatacccgggctgcaccaactctagccacgaccgcacgccccaccaccacgcagccaanagccaacatacagctacgcacacacttcccaccttgcgcccactgcgccaatacgccactccacgccgcccacacccgagagcgacccctcacaacgacgcagccacacacaaggccgcgcacaagaccccacgcgacggcctcgcaaccccacccatccaggagcccagcactcaccccggcgcgcaatcatcggccccaaagacacacacccggaggacaacggactgagcaacgcaaaacaaccccaacagaaaagacatcccttagcgcagacatagcggacgagaactggggaccatacgccacgcccgcaacgcgccccctaggccacactaggccaaaggcgacccccccaagtccgagacccccccgaacagacgccccataggggccaacaccagacacacccacaggcggccccaataggcaaaaaaccaggactacgccacacttagggcgcaaagccaacaaccaaacagccccatacccaggacccccacctgacagccacaccaaaaccaacagggcgcatcacaccacaacaacgggagcgaaaccaaccaaacaccaaagcaaaccccccccacaagagacccaaaccaggcctaacacttcccatccacccccaaaaatacgacccagcaccacccacaaacgggccatggagaaaaaagaaccccacccccaccacaagcaaccagccaccgaccaccccacacaaccagcccccacacacgcgcaccccgacaccagaccacacaagagatcgaacaacacaacacgaggcacaccacatgcacaaacccgcacacccacacgccacgctttgcgcaaccctccacagccccaacgatcccggcaaaacccacccgctggacacccacaagacgcaacacaacagaaacggaacaccccaaccactcgacacgcggggcacagccccgcacaacgcggcgaaaacaacacacatcgccaacaggcccccggcggccccaaataccacgcccacttggcacccccgaggccacccacagcggacacacccgcaggccaattaacccgcagcccaagcgaccaccacccccgacccgcgtggcaaccacacacacacagacacaaaccggccgccacaacaccggcaaaaaacgcccgcagcaggaccaacccaccatggggacatagcagccgacaacaaaacacccaatcaccgattaccgccacagacttcaccacgatggacccgaagtggcaaaccacaccgcatataacaaaagacaccaccaataggcacgagacaaaaacatggcacactcgggaaaagaaaagaccaggagaacaaacaaaaaactagacatcaaccacgcaacaacacacaataacaagagcaaaagaaaaacacaaccatgaccgcaaggcgtcccacgccagaccaaccaagcatacccagcacccaacagcaaacagagatgaaaaccaccaagcgaacaacacaggtgcagaacaccaaaagaacacaaaacaacagaaacacaacaaccagcagagacagcaccaccgagcacaataaccacccgcggaccaggaaggccacaccatatcaaccacgagacaataaactaccaagacacgaaaaaagacgagacgacaaacgcaagcagcaaagatctaccaacagcgaagagaacagaaacatggagccagaggccaaaagaagaggagaacacgaccacacgaccaaaaagaaaaaagaaagagcaagcaaaacacagaatacaacacaatn

SEQ ID NO: 573840 - DNA, 142 bp, Homo sapiens
tcaatcggctcggcccatgttttacatgagtgtggtcatatgaaagatgaatgactgatgtagtacatgtatgagacaggagcgggcgggcggagcagagagagagagagagaagactagattacctaataaaactgataat

SEQ ID NO: 573841 - DNA, 316 bp, Homo sapiens
ttttcaggatctatcaaggtctagccagcaagtagtctacatttagaaactgagggtagaagtgtctgtattttgtaagtagagaaacaatgcatctacagaatactaagtcacatgtctttaacaaggcaatttacattattaggtgtcagtttttaattaatctttatgttccttaggatcctagcaatacactcagttgactgtatctcaagttcaaactgcactcacctggctataaaggtaaacatcacaatggaattgggcctgtctgactagggaaaaagatcacttcaatattgcacatttcctttct

SEQ ID NO: 573842 - DNA, 367 bp, Homo sapiens
  misc_feature (6)..(6): n is a, c, g, or t
  misc_feature (64)..(64): n is a, c, g, or t
  misc_feature (75)..(75): n is a, c, g, or t
  misc_feature (115)..(115): n is a, c, g, or t
  misc_feature (139)..(139): n is a, c, g, or t
  misc_feature (199)..(199): n is a, c, g, or t
  misc_feature (268)..(269): n is a, c, g, or t
  misc_feature (275)..(275): n is a, c, g, or t
ttttgnaggtggagtcctcaacgctgttgccccagggctggagtgcagtgttgagatcttggcncaatgcaatcnccacctcacaggtagctgggactacaggcacctgccaacnacgcctggctaatttttgtattcntagtagagatggggtttcaccatattggtcaggctggtcttgaactcctgaccttgtganccgcccgcctcggcctcccaaagtgttgggattatagtcgtgagccaccgtgcccgtcctagagtcagnntttaantcttcaaatattcaagaccggtttattagctatttgaggttgtgaacgcttctccttccttacaagtgcaaagcctaactcattgaatgtgt

SEQ ID NO: 573843 - DNA, 178 bp, Homo sapiens
agtagtccacgtcgcctggcttctccggcttctcccttaggtccccggtggtccatcacggcccttgcatagccatccaggcgtcggcttcccttctgtcctggtgatcctttttcaccactcaagccacggtcaagccacatagccacggtcaagccacaagccacggtcaacccag

SEQ ID NO: 573844 - DNA, 169 bp, Homo sapiens
tcatcaaggaatagctattagcggctggtggctcacacctgtagtcccagctacttgggaggctgaggcaagaggattcttgggcccgggaggtaggaggatgtagatagtactagataaacgttcacacagtctaaaattaccctttatactagctgaataatctcaa

SEQ ID NO: 573845 - DNA, 256 bp, Homo sapiens
gtccccaggggtcactttccatccacgggaaaaacaaatgccccttttccatttatcattgggatttcctcccaggaggcctttcaggttgggtaaagcaggggcctccagtggtcaggccaaaagcaaggaaaacctggctgcccccctgtgggtgaaaactcaaaacatttggaactacccttttccaattaggttcccttttggttaaaaacaaagctaattaaatcatcctgccccccgagggtccaaacca

SEQ ID NO: 573846 - DNA, 528 bp, Homo sapiens
tacttttccacggggacgaggcgggagttggccaggcctgcttgagcggcccaactccaaggggaatctgtctcccttctggctcacccatcagcggagagctactttcattcaataaaaccttgcactcattctccaagcccacatgtgatcccattcttccggtacaccaagacaagaacctgggatacattaatccctctgtccttgtgataaggaagggggtctaagtgagctaaaacaagctgtctacagacggctaagttactagagcacactgtaacacatgcccgcgggagcctgtaggagctgtaaaacattcacccctagatgctgacatggggtcggagctccacagcctgcccgtctgtatgctctcctagaggtctgagcagcagcggggcactgaagaagcgagtcacacccccatcacatgccctgcgagggggaccagggaacctttccggtttgaagcccatgtgacttccatttataagactctctgccatgtggagaatggtctggaat

SEQ ID NO: 573847 - DNA, 363 bp, Homo sapiens
tataactgcctcacccgatctcacgcacagtgcgagagttgaaggtaagccccggatgttgccagattacggtggacaaataaaaaaaaaaaaaaaaagcattgggccgctccaacagcaactcacaaatgcatgaaatgttttaacctctagacagactgccagaatttctctcttctaattcctacttgtagtgataacatttttctttttgtgatttttttttttaaataatagtgtagtaccttgaaacaactgcagttctaactcattgtcaccatttctgtttgacaagttccacttcctttgcaattattgtatttagttgtgcactagtgtcaataaaattgacatttgtgatgc

SEQ ID NO: 573848 - DNA, 107 bp, Homo sapiens
agttcgatggagactctcaggatccttcatccgcaaggcatctgatgtcagtgaagttaggatggtcctgggagagaagggatagatcgtcaagattatcagctaaa

SEQ ID NO: 573849 - DNA, 117 bp, Homo sapiens
gcggccgcctactactactactgctcgaattcaagcttctaacgatgtacggggacatgattatttttctaagctggttggttaataaacagtacctgctctcaaattgaaaaaaaa

SEQ ID NO: 573850 - DNA, 935 bp, Homo sapiens
ggggggcttcacgtggaatatctcatcttccccacacaatgactttgcaagatggaaaacactcgtccaccccagctgaccgatggggacaggtttggagaaagcagagccaaggcaggcactgatggaaacacgcggagaaggagggcgagaattttgtcccctgaattgagcaccattgggaacaaatcaatccaagtaagaatgaaacccaggctggtgaagaaagccaaacaaaacattccctttcaagaaacaggcaaacatcttccccaacgcctggactgactttcctgggttggcctgggaaactcccttctggaggtgggagccaaactcttattgtgactgagatttatcttccataaaagtccaggtgacggtgaccaataacaatctcaccattttactgatgtgtcaatttcctgtccacatacagaaaagaataagacttcagggaggcaggcaggcaacaggcacgtctgagtccatttctcagctgaaatctacaagaaactgaggacctcaatcccccaaacctggagcaatgcagtcctgcggtatgcttgataggggtgcctcagaaagcagaacccttttccccaaacctgaaggctttcagaattgaggtcctacatttccgtgggcaaggtatcctggagtgtggccttggtgagtgacccaggccaggcatggccacacaaggatttctggccccaaaactgtggctttttcctgtgcgttggtccacgcggtaagttggggccacctgttcccgccgggttctattaaccccaccagcgtcttgtttgggccggacagttccactatcttcaaattcgtgtgtctcaaaaggccccggttttcttctccccatgtgtcctccactggcgcttttccccaggggtttccccaccttttctcgcccactttag

SEQ ID NO: 573851 - DNA, 247 bp, Homo sapiens
tatgggcacagaaattattctgtctgacaccatatagtgaatacatgtcattatacatttgtccaaacccacagcatgtacaacaccaagagagaaccctagtgtaaactatggactttaggtgatgatgtgtcaatgtcggctcatcaactgtaacaaacataccactctggtgggggatgctgatgatgagggaggctgtgcctgtgtgggggaaatacatgggaaatttctgtgcccatttcaa

SEQ ID NO: 573852 - DNA, 127 bp, Homo sapiens
gatcacaggctccacgatgggcacacatgccattctgctggccaatacaggcactaacgggccaaaacattaggcatctaccatgatggcagagagctgagggggtgtgtaccccaatcttcaggca

SEQ ID NO: 573853 - DNA, 207 bp, Homo sapiens
agtatctaaatcaggtgtcatagcggaaggagtaattctctgtgagtcttggctctacgcctctagactcttggtacttgtcttctgattcgtccttatgcatcatagctaggagctcgtgtttagaaccttgggttcttttgctcatgctgcttctgttccagtcagaattttacggggaactacgtggtctactatttttgtaac

SEQ ID NO: 573854 - DNA, 744 bp, Homo sapiens
  misc_feature (354)..(354): n is a, c, g, or t
gaaagccttcggaggacagtgggagtggtacctcaggatgctgtcctcattccatgaatactagtttattacaacctcttatatggaaacatcagtgcttcatcctgaggaagtgtatgcagtggcaaaattagctggacttcatgatgcaattcttcgaagtgccatcataggatatgacacccaagtagggggacgaggactcaagctctcaggaggagaaaaggcaaaagaagtagccaatttgctaagatgcacatgttctgaagcgacccacgccacgtcatactctatgatgaagctacttcatcgttagattcgacttactgaaggacgacgtagattaccttgtgntgacaacaaatagacatggtagtgatggtcaaagaacagaacttctattttcactatgcacacagattgtcaacagtggttgatgcagatgaaactcacttgtcattggatcagggtaaggtagaccgaacgtggtacgccaccaatggtttgcttgctgaaccgctcatagtatctattcgagaaatgtggcatacacagagcagccgtgtgcagaaccatgataaccccagaatgggaagcaaagacaagtataatatatccaaagaggaggaaagaaagatactacaagaagaaattgtcaatagtgtgaaaggctgtggaaactgttcgtgctatagtcacatagacatttcttttttgtgttaacggctacatattgctgagcga

SEQ ID NO: 573855 - DNA, 598 bp, Homo sapiens
  misc_feature (456)..(456): n is a, c, g, or t
  misc_feature (528)..(528): n is a, c, g, or t
  misc_feature (585)..(585): n is a, c, g, or t
gttctggtggtattaggcatttatggactagtaaaaaacacattcttatctgtccgctttcggacaacaaccgggcttgattctgcagtaaatactgtgcagatgatggcacctttgaacatgttaaaggggcggaggaagctaaacatgaattacaggaagttgttgaattattgagaaatgcacaataatgtactattcttggaggtaaacttccgctgtggcgggagaagctgatggtgccttttattatgcttctggatcccaatgtgatgagactgttgtaggtgagggagccaaacggatcagacatccttataaggaagcacatgcgaatgctcattgagcaatatttaatgatgaattagatactgatgcagggaagagaattgaatctacaatgcatgcatattctaggcacaccattcatcaactgcttgctgaaatggatggacnttaacccaatgtatggctatcataataggagccacaaactctccagaggcattagataatgagctatacgtnctgatcgcttgacatgcaagttacagatccaaggacagatatgtaaggtcgacaganatattgtgggatt

SEQ ID NO: 573856 - DNA, 282 bp, Homo sapiens
agctggattcagagcttagtaggcatatgcagcttcatagtaagacttcatgatttgagagtttgttcctttagaaaaaaaaatgccttctggccgtaagtctcaatgcagcatatacaaaacagttaggaataccagtaaatacggcaacccgtgtagaccagtgaggagctagctactctcctctaaccaaaaggcagtgaagacagcactcggcatgtcatcatttattacaagaaagggggaagaaaagaaaaaccttatgtcgcttttcaaaattac

SEQ ID NO: 573857 - DNA, 870 bp, Homo sapiens
gaacgtaggctgcaatctggctcccgctcgtcaccgtcatagccctaccttgacgctccaatagagacatgcgccgtcggcaagtgagagccgcgtacggtgctactgagcagactcttggtgcctcggtgacggaaagatctaactaaccattgggcaatccgcacgatcctacgaacgccaagaggcaaaatggtcatcatctgccttttggtggtgcaaactagtctgcgcgagtgatgcacttcaactaatgcaagccgaggccagactcgacttcagtccacacgttcttcagagattttctaatgatagtgctgcatgagagagtgtggaacgacctacttgtctgctagatttaggaaacggagaaccacttgtgcatgatctgcgcaacagccggacagaggacccgtgatagcaccgagaagattgcaaaagcgcatgataatgacctgcccagaaccgggaagatgaccaaaaagacgaatgtcttcattagggattccctacattgccggcacccaaggaagggctgtcgtttcagggcgtttcgttgcgctgcgttgtctgttacttgatgattatcgccgcgagaaaaactcgaaaagggcagaaatactacctggctcatggtctcactttggtggatcgtctagcggataggagagaacttggagcgcagaatcgtcgaaaaatacactgtaaggtgggcccctccatcgcttgaggtcttgcttgagagaagaattgctcgaagacagccccaaattcgctagcctaggaagccggatgatctgggtgtatgattccggaagcgtagcaggccaagggctgattagacatgcccggtgaaccttgagatgctgg

SEQ ID NO: 573858 - DNA, 434 bp, Homo sapiens
  misc_feature (24)..(24): n is a, c, g, or t
  misc_feature (46)..(46): n is a, c, g, or t
  misc_feature (81)..(81): n is a, c, g, or t
  misc_feature (178)..(178): n is a, c, g, or t
  misc_feature (250)..(250): n is a, c, g, or t
  misc_feature (274)..(274): n is a, c, g, or t
  misc_feature (432)..(432): n is a, c, g, or t
cccccttaattattttttagaaanctccctttccaaaatgccacanaccccttgggaggcctcaaccccttaaacccccancccagatatcatccttaaattcagttacccaccttcaaagaaacaggaccttggggagaggaaggagagaggttggaaagaagcccacagagagaantgggaaagtttaggctgggcacagtagctcaggcctgtaatctcagcatttgaggaggccaaggcaggaggnttgcttggggccaggagtttgagnccatcttgggcaacacagtgagatcctgtctctacaaaaacaaaatttaagaattagccgggcgtggttgtgcacacctgtagttctagctactagggaggctgaggtggaaggatcccttgagcccaagaggtaacagtgagctatgattgtaccantg

SEQ ID NO: 573859 - DNA, 99 bp, Homo sapiens
atttattattttacagttctcaaggtcaagagtctgcagcatttttcaccggccaaaatcaaggtgtcagcagggctgcatcccttctgtcgtcttctc

SEQ ID NO: 573860 - DNA, 636 bp, Homo sapiens
gccgccttttttggttttttttttcacgcttaattcactttatttttctggtataaaaaccctatgtggtagccacagtgggagccggagtccgggcagggagactcgggggggggtctgggacgagggggtcagggaactccggcatagggagactgggggaatacagtctccttccagaggtcgggggtcaggtagctgtaggtcttagaaagggcatcaagagggggcctgggcgaagttgcccaggggggcgaggtgcagcccgcgggcgtgaggtggatagcacgttcattgcgagataccagcccattacagtgagacaggctctcatataaggcaacaggggtggcggagaacgagtgccaggtgccccggggtgtgcagggattgaggggataccagcaacagagccgacaggggcccggttcacctgggcaggggaccagggtgggggctaggccagatctgtgtccccacagtagcctcgtgggcagggggacagagggagacgctggcgccagggatgaggggccccgggagtggggggggcacctcctgggagcatttaaaaccaagaccggagggggcatggtagtccccgaatagcaacaaaggcgttgaacctgggttgcg

SEQ ID NO: 573861 - DNA, 137 bp, Homo sapiens
  misc_feature (37)..(37): n is a, c, g, or t
  misc_feature (42)..(42): n is a, c, g, or t
ccggttcagtagatgtgaagtggcaggatccagagcncacangaggcagtatactgtgccactgatttacatggtctggggggtaaagaggctggagagctggaacactgggagcaagttcaggctgactcagtaac

SEQ ID NO: 573862 - DNA, 528 bp, Homo sapiens
  misc_feature (420)..(420): n is a, c, g, or t
taaaaggtttccccaacaaaaaaaaagaggcttggggggggaaagggaaaaacccccaaaggggggcgaggggggggggggctttcaaggggccctaaaaaaaggggggggaaaaacccctccccaaaaggggggggggggggtgtgaacccctttttttaagatcaggcgttgttttggaccctcagtggttttttttttacccgccgcccggggggccttttttaggggtggggttatatcaacgctcggcgcccctttgggggggtatttccggccggggtttgttcgcccccgggattttggtgagagtttgaaaataaacgcggccaattgtgggggaaacgtagtgtgacagagaggggtgggggagcgctttgggagaaaaccgggggtgccccgggtattccccgggggggngaggaaatggggggtgtgggtcttcggttgcataaacgcaacaaggaagtgtatgagtagtcgtgcggcgggtgatgtggaggggaagggtggggaagggtgcgggtg

SEQ ID NO: 573863 - DNA, 126 bp, Homo sapiens
tccactcgtctttcttctcatatgagacattcccttccagatctcgccatgcttctaggaaagatccgtgatgctgatgcaggatgatctgacttgatcttctctcggctggcattgagccaaagc

SEQ ID NO: 573864 - DNA, 180 bp, Homo sapiens
tccccccccccccccccccaggtttagaaaaaaggtttcccccaaatttgggttcccaaaaaattttgggggggaaaacttttttaaaggggttttggaaacaatttaaacgggttttttttttccccccaggacccccccccctggggtttggttccaaaaatttttgggaaaacccca

SEQ ID NO: 573865 - DNA, 1557 bp, Homo sapiens
  misc_feature (550)..(550): n is a, c, g, or t
  misc_feature (1364)..(1364): n is a, c, g, or t
agtaccccgctgtgggctgcacttcgaaggactgctcgagatcgcctctgtcctacacatcttgaaacgaggcgggatagtgtgagccgcggcgacttgccacagtggacccgtgcgctcgaaggagatctcgacacgtggatccctacgcgcagggacccctgtacacgccgaactccggcggctcgtgcggcgccgtatcccgtgcctctctctgcgtggctgcatcgatgttgtgtgtcggggggggctcgcaggatttgacgttgcgcgctgccttgcgcctcaactctcaccttgcagaaggcattggtctcagtgtcaccctcgccgagagaggagtccggcgcacgcctggacgcgtgtaccaacgcggttgcgacctcgtgcactaaccattgcgcagccaagaatgcgtagtcgagcaagatagtcccgaggccgagcttttgccacaggggaacgcgtagtagtccagttgtttttaccagctggagaatagtagttgcataaatgaactgtgggatgtcatctctactactcaccgcgnatgttcgggtgctgtgctgcccacaaaaatgggcgtcgtggagaaccagagtctcgagtaagtgaccgaaccacatcacgaaagggcaaaaagttaacgaagcacgcaccagctatgaggcactacacatttgcattggacatcattgtccttcacattagccctattcacagaatcaagccttgcgctcgagtccctaacgacgcatcaatggagtcccaaatgtatattatataaacagttatataaatcatagaggtcaaatttctggcttagaataaaactagcctatatccctggggaggttgaaagagagggcaaggtacgggcttgtttgccacatgaatgtctccatttggatagcggtgtcaccgaaaggcccaaggttccaagtttccattacttcaaggacggttacaagtggagatcatagacagggcggttccgctaaagataactttaccccctttttcccagtggttaaaccctataacttttaggcaacccctttgtcaccagtggccgaaaaaaaaaaagttggtttccaagagacattaggggattaacaaggaagggccttttaaaactgttgggggcacaccgaaaaaagttggggaaaaggaaaagccctgggtagccaatttccgtggaaagaacacagaattggattgtcccgcaacagattttggtatatcccggaggaatatcccaggggacacgggccaggaggtgtcttcacccaataatataaccaccttcttttatgggatgtgcaacaagcctggtggcttaaaaggcacagtcccacccattntggcgagtctcgtgcctggcacacacttgtgtgttcctcaccacgggggacgaccacttccgcgaagacattaggatcgggcggcggcatgagtctaacataaacagcgggggctggaaatttcaaaccaatcatagcatatagccacaccgaatattacacccgtggagaaaacacaccagtgtcgtacaac

SEQ ID NO: 573866 - DNA, 406 bp, Homo sapiens
  misc_feature (111)..(111): n is a, c, g, or t
  misc_feature (139)..(139): n is a, c, g, or t
gcatgccgcccaccacgccgcagccacccaccacgccgcagttgcccaccacaggctcacggcccacgcaagtttggcccatgacgggaacctccaccaccatcgggcttntcagctccaccggaccctcacccagctntaatcacacccctgccagccccacccagacacccctccttccagccacgctcacatcctccaagcccacagcctcctcgggaggtaaggagcctccagctgagcccatggagagggcagctgcaggaggtcctaggtacacctctggggtgggcttagggatggccctgcttcctggctcacatctgccactaagcagattcccagcgtagaacttcctatgcttgggagccaaactggggatttttcggaaaaacttttaaagaca

SEQ ID NO: 573867 - DNA, 105 bp, Homo sapiens
ggatttgctggtgcagtacaactaggcttaatagggaaaaaaattcaattaaagactaataaggaaagcagcttattaagttggtattttaagagagaggaaaaa

SEQ ID NO: 573868 - DNA, 112 bp, Homo sapiens
actcgaaaacaagtacagcgctaaagtcagcgctcagctcgttaaagaagcggctgccatcggctacaagagaaagagaaccaaggaatttaaataaattcctggttcctaa

SEQ ID NO: 573869 - DNA, 247 bp, Homo sapiens
cgctgaacaatgacacggcatacgcagaggtcacgacactgcacacgccgaggggccaaactgcagcacgccgagcatccatagcaaaatcgccgatcttcacgtgcacacgccgaaaaaccacactgcacacgccgaaggtccacactgcacacgccgagggtccatactgcacacgccgagaccccacacggacaggtcacaggccgaaatcgccgatcttcacggatcttcacgagagcaatgt

SEQ ID NO: 573870 - DNA, 389 bp, Homo sapiens
ggggccaataaaactttatttacaaatcaggctgtggccagatgtggcccacaggctgtagttgttggacctctaccgtagaccatcatgaggcctggggttcttcgagaacaagaactccttggttgattccccagggtacggcagggccttgggaacctgggtgggttggggagggtctaaaaaggctcctttctttggtaacctgactttttggaagctcaggtctagctgacgccccatcactgggccaggggggctgaggcaggtgatttggggaagggtttaagattcctgaatacatttttccatattatgccacaccttttttctatggcccttcagagccttgcggcttggggactaatggttgggaccggaattccgtg

SEQ ID NO: 573871 - DNA, 192 bp, Homo sapiens
attgttttctacaccaaatcttggtttttttcttctttctttaaacatagaggtaccaccacaaggcatgccctactctctcgcagctcttgatagcatctgtttgaggcaaagctctctcggcaagcaagtggctatttggattgctgtgcttccccttttttccaacctcgcacattgacatcataaaat

SEQ ID NO: 573872 - DNA, 1456 bp, Homo sapiens
tgtgcctgttctcgcgaggtgggtggttttgttaccccttcgtcttcgtcttgtaactcgtgctgatactctcaggtatggtcggttcgtccccaccacactatcctgtgtcctttctactcgaggatggttgttccctacgtcgagtgtgttgtcccccgccctcttttcgtggggggggagaagatatcacctccctctactgttgatttatgtgcgtggttgtccatcgccgggttggggtgctgttggtccatagtatctaataatacactctggtgggttcactcactccctctttttgtttgtgtgttgccgttggtcgtgcgcgcgcttcctatcattgtgttgtcgacccacgcccaatttatttgtttttcttgcgtggccgccccccactaaattgtattgtattctgtcccccgacgcacttcttgttcgttgggggcggcgacacgtcgtctgcgatttaaaccagacagccgggatctagttagggaaggggcaagtaataatattgtgtgtcctcccctcaacattattgatgtcagcgggcgtgcccctattttattaagaaggatgacagtcgcgttggatcataactacgcacaaacagcgagtattgttggtgggggcgcactaaacacacggggggggggtattatcttacacctcacacagactgtttatctaacactttggtgctgtggggagtaagaatacccctccttgatttgcttccccccgctgtgttgttatacgcaccagtcttgtgtgtagtttgttttttttgtaacagccgggggagggagtgcgggagaggcccccccctctctttttgatagagtcgctcttctcgcggtgcgaccattgtttattgtatcccccccgcgtcgtgcgtgcggtgaggaggagacaattatctattgtgtgtctttcaagcgctgcgccctcttcacacaagagacattttgtgtgagaaaaatattgtagcgccccacttatttatatcatccctcgtttcacccatacgtagtaatagaggtattttttgctcccacacaatgtacttgttataataggtagtttattttctcgacacatcccgcatacaccacacatctggtggtgggatattgccacgacccgagtgttaccgccaccacattttgatgtgccattgtgtgatgggaatcaccctgcagcagcccacaccgctggttgtttgttactcactcacaacgagtggttgtaattagagacgcctcctccctcaactcatgatggtgaatccctcttttcttctgtagtggagagaatgtttaacaagtgggggcaaataactcttctttttatgataaacaccatcgctccctttttttttttttatcccccccctctctttttgggaaaaagggggagaaaagggaaaaaaaccccctttttttttttttta

SEQ ID NO: 573873 - DNA, 285 bp, Homo sapiens
ttactgatcctgaggatccgagatcacgccataatagcagcctcggtgctccagcatacttcttcatctcagcctcccaagtagctgggactacgggtgcacgcaaccatatcctgctgattttttaactttttgtggagacttggtctccctatgttgcccaggctggtcttgaacccctgggctcaaccagtcctcctgcctctgcctcccagagtgttgggattacaggcttgagccattgtgcccagtctatggtatagttttaaaaaacaaaaccaaaag

SEQ ID NO: 573874 - DNA, 255 bp, Homo sapiens
  misc_feature (23)..(23): n is a, c, g, or t
ggggcccccccggggttttttcncgggggttttccccccgttttttcccccccccaatttccgccaaggggttaaaattttcgtgggtttttcccccgagggcctttttttaaaaaaaaaccaaaaggggggggggttccttttttttacccccccgattggcccgtttggggggttctgttaaaatgggggggtttttttggttttttttttttttgccccccacccttttataaaatattttttgggggggga

SEQ ID NO: 573875 - DNA, 246 bp, Homo sapiens
atccagctccgcatatagcgccgttcatccgttcactgatttctcagtcatccttctgaccgtaatgtttgcttcatgatctgggtatgttctggagtggaccgttgcaaacactgaagcagcagtcagctgcatttgttgtcctggatgtcagagccgaattgagccgggtcaactgtgggtgcccaaagaggtcaaggtaatctatcctgaatcttgaaagaactccccccttaagcggatcag

SEQ ID NO: 573876 - DNA, 341 bp, Homo sapiens
ccagcgtttggaaagcaggttttgtgggaccccccgccccgccccccgcactccttaaaagcagcagtagtgggttttccaccctgttttctgccacattttaaacaaaactgtgctgtgcccctccgggaggcctggatttggcaaaaagaaacacaataaacccccttctttttcttttccgtccaacaaatttggagagctcttggcccccctacccctttcccccttttggatttaattttaaagtcagtgtactgcaaggaagctggatgcaaaaaaaaaactaaattaaactggcctgttatttaaaatgtaataaaccagtttgccatgaggga

SEQ ID NO: 573877 - DNA, 480 bp, Homo sapiens
gctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagactagcctgggagccccatgtacaggagggagggcctatggcacagctgccctgtctgtcagacggcaggatagatggcacactagcctaccacggtgaattggccacgcaggtgagtactgtgttacggacggccaccacgcgagcatctacccaaacggagagcaggtaaggagcagaagatcttggagcagaaggcggcctgctccatgccccacttcgggtcagctga

SEQ ID NO: 573878 - DNA, 124 bp, Homo sapiens
gttgggattacaggtgcacactaccattacctggttcattttcttattttaactagagacaggttttatcatggctgaaaccaccaggctagtctcaaactcctgacctcaggcgatccgccca

SEQ ID NO: 573879 - DNA, 679 bp, Homo sapiens
  misc_feature (22)..(22): n is a, c, g, or t
  misc_feature (105)..(105): n is a, c, g, or t
  misc_feature (120)..(120): n is a, c, g, or t
  misc_feature (255)..(255): n is a, c, g, or t
  misc_feature (297)..(297): n is a, c, g, or t
  misc_feature (319)..(319): n is a, c, g, or t
  misc_feature (344)..(344): n is a, c, g, or t
  misc_feature (353)..(353): n is a, c, g, or t
  misc_feature (367)..(367): n is a, c, g, or t
  misc_feature (412)..(412): n is a, c, g, or t
  misc_feature (471)..(471): n is a, c, g, or t
  misc_feature (515)..(515): n is a, c, g, or t
  misc_feature (540)..(540): n is a, c, g, or t
  misc_feature (544)..(544): n is a, c, g, or t
  misc_feature (551)..(551): n is a, c, g, or t
  misc_feature (556)..(556): n is a, c, g, or t
  misc_feature (584)..(584): n is a, c, g, or t
  misc_feature (593)..(593): n is a, c, g, or t
  misc_feature (653)..(653): n is a, c, g, or t
aaaataacacgctaaaaaaaanaaagccagttcctgcagactccgaacaacgctggggagaagctccctgagacccccggcgggaaagcctggtgggaagcccanctgtgtggtacctgntgctccacctgccttggtgccatcacagcccggacaatggccactggcctgacaaacgcacccgggccctggaggctgggctcaatggccccaggcagaggagggggaggcggcctgaactggcccgggccactnggccgcaaggttctggtttcttattgctcaacctggggccangggcgttttaaggacatccaantgagctgccctcctttgctaaacanaggaggaangaaggtaagaaatnaaaggggattacaaaacgggctaagttttcccctagtccccgctntctggacatgagagcctagccagaaccacgggcttcctcttaccaacaccaaactgtcnttaagccccgccaccgccacccaccatcacctcccactgtgganggtgcgtcccaaagctccaattaantaanaaggtanggcangagctgggatgaccacccttcctcagcnaggaaatgnaacactggggtccaggaacggggtgctcccgggtaccacacctaatgcccctgggagggntgctcttggctggaggtgggaagggg

SEQ ID NO: 573880 - DNA, 1310 bp, Homo sapiens
tggcaaacacttttttttttggaagctcttgaaataattacacccgtgacgtgctctaacaaaaccaggtgctgaaagcgtgattaaatctatttgacgggtggcaccgtgggtgaatttccttctcacagcttcagcacacgagcaagtgactcgtggagtgccatcagcacgtgcccccacagcgcattatgtgcttctctccttctgtgggttattggtgggaagttgtggtgcaacgtgggtgacacaaatgtgtgcgtgacagaggtgcctcttcaacattccacgtggagaaaaacgcttgcacatgccaaagggaaaaaaaaatgtgaaaaacgcggaagcaatgtgtccttctgcatatgtgcttctctcccagcagaatatatttcatctcaccatatttctcatgtgcgcgtgacacacacaccgcatagacacacaaaacacaaaaagaaagcttccttttgtgttcccacaagaaataaccctgtgtctaccaatttctcggagaaattttcgcagatacataccccatgtgtctctcacttttaacgcagaggagtttagaagacataatatttcaccatatatatatatctccacatatatctcaccatctctatctcctttatatcgtgagacagcgccctatgtgaatgctgaaagaatttatgtaaagcgctttataaacaagggggcagaaatctcaggcgaatctcccagagaagtgcttgaacaaagtggggcgtgctcttctcacagacaaaaaccctcttgcagcaagctgtgaaaaggagatgaaaaataaacagagagagaatatacgaaccacacctatacagctttcgtggaagctttatcctcatcagacggagttagttcagaaccacaagatatcgtgctcacccagatgacaccagtgtatcaggggacaaccaccacaacaataacgcaatgtgttaccactgggatcaccatcttgacagcaatgccccccgcaatacgtagtggcgcagtggaagaatcactgtgtagtcacccgaatgatatattagcgagcctatgtcgattgtgcccacaataaaagtcatcttgtcgttatccgctaagataaacaagcaacaacatagatgctgtgcacaagcccacatacaacgtgattagtcagaaatcttggccccaccagaacaactagctggatgacgaagaagcggggcgtttttagtgagacgagacaaacattgtgcgtatactatccaccataagtgaggacacagtgcctatctcaacaaagagccacaaca

SEQ ID NO: 573881 - DNA, 172 bp, Homo sapiens
  misc_feature (52)..(52): n is a, c, g, or t
gcgctgtatcccaatactttgggaggcaaaacagaggagcccttgaaccagnggttcaagatcagcctggggaacatagcaaggcctcctctctactaaatatttttttaaaaattttttaaaaagtagctgggtgggccgggcacggtggctcatgcctgtaatcccagca

SEQ ID NO: 573882 - DNA, 284 bp, Homo sapiens
ggggtgttagggaggaggttggagaatgaaggcagagagggcagcactaaaaaaagaaaaaaaaacaagtctgggtgcagtggctcatacctttaatcccagcactttgggaggccaaggtgggcggatctacctgaggtcaggagtttgagaccagcctggccaacatggttaaaacctcgtctctactaaaaatacaaaagttagccgggtctggtggcgtgcacctgtaatcccagctactcaggaggctgaggcaggagaatcgcttaaactccgagact

SEQ ID NO: 573883 - DNA, 414 bp, Homo sapiens
acaccacagccagtcctgccacagccctgccacaaaaaacctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacggtaagtgtttataatttgtttaggttttgtaagctgatatttgcatgagaagcaaattcattaaatcttaaaagtttcaagggtcttaaa

SEQ ID NO: 573884 - DNA, 413 bp, Homo sapiens
  misc_feature (15)..(15): n is a, c, g, or t
  misc_feature (85)..(85): n is a, c, g, or t
  misc_feature (96)..(96): n is a, c, g, or t
  misc_feature (152)..(152): n is a, c, g, or t
  misc_feature (184)..(184): n is a, c, g, or t
  misc_feature (273)..(273): n is a, c, g, or t
cctccctgaaaattnctttgaaaacctcaatttttatttcaaaaaactcagggggaagtttgcatttaaatgataggaagcacanagtgcaaagancccaggcccagttcccttatgtgatcccagttccccagatctacaaataagtaatnctgtaatatgtaaataggcccaggccgcaagntgtcacgcctataatcctagcactttgggaggccaaggcgggtggatcacttggggcccaggggttcgagaccagactgggcaacatgncgaaaccctgtctctactaaaaatacaaaaattagccgggcatggtggcatgtacctgtaatctcagctactcaggaggctgaggcacgagaatcggttgagcccaggaggtagaggttgcagtgagctgagatcgcgcc

SEQ ID NO: 573885 - DNA, 891 bp, Homo sapiens
  misc_feature (809)..(809): n is a, c, g, or t
agcggggctgcatgcgcgccttcgaccgtcaaagcatccaggcagccccctgctccggtccatgcatggaacgaccccgacccagacccctcacaaaggctcctgagcgaacctgagcctcacttttactatgagctatcaacacggtgcacgtacatgtgaggctatgactctggctaaccatcttgtgcctgctgggtatcctcactcgtctatcgaaagactgacgcaaggtgaagtgcaggaaggcggactccaggtctgagagcccaacctgcaaattccgtgtaagtctgagcttccctcttcagcccctggtggcggtcggcgtgtaacagccttgcccgaggaagagctccgttgccgagccctgcctgagcgcggtgagcctgaaggaccgggtgtgaggcggtggtggacccagtctgggcgccgggagcggctccgcgagcatatgaggcgcatcagcgcaaggctcctaggctggagcacaggggactcccctgtcttgttcccttcatcccaaagcgctgttggtcaaggaaagaatctcaccgcaaatagtagtgcactgtcttgaatgcgctgatgagaacattggtcgcacgtgggccttcactgcctcacatgcgggaatctctgagcggagccttcgaattcacacggaccgcgagggcagtacactgaaagagattactcggagttcacttcttggcaccgaacatgtacccttaaagctaaatgtcaaagcacatgagggaaaagattcaggaatttgggcagatgacaatgggagcagccctactcantgttcttcttagtgatattacgtggagttccctttatggaaaatgcgtacgacagaagccgacgcacagagaagggcgaaac

SEQ ID NO: 573886 - DNA, 413 bp, Homo sapiens
acaatcctggcttcagtttcttcctgtgtaaaataagaggtttggatgaaccccaaattctttccattctaaaaagctgtgtttttatcattctttcctttatcttttcaagtattctttgggtgaaacgctattttataaggtgttaatgaggccaacagtgtattcaaaagtaaaaggtcctgattaagacttggtagtgagaatattctagctttgtagctgtgacattttcttaacatttcttatttggcttcctcagggcatcacatattatatatcacgtaccacatattgtttcccatgtataatctatacttgtccctttatttatttttgtgtgtgtgtgtgtgattcttctttgagcaatatacttagttattttagttacagaaataatacctgtttattgc

SEQ ID NO: 573887 - DNA, 403 bp, Homo sapiens
  misc_feature (119)..(119): n is a, c, g, or t
  misc_feature (126)..(126): n is a, c, g, or t
  misc_feature (187)..(187): n is a, c, g, or t
tcaccgtgatggacgttggcatccaccggtacagcgcgccaggggtgggctggagcggggttagacttgtggcccagcatgcacaacaagtttcccgtgccgacttttcccgctacganctgatcntcgccatggaccagagcaacctgcgcaacctcaaggccatgcaaccagcacagggcaaggnggacctggacctgttcctgcgccgttacgactcggtggtggatgaagtgccagacccgtactacgaaggcgaccagggctttgaaaccgtactcgacctgatcgaacgcgcctgtgacctgttggtgattgaattgaagggccggttatgactttgcaggtgcaggcacaggtttcgctcaaaccgttcaacagctttggcatcgacgtgcgagcc

SEQ ID NO: 573888 - DNA, 376 bp, Homo sapiens
tcaaaagacagttgacggaccaggaagcttgatgcatggtgaaagaattggtctttctgcccgggcttggtggctcatgcctgtaatcccagcactttgggaggccgaggcaggcatgatcacttgaggtcaggagtttgagaccagcctggccaacatggtgaaatcctgtctgtactgggattacaaaaaaattagcccggcgtggtggtgcatggttgcattctcagctacttgtgaggctgaggcaggagaattgcttgaaccccggaggcaggggttgccgtgagcagagatcatgccactgtactccagcctgggcaatagagggagactccatttcaaaaaaaaaaaaggggggtttttccttgggaaa

SEQ ID NO: 573889 - DNA, 108 bp, Homo sapiens
acagagtctctgagtccccatcaacctgcaaatctaccccagcatcagagggtgaggaccgaggagctgcgagcagatcaagaccctcaacaataagtgtgcctcctt

SEQ ID NO: 573890 - DNA, 665 bp, Homo sapiens
gggatatcacagatagaatcgttcgaggagtagatgagaggtagtctgctaggtggggtgtatgttgactaggtttacatcgttcggactttctaagctgttcaggtattttaatgaaccaagggagagcactgtgaataaaggattatgcataataagaaggtggtgagggggtagattcacagagtttgggatcttttggatttgcttaaacagtttggggattaccttgctttacattgaataggcctgatgttactgatgctcaagggaaagtcaagtaattaggaaagaagaaagcaggcatcaaactcagacaaacaaatgaatatactatggagaaggaatagttgtggttggtggttgaaatggggaagggagcagggagaagcgcatggaatttctggaggaaattggtacttaattcctacttcaggcttttcgaaacttacaggacattgactcttggatgatactattaaacctaagcatcttttatttttttagaatagaaactttcagcttacattttcttcagtgtaggaaaggagtccacgggcacaggggatagtataaatcacatgctttgtgataggagcagtctttgacattacggagctctcagctcctggtgttcgtcggttcctagattacattatagtgtt

SEQ ID NO: 573891 - DNA, 935 bp, Homo sapiens
gggatgcagatgggtgctatcagagcctctcccacaccactatggtgtaataatgtgattattactctacactgaagcggatcagagttcgatattatttgagcttcagatgtgctttagaggcttttcaaatgtaccgatgatactgtttcttgctacatgaatatagtaaccacgtccacagtgttcatatggggaaggatatggggaaggaaatatatttgtaagacagatgagaggctgtatctatttgcagattttacaagggttcggtccactaacaattcgttggagagatggggtgatattccatggcgtggatcagggcttggacctttctgctcgggtggtacccgtgggcgtcgacgtgtgacctaagggacttagctagtagtttcatcacttgtgtatcggcttactaataagaggtggtgactcagcaggagcggaaagtatgtggcaggttccacctgggagccaaggtgggggcctgatggctttgccagaaatctggctctatgaacctccgtgaggcaggatctgtgaatgactccacattgtgtctagcatgaagtataaactcatccagcggttaacatctggacagactcggtcatcgcagtaccgaggagtattataggtaaaggtggtggaaccctaaatacggcttgtggtgggggtctccatgcaggtaattggagggccggcactcgctgtgaattggctggcgcttaatgatggacaggagactgtttacgccttaagaagaccctgttttgtggttgactcgggtacctggtccctgtgggcaaaggccttccacaatgttcccttttgcccaagactcactactgtctgccaaggagagccgtttgtcacaaaaaaaattggcgccagttaatgggaggaataatagatggtacaaggcattggac

SEQ ID NO: 573892 - DNA, 925 bp, Homo sapiens
gccagcacgtaacttacgcggtatacgtagcgtcagataccgccaatcagtgccagtagcagcaacaccacggtggtggcaatcatcgcattcaggcgatattgcgggtcaaccgcccaaataattagcaccatcaggctcataagaccaaatgcagcgaaaagcatcgtcaggcccagcatcagtaaaagttgaaagagattcgctttttcctcttccagctccaccaccgccagccgcagacgtgtctctaccatttcaaccatgatagaaacaattcgctgcccgatgcccagaacgcttttaccgggcccttgtgcgtgatgagtgtccgccataattaacgacgcgacagcagaacgccgagcactacaccgattgcagcgccaatgcccacgcccgtccacggattttcgcgcacatactcatcggcacgcgccgccgcgacacgggtttgtttggcaatggcatcaccggtttcacccaggcgataacggctctgtttcagtgcctgctccgctttgctacgaatcttactcaactcttctttcgacttctcgccagatgagctaagcacctcttccagcgtatcggaaagggatttcaactcagcacgcagatgttccgtagtgtgttctttcgacatagttttctccagggtgagtaaagtacgtgactatttgttgaggtttagtacagtcgcggcgccttccagcctgttttcaggcgtctttcctgcggcttcttgccaaggtttcccggttccgcgttttgggcactctttatccggcattcgcccttttttgcttccgcctcgggctaaatcttggctggggttcccgccacctcatctttcggctttgcgatttcttctggatgatccggccgcagtggcttctgaccggtggccgaatccctcagggtt

SEQ ID NO: 573893 - DNA, 398 bp, Homo sapiens
atagaatcgagctcgcgtaccacaccagctcgggggttgcggagacgggggttctcgaactcctgacctcaggttgttttgcctgcctcggcctcccaacagtgctgtaattacaagtactgagtcaccacgccaggcccctttgctctttaaatgtgtagtagtttgatttttttgtcctctattgatgctgcagctcagagacaaaggcagaatctttatcctgacgggcaacaccgtgtcatctggcttctgtgacctcattggtttcttggttctggaacagagtagggctgtcgtcgaacgggtctccttcccctgtgttctctcattctgctatagagtccttctgacgctccattctctgtccctatagataagatctgaggcctccatac

SEQ ID NO: 573894 - DNA, 126 bp, Homo sapiens
gcccctgattatgggcataattgtgaagtgacaaaggcccttcaaacaagagatgcagtctgctggatcacagagaggtcgtggagtgtggatctggcaatttcatggtgccatctgggactgggg

SEQ ID NO: 573895 - DNA, 353 bp, Homo sapiens
  misc_feature (353)..(353): n is a, c, g, or t
tcagcctcggccccattcatgatcttggaagcaagtagtgatttctcaaactgtgatgccacccatttttacaccaaatatcagtgtttctgggactatcatgcccctggtgggtgtgtgatttagaatgctaatgagcgttggcagaccaccgtagctcctgctgtaatcctcacactttgggaagctgaggcaggaggattgcctcaggccaggagttcaagaacaacctggccaacatagggaaaccccgtctctcaaatcctaggagcctaggtcgaatcgcaccatgttgggtccagttggtcttaggtcgcttgacctacaccctggattttcagggtcttatcgtn

SEQ ID NO: 573896 - DNA, 275 bp, Homo sapiens
ccaaatgaaaaaaaaatttgcctctcctaaaataagaacatgaagacccttcattgctcgacaggagggcaccagtgtgtcaaccctaccctacaatctaggtagttaccttaaataccaatagcaaatctgagcatatatgagaggcgtgattctgacagccaagtagaaatactgtggggaaccatacatgtacacccactggatgccctgaaaaaatgccaataatttgagcgcacccacttctgctagctgtctcttccacatcctcacat

SEQ ID NO: 573897 - DNA, 947 bp, Homo sapiens
  misc_feature (22)..(22): n is a, c, g, or t
  misc_feature (33)..(33): n is a, c, g, or t
  misc_feature (65)..(65): n is a, c, g, or t
  misc_feature (317)..(317): n is a, c, g, or t
taaaaaaaaaactttgggcccnaatcaatcgtncaacaaaaaagcaagggaatgaagctttgaantttcctctgtggggttttcctttttctggtctctgtgcaaaccctgcccctccctcgggtgctgctggcctcaaaggaaggaactccgtggggggagggtgtgaatttgcaaaacctgggtctctgctctgctctgggggtgggaaattgcagtttgaacgaactccttccctctcacccctcctctcccggcctcgcccaggagtcttggctgttggcagctcagaggtgggggaggcctgtggtgttganggccctgcacctgctcctgctcctgtcaccccttcctgctgcctcctccatgcccaaggaacacccatggtgcagtcctcaggcaaggccaggacggggctgaggccctgcgtggagatgctgcaccagcggaaggctgagacccgcttaccttagttcatctgttcactcgtaataaaaagaattctctcaaaaaaaaaaaaaaaaacaaaacacaaaaaaaatttttgtggggcgcgccttgggcccctggaaaaaatttttttaaacccctttgggtttgggggcggccgcggcccccagtgggttatgggtgaacccgttggcccccaagctgtttcccccagagagaaaaccccgcggcccgtgcacgagcgcttgggttttcctcccccatttaaaaaagggccggggcgcgacagccaaggggttttggacacaatcccggtgcgaggttcgggaggccataagggcgttctacccccgcgggagtccaaacaggaacctggaatatcaaaattaagcccccgcccgctggattattagcgaatggaccaccagtagctcctcgtcgacatacaccacacgatcacccacaccagcactctgtatggcgcaccaccgctctac

SEQ ID NO: 573898 - DNA, 235 bp, Homo sapiens
  misc_feature (12)..(12): n is a, c, g, or t
atcacccacatnagaaatacccatgaaataatagcatattttacccagacatctgagtctgctttcaagagatttttatactttggggtctatctattatttgattgactgagtaatattcaagttgttttaactccaaatcattcattcattcatttattcacttgcttagaaaaacatccactggttgcttaatttgtgtccagtactagttggtagctagaaaaaaaaaaaa

SEQ ID NO: 573899 - DNA, 743 bp, Homo sapiens
  misc_feature (58)..(58): n is a, c, g, or t
  misc_feature (84)..(84): n is a, c, g, or t
  misc_feature (94)..(94): n is a, c, g, or t
  misc_feature (96)..(96): n is a, c, g, or t
  misc_feature (99)..(99): n is a, c, g, or t
  misc_feature (130)..(130): n is a, c, g, or t
  misc_feature (146)..(147): n is a, c, g, or t
  misc_feature (174)..(174): n is a, c, g, or t
  misc_feature (180)..(182): n is a, c, g, or t
  misc_feature (193)..(193): n is a, c, g, or t
  misc_feature (199)..(199): n is a, c, g, or t
  misc_feature (207)..(207): n is a, c, g, or t
  misc_feature (215)..(215): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (236)..(236): n is a, c, g, or t
  misc_feature (239)..(239): n is a, c, g, or t
  misc_feature (250)..(250): n is a, c, g, or t
  misc_feature (289)..(289): n is a, c, g, or t
  misc_feature (307)..(307): n is a, c, g, or t
  misc_feature (314)..(314): n is a, c, g, or t
  misc_feature (317)..(317): n is a, c, g, or t
  misc_feature (328)..(328): n is a, c, g, or t
  misc_feature (334)..(334): n is a, c, g, or t
  misc_feature (407)..(407): n is a, c, g, or t
  misc_feature (410)..(410): n is a, c, g, or t
  misc_feature (418)..(418): n is a, c, g, or t
  misc_feature (426)..(426): n is a, c, g, or t
  misc_feature (434)..(434): n is a, c, g, or t
  misc_feature (437)..(437): n is a, c, g, or t
  misc_feature (445)..(445): n is a, c, g, or t
  misc_feature (448)..(448): n is a, c, g, or t
  misc_feature (459)..(460): n is a, c, g, or t
  misc_feature (483)..(483): n is a, c, g, or t
  misc_feature (488)..(488): n is a, c, g, or t
  misc_feature (524)..(524): n is a, c, g, or t
  misc_feature (530)..(530): n is a, c, g, or t
  misc_feature (595)..(595): n is a, c, g, or t
  misc_feature (603)..(603): n is a, c, g, or t
  misc_feature (616)..(616): n is a, c, g, or t
  misc_feature (694)..(694): n is a, c, g, or t
aggtaaaagtccttactgaatatcatataaacatcaggtgttaccaggcttgatttcnggaaatgtcactggtttgtgataganattacctatnanacnatgtggtataaatgaatatctgaattttacnattatgtggctacagnntgcccattactcttcataggtattacntctttnnngttcatttccnttcacncatttttnctgctgangcctcgttcnccttanagncnccngctgccttgcncccagccatcgttctcttgacagcgttgtctgaccagcnctgagagacagacaccgngccaccncgngccgctggtgnagatcntcagcagtgatgctctgagggtcgttcttcccgcatttccacaaagtcatcttcaactgccttggttatttcntcngatatgcnatattccnagaactcncanaagcagtnagntaaatgcgcgnntttgttcagcacggaaggcagcnccgcngagagaaggctgttcatgtactcctccatgtttggnggaatnagccggggctgtaagtgaatctggcagtctgccgggaggagtgacctcccctccgcaagtcatgncaacgttnatattgcaggggnattccatctgatggtagctgaagtcataatccaccttctgccacgttatgaggttgctcagggctgtcacattatganacctggggtatcagctgcccctgttccaggagagtctcatcgattacaa

SEQ ID NO: 573900 - DNA, 370 bp, Homo sapiens
aaaaaaaggggcccagggggggggggggggggttgcaagggggaaaaaatttttttttcccccggggggggcgggaaaaaaattgggttttttccccggggcccggggggggggggaccccaaaaatttggggggggaccccaaaaaaatcctttttttttgggggccccaacccccttgggggggggggggccgggggggggtttcccccgggggaaaaatgaacccccggggttttggggtttttgggggggggggggggggggtgggttcccctttcccgggggcccgggtttccccggggtttttcccttggggcccccccggggtattttgggggggtttttttcccttctaaaaaattttttta

SEQ ID NO: 573901 - DNA, 758 bp, Homo sapiens
ctgtcgcccaggctggagtgcagtggcgcgatctcggctcactgcaagctccgcctccccggtactcagtatttcttaaatgaatcctttcttcatcatactgctgctaccactggtaccctaagtctaataatcacgtctggttcattgcagtaacttattttctctatttccacccttgtcactgtgcaaataaactatcttctacattgttaccaaatgatctttaaaaatcatctaatgatcataatcttttcttgcttaaaatcttactgatttttcaccattcttaaggccaaagtctaaaattcttactgttgtctacaaggcccttcatcatctggccccacctacttctttaatatcatatcttactcccccccactcgtcaacagagaacttttttttgatatctaagatttttagcattaaaattataggatgtagtagaaatgaaagtttaaaaatattgcttgtaaaattattcttcattttaatgtatattcataattagctcactttatgcatatgtgtcaaatgagatagtttttgttagtgtttatgaactgtaaaacattaatgtaaaatattgtttctctttactttttgtttctatcttgccttttgctttcatctacttgataaaagatactgctgctaccactggtaccctaagtctaataatcacgtctggttcattgcagtaacttattttctctatttccacccttgtcactgtgcaaataaactatcttcta

SEQ ID NO: 573902 - DNA, 117 bp, Homo sapiens
gagggcagaccacaaggtcaggagacccagaccatccttgctaacacagttaaacctcctctctacttaaaatacaaaaaaaaaattaacctggcatggtggtgggcactgtagttc

SEQ ID NO: 573903 - DNA, 743 bp, Homo sapiens
ggccaaacattcagactgtgagtatgctcttggaataccttaagaagttacaattagccgggcatggtggccgtgcctgtagtcccagctacttgagaggctgaggcaggagaatcacttcaacccaggaggtggaggttacaggtgagcagagatcgtggcaactgatctcaagcctggggtgacaaggagagattgtgtctccaaaaaaaagtgttacacctaggggtgtgaaattgggcaacaaggggatgtgaaaacatatatagtagaaagaggctggaattaacttcccagggtgtggcgtaataacaacaacgggggggtataaaagagggggatatgcggttgggtagatttggattcgaaaaacgaatttccttaaggtctaacacgcttacaaaaaagatacattgtactctttttccccacaaagttttatgtgttgctatgggcacagggttgtggtctattacgattttagagttatttgccttttgggggatattctattaaaacaggggttaaatattgttccaaacgaggtggaaaaatttacaggatgtgtacgtggtatggaagggattaccaatgtgcgggagattctggttaaattgagcctctggtaaattggctggtatttgggttccaaaggggtttaacttataggaagtggtaatttaattaaaattatttatagtttgattacaatttgtaactaataggagtgaactagggtaaaa

SEQ ID NO: 573904 - DNA, 718 bp, Homo sapiens
  misc_feature (5)..(5): n is a, c, g, or t
  misc_feature (61)..(61): n is a, c, g, or t
  misc_feature (69)..(70): n is a, c, g, or t
  misc_feature (87)..(87): n is a, c, g, or t
  misc_feature (96)..(96): n is a, c, g, or t
  misc_feature (122)..(122): n is a, c, g, or t
  misc_feature (129)..(129): n is a, c, g, or t
  misc_feature (150)..(150): n is a, c, g, or t
  misc_feature (170)..(170): n is a, c, g, or t
  misc_feature (195)..(195): n is a, c, g, or t
  misc_feature (233)..(233): n is a, c, g, or t
  misc_feature (248)..(248): n is a, c, g, or t
  misc_feature (253)..(254): n is a, c, g, or t
  misc_feature (258)..(258): n is a, c, g, or t
  misc_feature (267)..(267): n is a, c, g, or t
  misc_feature (279)..(280): n is a, c, g, or t
  misc_feature (307)..(307): n is a, c, g, or t
  misc_feature (348)..(348): n is a, c, g, or t
  misc_feature (350)..(350): n is a, c, g, or t
  misc_feature (358)..(358): n is a, c, g, or t
  misc_feature (363)..(365): n is a, c, g, or t
  misc_feature (377)..(377): n is a, c, g, or t
  misc_feature (391)..(391): n is a, c, g, or t
  misc_feature (395)..(395): n is a, c, g, or t
  misc_feature (405)..(405): n is a, c, g, or t
  misc_feature (417)..(417): n is a, c, g, or t
  misc_feature (465)..(465): n is a, c, g, or t
  misc_feature (507)..(507): n is a, c, g, or t
  misc_feature (534)..(534): n is a, c, g, or t
  misc_feature (568)..(568): n is a, c, g, or t
  misc_feature (599)..(599): n is a, c, g, or t
  misc_feature (606)..(606): n is a, c, g, or t
  misc_feature (617)..(617): n is a, c, g, or t
  misc_feature (649)..(649): n is a, c, g, or t
  misc_feature (664)..(664): n is a, c, g, or t
tcaanccttccttccgcctcggcctcccaaacgtgctgagattacaggcctgagctgctgnatggctannattttgttaaaggccgncacagaggngaagtcaactgctagaaatcacaggnttttaanaggtggagtcacatttgaacncgtggcctctgatgccaganctgcaggtcacatgttcaccatggnccaggtgaccctgactgcgggccccacctcttctgtgnggcacagggcaggantccanntgangcgcgaggngcctgggacganncctttggtctcttctggggttgcggcnaaaacctgggggtcccgggtgtgaagaagggggtctgcgcncncagcgggnaggcnnnaggcgctgcganaggacgccgaggangcgntggaacttcncaaagcgttcancgcagcggagtcccgcgccgcgcggctacccacaagacgcagcctccngcacgagagccgcgtgggtcaggggcctcccctcagctccgnggttagggccgggaatcctcggcaggngctggcgctgccaccttggcggaaatttggggtncgtcccgggaccatggtgacgcgccccgtgnagggtgngcaacagccgntcacagctctcgtccagcggccccgcgacttnctcgccctccaatangcgaaccatgggtgccacgtgcggcacgccacctcgccggggtcgcagggtcca

SEQ ID NO: 573905 - DNA, 204 bp, Homo sapiens
tgaataataaccttctaaaatagaaagcactaggcccatatgggttcactggtgaattctactgaatatttaatggaaaaaataataccaattctctaaaattgctcccagaaaatagaaagcagcagacggaattttttttttttttttttttttaaagacagagttttgttttgtggcccaggcgggagtgcagcgggtgat

SEQ ID NO: 573906 - DNA, 1122 bp, Homo sapiens
  misc_feature (74)..(74): n is a, c, g, or t
  misc_feature (247)..(247): n is a, c, g, or t
tggaaaaagtcatggaggccagggggttggtttgaaaccagcttggggggggtttcgatttctccttctccttnttttgtgtctagaattttattgttatatccgggttcttctctcgaaatgtgtgtggtggctaggggtggggggggcatctccattattagtctccacctccgaggttttagtggagggtttctctctactatttaggaattttctcgccttctcggaaagcgcgaaagggctnttctctcaaatctcatttgaaacattctattataatatattatacgtgcgcgtgttatagaagaaaatgtgtacatgtgagccctatacgagaattgtatatgaggagtggtttctcagtgtgtgcggtgttatgtgccatctcgcgggatatagtctcgcgagagtataacgcgtctcggaggcacatatctcgcggaaatataggccgcgagagaaagagtggtgttgtgtgtggcgaaaagaacagagttttttagaattcttttagcgccgccgcatgataaacatatatctgatatcatagtgctgcacacatgtgggcatttgtgtggggcggtatagcgtcttgtggtctctatagggcgtgtgttaacgcctgtgtagacacatcatagggggagacaaatctcacgtgtagcacatggggtaagacgccctctcctttatgtgcaatgtgggccaaaattataacacggctctcccatatgtgtagatttgagagccacacattttatggtggtgggacaaaagtgtgggcggacattacacaacaagcgttgtaaggattagcggtgtggtctcgagttggtgtacgcataagccgaggagtgttctctataagggtgggacattgaaagtttttggggcctaaatttacccaaatgtcgtcccccagggtcttcagggggccgcccaacgccattaagcggggtgtaggaacacaaaatagcacaagacggtatttgaaaatttcccctataagggggggcgccttccaaaagaaagccccacctgttggcacaagccgacacatctcaaattttctacaacataatgttgaggcccttctccccggtgttgagaactgtgttg

SEQ ID NO: 573907 - DNA, 819 bp, Homo sapiens
  misc_feature (549)..(549): n is a, c, g, or t
ggaagctggaggcacaggagatgccctcccagtctcttcactctgggggcctcggagcacagaccactcaagaccccctactttgatgctggcgcctcatgcactgagcaggaaatgcctcgtatacctatgagctgcccaccgttggaagaacggtcaggacccttgtcaccctggagccacatagcctggggtccccctatcccggtgcctccagggcccacgctgctgtgtgaagacgtttccctgtgatctagaggatgaggagggggaggaggaggaagagtatctggtactgagaatcaatcgcctagtctatgtatgctcctgtcacttagtagcgagtcccgctcttgattcctacacagaggctaaaggcattattgggtcagggtcctcgtggccagtgtatgtgtgagctgcattgctgcctggtggtcgtcacatctgacctgtggatcccttaggtttcttgccaaggatctagtgccccctgagctctggaccaggtcactgtccgagttaaacgaagattatgcattcccattntgtgcatgtgcgtaccttgtgtaggactccctagcatatgaacgccccctaatcgcatgagccctaggagaacattcacgcgtgactaatggaatcctggtgatcttatctcatgaggcaggaggtgggggaccggtggttcggcacaaacctctggatgtcaaagactcctctccccatactgtgatcttataccatatctctcaacggcacaatgtgctctactcccccacatgtcggggtgtacgacctttatctatgatttggtcg

SEQ ID NO: 573908 - DNA, 146 bp, Homo sapiens
cctgatcttacgtgcccttttttactgtacggaaaagccccaactggcctcctgggggatgagggctgaaatgatcccgaaggccttttaatctagtgtgaaatccggcgtgtactcacgaaatccgttccccgcaatttacagca

SEQ ID NO: 573909 - DNA, 846 bp, Homo sapiens
cagcgggcggttgaggccttcggtggtgaacgcagtctccagcacatgtctggttgtctggccacagccggcgcggccttttccgttagcgttgctgctttgttcctgcctcgcgccccagcattggtccttgcccatctccttccgtcctgccccattcaactctcgcccagtgcctccgtcgcaggcagcattcaccacaggcacctgctcagtgcacttggcgcgtacgcagcatctccgacccagtctgggggcgctggacggcctgcgcagccacctccaagcatccaccagcattctcgctggcccatcattctctcactccaaacagcaggcatgccaaccaaggggcaccatttgccctttaccgactgcacagcattcatgcaccatgtttgcaagtgtgttttgcagcagcccacgggcacccagggcggcataccgtgaccaactctgtgcatcccttcagcaccatgcacagccatggcagtggcaggccgcaacacacattaccgcaagcagcattgcccaccagttcgcagcaagctcgaacaccattcagcaggtcagcagcttgcgcacgcctcagcaaggcacctttccagcacatctcatcgttcaatcgcattcttgcctcacattgcccgcacgccgcagccagacggccgcatgcgtgactaccccacacgacgttcaaccacaacacctcggggtcctcatactttcagcatccttttcacctgttcctggtctccatttggcacttatgctacctggcaggtctttctaccctgtgacagcttctttccaaggcccacgcacattgattgcagttatgcctcg

SEQ ID NO: 573910 - DNA, 871 bp, Homo sapiens
cctcccatttttgggcgcccccctccccccatggcgaaaaaattgtttccgcccccgggttttcctttcctggccgaaaggtggggagaagtatcaactggtttccctttcattgagggggccccttttatggatgtcctcacaggggggtctagctttcttcgttcaactgttgacccgccgtgaagtttgccctcccccttgtgaagagagcgtggctcttgactccctccctctcctggtgtcatgcacgcccttgggggcctttcaatgtttgttgactgccagcaccagttccttctcagaaccgccaccggtctcgcttaacttgccctccatacccgctcccttgttgaaatttcttgggttgtgggcggaacctcctgtggagcacgaggatacacccccatcttctcgtgcgcgcaggtaccattggttttagaacgttcttacccgcgtcctaaagcccggcacttcttagttccctccatttggactccccaatgactgttgtcccacggggaccagtttcccttaggggtgaccgcgcccatcctatttttggagggcatctacatcgaacccttgagggtttcgcacctccggatgagtggatcagggacatccccgatggtgccacccggctatttatgagtttgtttgtgtgcaacgcggataaagatcctaccgggatctggggttccaggaccgcgggttatcgagcgtcgggtttttttttcttccaattctctccccttccaaagagccaaaagaaaataagggccttttttcccaaggcccttccccccttaatgaaattttttccactttgttttaaacccccaccccccccaaaacaggggttttttta

SEQ ID NO: 573911 - DNA, 128 bp, Homo sapiens
ggatatatcacactggtacatagtcctcatcagacgtaggttttatctgaggggacaggtctcattctgccacccaggcgggggggcaatgatatcatcacggctcacggcagccttgacctcttgga

SEQ ID NO: 573912 - DNA, 816 bp, Homo sapiens
tcgcaacaatttttcgagattttccacgttcacctcgttgtcccctaaatattactctgcattttcccgcaaaccaatgtcctagaaacaaccctaatactgtgaaacattttcttttaacaccccaaacctaggtgggcgccttctcttatcacaagagcccacttcgttttcgctcctcccaccacccggtcttaaagacagcactttgttacacaaatttctccactcatattcttcctatcattgtcactttcctccccgactaatagacccgcgatcttcatcaacaacttgttgaccagttctctcacccccttgagaccacttgtggcacaaatcttcccacaggatgcctccgcgatttttccatccacccgccaggtgtctttcgaccatccatcagtcctataagaattgtttagcaaaacaggcgcacgtaacaagttagtatcttcggttaatacgtgaaacaggctggaggtctcccccagacgactgcaatgccctgcgtgaacaatacatatactccgactcaatccactcgccggtgagtatggttgtcttttatcgttgcatagaatggcttgcggtgcacgggtgacatatccaccaccaccatgagcccactctttaaccttttcttaaacagtaggttgagtctttttcttcttttaaaacaccaccgcgaccctcacaaacacacttcttgagaagagaaactgtctttcaagaaaaacatatttctccgcataaagtatctttataaaaaatcataaattagagcaaaattctttcgcaccaatatacagaaca

SEQ ID NO: 573913 - DNA, 203 bp, Homo sapiens
atccccaagagcacatgccaaactgctgcccgaagcacatctaacggtggaatcacacatatgcccctccatggaactcatacacataacatgaaagacacctgctggctgcaaggtcacaagacagctgcaggctacaagtccaatactgctcagaacctacactgggggagagaggggtagacaggtgtaggtagagctct

SEQ ID NO: 573914 - DNA, 1034 bp, Homo sapiens
  misc_feature (1034)..(1034): n is a, c, g, or t
aaagaaatccccgtgactgtctataacgccaattattaaaaaatacaccaaaatcacttgactggacgtgcctgtggaaataacctgaacaaacgagaccacgagaagaaccgaatcacttaccaggtcctgacaacttaaaactaccacctacggactttctacctggacggctggacgaaaacacgaacgacacactctgacagacaactggttaccaacgacccgacggtacaccaacgggtacaccacaactttcagttgacacgcgatggctgaactgggtcactatctacttcatgacacgacttgaccggaccaacttttaacaacggaccttggctttcagcgggctccgtacacaaccaatcccccgagtgtaagcggaacaagtatgtggccgaaggacacaaaaaaacaaatacacaaggttctccaaagggggcatcatataagcaaccggacaccggacctgtccaccgggggaaacaggagatccggttttccgttccgaggggtggccactaaaacagttcccccaaatgacgacaagcgccgagggcacactaccagcacgacacttgggttttagtacatttaactaaaaaaagccacgattaaaacggctttcaacaatttaacgcggccttggaaaccccccgttttgtagggcaaaacacagacatgtgggattgggaacgggacagggcctcccataaaaggcggatgatggggaacaccgtttttccaacagggggggcacaacacccgctttagggtctacaaatgcacgcgcaacgtttttctcccatggagccgcaagcgccctagaatgtagggccgataaaacggcaccacacatacatgttccgccaagttttccaaccgaagaacgatattaccaatcttcattcccgcttgagggcacgacactgcctaagtgcgtaaatagatgctatctgattaaaagacaccgttactgttcactcgtaccaacacatcactgacgatgaccaccgatttaggaccaaaan

SEQ ID NO: 573915 - DNA, 718 bp, Homo sapiens
  misc_feature (115)..(115): n is a, c, g, or t
  misc_feature (119)..(119): n is a, c, g, or t
  misc_feature (121)..(121): n is a, c, g, or t
  misc_feature (132)..(132): n is a, c, g, or t
  misc_feature (182)..(182): n is a, c, g, or t
  misc_feature (184)..(184): n is a, c, g, or t
  misc_feature (199)..(200): n is a, c, g, or t
  misc_feature (211)..(211): n is a, c, g, or t
  misc_feature (239)..(239): n is a, c, g, or t
  misc_feature (372)..(373): n is a, c, g, or t
  misc_feature (697)..(697): n is a, c, g, or t
ccttagaaaggaaaaagcatctacccatcaatcttccttccccagggaaaaaaattacccacgtacttaatgagcctttaaccaaaggctttccaattattggacagattcactnttcntnccaaggccttnctggaccattgtcaaggcttggccttagccaccagaattagagggtcaangngggtcaagagtacgnnaaggtcagcangggaccctcaatactgattcttctctgnctgaagtagggcagaaagcagacatagctcaaatactgagcagccaaaaaaagaagaagatggcgagaaccagaaagagggaatcctgccagctgaaggctgggtgaccctgtcccagatccacacctgtacnncggcggaaaggctcatgggcattgaagacggtggtgaaaaagccaaagggaaaagcaccaacaccaaatgagaagtggaagcccccggtatcaccaaatggctggaataatctgggatcctggggcttctggctccctcgcccataaagcgggacaaccttctctctgctgatcccagctttacatactggacactcttgccgttctggccgtgtctccagccactgatgaagacatggccaacagtacaggtggccacacacactgaccacagcttcccgagcagtctccaaacatatattacattcgaaggtcgcgcccgcnccgcaccgctcgcgatttggc

SEQ ID NO: 573916 - DNA, 832 bp, Homo sapiens
  misc_feature (22)..(22): n is a, c, g, or t
  misc_feature (63)..(63): n is a, c, g, or t
  misc_feature (138)..(138): n is a, c, g, or t
  misc_feature (194)..(194): n is a, c, g, or t
  misc_feature (198)..(198): n is a, c, g, or t
  misc_feature (244)..(244): n is a, c, g, or t
  misc_feature (264)..(264): n is a, c, g, or t
  misc_feature (266)..(266): n is a, c, g, or t
  misc_feature (268)..(269): n is a, c, g, or t
  misc_feature (271)..(271): n is a, c, g, or t
  misc_feature (274)..(275): n is a, c, g, or t
  misc_feature (279)..(280): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (294)..(294): n is a, c, g, or t
  misc_feature (298)..(298): n is a, c, g, or t
  misc_feature (327)..(327): n is a, c, g, or t
  misc_feature (339)..(339): n is a, c, g, or t
  misc_feature (353)..(353): n is a, c, g, or t
  misc_feature (358)..(358): n is a, c, g, or t
  misc_feature (361)..(361): n is a, c, g, or t
  misc_feature (367)..(367): n is a, c, g, or t
  misc_feature (387)..(387): n is a, c, g, or t
  misc_feature (400)..(400): n is a, c, g, or t
  misc_feature (411)..(411): n is a, c, g, or t
  misc_feature (420)..(420): n is a, c, g, or t
  misc_feature (430)..(430): n is a, c, g, or t
  misc_feature (479)..(479): n is a, c, g, or t
  misc_feature (483)..(483): n is a, c, g, or t
  misc_feature (490)..(490): n is a, c, g, or t
  misc_feature (532)..(532): n is a, c, g, or t
  misc_feature (543)..(543): n is a, c, g, or t
  misc_feature (573)..(573): n is a, c, g, or t
  misc_feature (596)..(596): n is a, c, g, or t
  misc_feature (628)..(628): n is a, c, g, or t
  misc_feature (645)..(646): n is a, c, g, or t
  misc_feature (660)..(660): n is a, c, g, or t
  misc_feature (663)..(663): n is a, c, g, or t
  misc_feature (687)..(687): n is a, c, g, or t
  misc_feature (689)..(689): n is a, c, g, or t
  misc_feature (714)..(714): n is a, c, g, or t
  misc_feature (717)..(717): n is a, c, g, or t
  misc_feature (723)..(723): n is a, c, g, or t
  misc_feature (760)..(760): n is a, c, g, or t
  misc_feature (806)..(806): n is a, c, g, or t
tggtagtgtagtggcattgatntgcgagccatcactggcaacgctctgcctcccgcgcgattnaaactgtattctacctgtcctcagcactctgcagagattagccatgtgagtactacgaggacatgttggccatanacacccaggctaattgttgtggcactttcagtaggagatggggtttcacgtatgtngtgncactatggtcttgatctcttgatctcgtgatctacccaccttgggntcccaaaatgttgggattanangnntnaannactnnancangnaaantgngatnttttagtggtgcctcttctctcttttganttaaggatgttnttccttaaggaaanctggnggntactantgtgatacactacttgaganatggattgttgcnctttcttctanagtctttanaaggagtagnttataaagacagaagatgtgaaccattgcattaatgtttggaagctganagtnttctagntttctgctagcaaactgatatgaggtagagtcctgaaagatntttcagcaatntcattttcttgggataagtgagtgactttnagaacatgtgtgtgttgtatganttttttgtgtgtgtggctgctctactcagatntgcatagaggttttttnngtgttccgtgttcngtntgtttgtgttggtcagattttttnanacatcttcatagtgtatcatcctgnaanctgaanagtcactttgaggttattgctttttctttccaggtcngttagccaactaaaaaggccccgaaaaaactggcttcatggtccangtctatcaagtgctcatttgttacag

SEQ ID NO: 573917 - DNA, 389 bp, Homo sapiens
atgctgcgagcaatccgtcagacgagaaagggcgccgagattctggagggctgggaattctctggcgaagaggcggcagatgggcaggatggaggatatgtcacatggctcggacgccggcacgcgcgacgagtgctacgggaggtggcaagcaacggcttcgctcttctcgtcgggttcatctcacagcagcaccgggagatggcaggggcagacaacacgagtgagacagaagggcaggcggcagacactggggatgaagtgacaatcacgccggcgccggcaccggaggcattatggaagggctcgtcgagcgggcaagggcaaggaggcaaccgcgatatgcgctctctccagacggatgaaataatgccgcggttgggaacgcc

SEQ ID NO: 573918 - DNA, 216 bp, Homo sapiens
  misc_feature (18)..(18): n is a, c, g, or t
atcacaccactgcacacnctgcctgggcacaaagcgcaaccctgtcaaaaaaaaaaaaaaaaatctccaaagaggaaaattgtttattggattacctactaaaatttctctttagaaattttataagaaaagctgtagcgagaattgatctattggtagtccttgggatattttactccagaatgtggctctcacccgcaatttgaaattggggat

SEQ ID NO: 573919 - DNA, 155 bp, Homo sapiens
  misc_feature (103)..(103): n is a, c, g, or t
  misc_feature (151)..(151): n is a, c, g, or t
ggtgcctgctcatcagacacctgatcttgcaagaccatcattaaaagtctcactttcgctgttctacagaaaaataatccctaatctgggggtttggacaggngactttgtttctcacaagactagttctcactctgttgcccctgctggngtgc

SEQ ID NO: 573920 - DNA, 113 bp, Homo sapiens
cactcaaagcacacagcatgtccctgtgcccatcactccttggagcatggtaacagggcttctccaacctcgcatcttgcagccgtctgcgatgatcacatccttcaggggtt

SEQ ID NO: 573921 - DNA, 101 bp, Homo sapiens
tgtagcgatctagaggatcccttccggtttgtgcatctgcgtgtgctttgaaaatcaacgacaacttgcgcacagtgagcatgtttttgaacacattaaca

SEQ ID NO: 573922 - DNA, 162 bp, Homo sapiens
ctttctattagctctgagtgagattacacatgcgatgcatccccattccagtgagtcgaccctttgaatcaccacgatcaagagggacaagcatcaagtcacgacagcaattcagcttcagaacggttaagcctagccacacccccacggggtacagcagtt

SEQ ID NO: 573923 - DNA, 409 bp, Homo sapiens
  misc_feature (18)..(18): n is a, c, g, or t
  misc_feature (74)..(74): n is a, c, g, or t
  misc_feature (148)..(148): n is a, c, g, or t
  misc_feature (168)..(168): n is a, c, g, or t
  misc_feature (217)..(217): n is a, c, g, or t
  misc_feature (224)..(225): n is a, c, g, or t
  misc_feature (315)..(315): n is a, c, g, or t
  misc_feature (351)..(351): n is a, c, g, or t
gaatctcgctgcggatcnacggatcgtccctggaaaagccggaagaaacacacgtcgagccgcttctccttcancgcgtcgatctgtgcggccggcgtcatctcgtgcagcgaccagtgcacgtgcggatggcgttcggcgaaacagncaacgcgtgcgggatcggcncgaccatcgccgaactgatgatgccgaacgccaggcgccccacttcgcncggcccnncaacgcgtgagatcgatcgcgcgatcgaactgcgcgacgatcagtggcacctgctccttcagtgttttccctgcctcggtcagttcgacncgatgctgcgagcgcacgaacagcgcggtgccgaantgctcctcgagcagccggaatttcctggctcagcggcggctgcgagatatggagccgc

SEQ ID NO: 573924 - DNA, 772 bp, Homo sapiens
  misc_feature (16)..(16): n is a, c, g, or t
ttctgggacactgagnaggggagtctccgtcttcacattgtgcacagatctgaggatgggattagcgaatttgtggagactgcacacccggacctgcccatgtctcaaaacaaacacatgtacagtggctctttttccttctcaaacactttaccccagaagcaggtggactgcacccaggcatgaagaaggaatattggccatctttgccacctataaattctgtaaaattatagacttgctcaaaagattccttttgatcatccccaccctgtgtaactggaaagggcattgcgatccacgtgtgtccaacaaacaaatgtatctgacgcctagcgagtcattctcacactccccctgggtgaggagcgcccgcccccgaccccgacgcccccggcctgccatcgccgaccgaacctgggagcagttactggtccctccgaccgcccccggcattaccactaccatcaccccccgacctaccctgctcccacttgacttgtcaatgtggatggtattctccgattcaaacgcatgatttccatcgcccggcgcaaaggcgagtaataaataagcaataaaccgtctgatcccgagacccccgccagagccctcatgctaccaagctaggaggacgacccccaagggcaacgactctcccgtcacccccaccacccgattaggaactacctggccctgttcctacttatacctagggagtcattaattagagaggcgctcgctacgctttataaataacgtaaggcataat

SEQ ID NO: 573925 - DNA, 739 bp, Homo sapiens
tatgcagtcgccagaccgagccacatcgcatcagacaccatggggaaggtgaaggtcggagtcaacggattatggtacgtattggagcgcctggtcaccagggactgcatttataactactggtaaagatggatattagttgccatcaatagaccccttacattgaccatcaacatacagtggatatatacatgtaccacatatagattccacaccataggcaaattaccagtggacacacgtacaagagctgcagaacgaggaagcattgatacatacaataggcaaataccacatacacctatcttaccagagcagcgagaatcccataccacaaatacaagctggcggcagactagcatggcgactagagatacagtacgtagagagatacacactaggacgatcttacacacacacataggagaacggcatggggcatcatatagacagggagagagagaccaaacaaggagtacatacatcatctgacccccatctagcaagatagacaccacacatagtaacgtacataggagtagtagaaacacatgaagacagtcatagacaaacagacctacaagatacatcaagaaaatgccatcctgacaccaacacaaactagcttaagcaacccactgtgcacaaggtacatcacatgaacaaactatatgagaatcagaaggaaagagactcaatgaccaccggtcacatgccaatcactgaccaaccagaaaga

SEQ ID NO: 573926 - DNA, 243 bp, Homo sapiens
ttggcatagcactgaatgagctggtctcttccagatccacaccatgctcacatgtagacccgtggaagtatgtttctggctgactcagtgcctctcgtggtaccagccatccctgccctgttccttccccgggtgtcgccagagctggagcccctgctccttcactttgcagcctcctcttctgtcaccaactgggaacccacctcttcctgaaagttctcccccactgactcaccggcttgc

SEQ ID NO: 573927 - DNA, 550 bp, Homo sapiens
  misc_feature (526)..(526): n is a, c, g, or t
ccctcacgggttacctccaaaaaaaaaagaaaaagaaaccttactaaaaacttcccaaggacccaaggacccattttcctctctatctgcctaaaataatttcttaataactcctacaacattcccccctgtggagatgccacactaactgctgttagggagttttgggcgacgactccttctggctacttcttgttgcaaaagggcgtcgaatggggaagagcagctagggctcctcctggggtcaatctaagggtcctcagaagaatgatgtgtctatgtgtggttctgtttacagcaccatttggagtttgattgcttctagatgagaagaaacaatttgagttatagtattgtgtatacagggtccaaatatcaatacaagacacataagcaagagagggcttaataaaggggttaaccaattccataaagaagactggaatttattaaagaggcattgtagccactcggggatcaataattttgatttgatttttaagtacttgtagattttctttaactngaggcattaatccgaaagcagcat

SEQ ID NO: 573928 - DNA, 102 bp, Homo sapiens
ccctgtacctggggaggctgaggagggaggctgatggttgcagtgagccgcgactcgcgccactgcattccagcccgggaggcaagagcacaactccatctc

SEQ ID NO: 573929 - DNA, 487 bp, Homo sapiens
cgaattcgatctcttcatgttatccttgtaggagtaactgtaatgaggttacgagattagtgccatcgccaggcgcatatgtagatttgcattcaagacttgaggaatcaaatcgagcgtgtctattcccatcgatgatatcagaagatatcttctcttatgcaagacagattaaatcccaagactttccacagagtcatgaggacttcattgtggacgcaaatataacatcactctccgccatgagagagtggtctggaagtgaaccaatgtcttcaatggaggattacagtgcgacagcatgagagcatgattcgtctctctgaagctatggctcggatgcactgctgtgatgaggtccaagctaaacatgtgaaggaagctttccggttactgaataaatcaatcatccgtgtggaaacacctgatgtcaatctagatcaagaggaagagatccagatggaggtagatgagggtgctggtggca

SEQ ID NO: 573930 - DNA, 275 bp, Homo sapiens
acatgcgtctgatagtaccatcgtggacatgcagccttaatatattctaacgcttccttacctgctggtaaactgccaccggtctcaacacccccatgagggccccctgctgccccagctccctccctggacccctgggaccttcctcatgagcctcgacttgaaaggttaacgtctcaggtcctgcaccagtaacagccagcggcctcaatagccccactgagggtcctctacgtgccaccgaggtccctcccgtgtagccctgctgaacctca

SEQ ID NO: 573931 - DNA, 270 bp, Homo sapiens
gctgttcgtgtgtgcttcacgtgctgtcacggacttgccgtctggcctgtgtggcggcaggtcagctggctgctcgtggtgtacaggtccccggcggctcctggctaggtgggacgtatctggcggtcacgttctgtccgctttcgctccaggtcacgctgagtgactcctgggggaagaaaccctggagcaggcatgcgacgaccacgttcccatcttggggggtgctgtcgaggctcagcgggaagaccttggggctggtcgggtatg

SEQ ID NO: 573932 - DNA, 159 bp, Homo sapiens
cctaaggcctagaggagcaacacaaactctgcctgggctgccagcctgctccctgtggaatctgtcctcaacactgccacatcggctcttgcctgaactcccagcctgccaacctgcactacaaactttgggcttgccagaccacacgctcatgccaga

SEQ ID NO: 573933 - DNA, 198 bp, Homo sapiens
gccaaggggccccagggccccggggctccccccacagcggggtgggccccggggcccgcggctcagtggcccgcttgccacgtcggccaggcccctttgggccccttttttaattttacccgtgctcttccctcttgtgcctaagcctggggtttgggagggtttaacccccgatttgccggggggccaaaaaaaaaa

SEQ ID NO: 573934 - DNA, 655 bp, Homo sapiens
tgagacagagtctcactgttgcccaggctggagtgcagtggtacaatctcggctcactgcaagctctgcttcccaggttcacgccattctcctggctcagcctcccaagtagctgggactacaggcacccgccacaagtgcctggctaatttttggtatttttagtagagacagggtttcaccatgtgcagccaggatggtctcaatctcctgaccttgtgaaccacccgtctcggcctcccaaagtgctgggattacaggtgtgagccaccacgcctggcccatgaaccaagtgtttttaaggaaacaaaactattttttcaatcatcagatttatactagctatatggcctatcagcactatctggctaattagtgaatctagaaattttttaccatatttgataatactgatcagctcagtaatgggatgacgtgaacagataatcatgtcggtttcacatagtgtcaaatatggtaacactccaaattcaacttcaaactcttcacttcatacatggtccataggccacagcttacatatcacattactaaacgggcaaggacaagccttcattcctcctggatcactggcatcgaaagctcattaacgcaatatattcgaaatccatgacaactgcctatgcctcacacg

SEQ ID NO: 573935 - DNA, 390 bp, Homo sapiens
  misc_feature (230)..(233): n is a, c, g, or t
  misc_feature (270)..(270): n is a, c, g, or t
  misc_feature (275)..(275): n is a, c, g, or t
cctgggacagttggtggcactctgtgagactactctcagaccagtcctttccatcatgggctcctgtggaaaatgaccccagctcagctcagtagttgatgggacatctgattcaggttggacccagcccagacatctgattcaaacaatattcttctccaggaattttgtaaccagcactggtagagggagggaagtgctcccccccccccaaaaaaaaaaaggggggnnnnttttttttggggggggggggggggggggaaaaggganaaggnctttgcccaagaaatgtgagacttggaaaccaaaggccgccatgttttctgtctcatgatggaatccaatcttctttggcggggaaaataaatgaagccaacaccagtaggaaaa

SEQ ID NO: 573936 - DNA, 256 bp, Homo sapiens
ataaagccatctgtcctccccgctggtccatatcacgtactcgcttacctcactagaggcaccgctccaacgactgttccctcttccttctgcagcatcagctttaccctctctgatcattcctactctatatagacacacataatgctgcccatcttagaagaaatacattatgtgaattcatcatctctgatctctgtcattccattttcttaaaaaccttattcctagcaggcttttgcccccaccatctccc

SEQ ID NO: 573937 - DNA, 1770 bp, Homo sapiens
  misc_feature (827)..(827): n is a, c, g, or t
  misc_feature (1717)..(1717): n is a, c, g, or t
  misc_feature (1770)..(1770): n is a, c, g, or t
tggaaaaaaagtgtctcactttgtgcccaaaacccgggggggagtgcaggggcccaatctgtgggctctcacgtggaacctctccacctctcccgaggtttccagggaattcttcagtgccctcagccctccgtgagataggcgtgggaactatattgggcatgtgcaccaccagtgccccatataaatttgtggattttttaagataaaacacgaggagtttctccaccgtgtgtgtgtggccgagggcgtggtctctctcgaactcctcgctgtgagacctctcgtgtgaatctcgtgccgcgcccttgtggcctctcccaaagaggtggtgaggaatttcacggggcggtggacgcccactgtgtgtcgcccgagcgagtggtgtgatgttctcttatattatctcgagagggtgtgttatagcgagagaagactctcgcccgtgggctatatattctccgatatcttctgttatacatctcccttaatagcgagggtgtgttgggcccaccgcagcgttattgatgacaagagtgccttataatatacgccgcggtattatctataggagtgagatctctcctactatttatcaacccgacacaaagaccgcgagagaaacaccatttatatctcttctcacccaagagggggtgtctcaccaataacatactgcgtgggataagtgtgggtgtatccaatatatatcttctccacaaaaatctttctacaaatataaaccgagtgtgttcccgaggcgcgtgagtaacaaaagtgtgggtccccgtggggataaactcaccacgcggtgggttattataagncgcaccatttcttcccccgtgtaagttgagtacccctaggagggggacgggggtgtagcaactcaccacacgggaaaacttttcccgagagaaagcattcaccggggcgggggggaaaaaattatacccctttacaaaggggggggggcctcaaattacaacaaattgtcttcgcaaacaacctctgtggcgggttggaagaaaaaacaccccccttttaaagaggtgtgcaacacccagtggactaacaggggtggttataccaaggggcgcaaagaggaggcattcttctaagcgccataaaaagaacggagtgtattaagaccaacaaacaccaacagcgtcgcgtcttttgctagaacaagcactcccaagcgagggggtgtatcatacgcattaatattatggtggttgtcccccccacaatataattgagaaaaagacagcgcaaatcatatgatcgtgtgaaaacccaactttatttttgacgatcagtcacatgcactgacgttcataatataaatcgttgcaggcagaaaacaaagatacgtctcatcgtgtgtgtaccccccggcgggatagaaacaacagacgcggagacaaatctatacacgcagacaaaaaacataccgccccccaacgcagtagtaggaagaaattagttacccacgaccccccccacaatagtgtgtagatatatgagagacccacacaaccactccagaccagtatttgtattgttataaaagagggtacccgtggtgagataggcaggggacctaacataacaatgcgtgagccgccccacgtatgagagaaacatcagcgcggaatccgtacgaaaatgaaaaccaccatcagactgcaatatgatgtcgtgtatatatctngagatcgagtccgcgcgataatagtaaatcataatactaatctaaaatgcgtn

SEQ ID NO: 573938 - DNA, 409 bp, Homo sapiens
ggttctgtgatgagcgtgaaacgagcatgcccatgcacgactctggtccccgccataggtggtctcctaagattgtcatctcctgtccctggcaactgctgtgcgcccattaagatgcacgaggtcccagcacagtctgatgtttactgtgacgtgtgtgatttcctggttaaggcggtcaccagtctgcttgacaaccaggagactgacaaagaaatactccacgcttttgacgcactttgctccaagctgctgaagtccctgtcggacgagttgccaggaggtggtgcacactgtacggcagctctctatcctgtccatcctgctggtggaggtcagccctgagctggtgtgcagcatgctgcacctctgttctggcacgcggttgcctgtactgaccgttctcgtg

SEQ ID NO: 573939 - DNA, 250 bp, Homo sapiens
tgttcaagttattggatcaattgagtatagtagctcgctttgactggtgaagacttagcatgtactgctcggaggttgacctctgctccgaggccgccccatccgaaatttttaatgcaggtttgagagtccaggacctgtgggactgataggtactgttcgcattactctattagagctccatagggtcttctcgtcttgctgttttatgcccgcctattcacgggcaggacaatttcactggttttaa

SEQ ID NO: 573940 - DNA, 155 bp, Homo sapiens
tgcctgctgctctctgctccctaagaggcagaggcagccctggatctaggctggtgatgggggtcggcccctatggtgggagaagctggggcagtttgccaggggttggtctagccacatctagagttctagagaatatgggacatagcgagaag

SEQ ID NO: 573941 - DNA, 1436 bp, Homo sapiens
  misc_feature (430)..(430): n is a, c, g, or t
  misc_feature (1209)..(1209): n is a, c, g, or t
  misc_feature (1218)..(1218): n is a, c, g, or t
tgtgggtgttgtgtgttgtggtagttgtgtctggcttcgttgtctctcgtggtctgtggatgtttcgtgtatgtgtgttcgtggttgtttgtttactctggtttcgtgtttcgtcttgttgggtttcttgttgtgtagtcgtgaggtgagagcacagctaaacctgtggcacaccagggtggggccattgaactccggaggacccgtggttgcccagaagcgggggtgttgactgcccgtcccgtttctttttcccgtctctttcgtggtcgccgagccccttggctgccgtaattctgcgcccggggcgcccagagaaactattcgcggtgatcaaatgtggggggggacacatacggaacgtcggctgagacgtttgggccctgggcgcaggaaattggtcacggctgaccgccgaaaggggcgacangttacaacgcccgttgggtggttgaacaccatcgatgggggtaccgcgggcggttcctccggaaggttcgttttgtgtcgaaggtcgcgcacacagtcattggcgcacacaccgcacctgttggtcaccaaagtttggtgagagtgtgtgtgggccctggtgagtactttgtggccagggaggaagtgtgtatgtctgttctcgtaagcccttcgtttctttgtcgctggggggaacctgtctgtgatgcccggacccgcgttgggggccgcaaaattttttttggacacgccggagtgttgtgggcctcgccctctccccgcagggatttagtctgtgtccctctcgcagcgaatgttttattttcccctcgtgcccccctcgtgtgagagccctcttgcccccccctaccgagtggggtcctccgccccaccgcgtgccacgcttccggtggggatacctcgagggacttggagaggagattctcgtgagggcaccacagcttgggcttgtcttgggaagatattgctcggaactttgttgatagaccgcaccacacacacagcggagatgtctgtctgggcctcttttcgagagctgtcttgcacgcacacttcttattgttatacacttaagggagttgaaagggtgtatgtccgcgaggtggaggcccacttgagagtgggctcgccactggagaaggagaagaaataggctggcgacggttgcccctcttctgggaacaactgaagaagggcaatcctttcgcccttagtctngctgagggnctattggagagggtcctccctccactctgtttctaccacgagagttatactttgctggccctaaatgacacttcccctccccaccctctccttttgaggcttttccttttccctcccctttttgctaccctaagggggatattccctccgtggcccctgtccccaccctttataatttggggtcccttttttataacccgggaaaaccccaaccaaga

SEQ ID NO: 573942 - DNA, 416 bp, Homo sapiens
ccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcaattcggggcaggagggagaggagggaaagtatttctgaccctgaagccaacagccggggggttgtgcaaacatgattgcacgtaacacaaggaagcactgccctcccgctgactggctgacgtttaccctttgctgttgccaacggttggatgctgtcatgggaattatcaacgtttgtcttggatatatataaa

SEQ ID NO: 573943 - DNA, 1154 bp, Homo sapiens
  misc_feature (25)..(25): n is a, c, g, or t
agcggggggggagctcatgcactgntgatagcagtacttggggagggccgagatacgtgggagtcgaccctggaggtcaggagttcgaagactagcatgggcaacgtggtgaaagcctgtctcttaatagaaatacataaagttagctggtgtgatggcggatgtctgtattcccagctacttgggaggctgaagagcaggagaatgcgttagagacccaggaagtagaggttgcgagtgagcgtgagatggcagccactgcgactccagccgtgggacaatcgagacgtgaggacgtccactcctcatgaaagaagagaagggagaagcgtcgtccacgacgctgggatgtcggcgccaataagggggcccggataccttggacggggggaagccggagtagcaacgttgaggcttgccatgtcagcgaaggggtacgggttccagagactggggcgggtaaacctcacggggggcgcataggccagtggtacgccggggtggtggcaacaggtgtcgtcaatgccacgggtcccgaagagattgccacaccgggcaaacctataacgcgaaggcacagcggccccaggaagggaacagacgcagtgatcgcgctgccttatcggcggacaaggaacggagaggttaccacacgaaaccgaaagcaaaggatggggcacagccaggagtgacaaaacaataagcgagccaatgaaacaagcacccatacaagaggaccaacacaatgcatcaaacagaagagaatcgaaacacacgaggtaaacgacgaactaaacgacaggcaccaacaagtgaagaaggacacgcacggggacccggagacaccggaaccagaaggaaatccaagagcaccgagaagacaaaccgagggaacgacgggacactgatgagagaagaccgatacgaaacaacaaggcacgcacaaacaaaaaacacagacgcaacaagtacccaccaagaaccacaccaagacgcagaaccacagagagaaggaaaacaacgaacagcaagaaaaccaaagcgaaccgacaggaggagacacagaagaacgagaggacaacggacaaaagagaaagatgagagacaacacgcaagagaaaaggacacgagagcaaaaacgagaagaagacaaa

SEQ ID NO: 573944 - DNA, 102 bp, Homo sapiens
ggtggatatgcagttgtttccctgtacagtattgaagccaggatctcctcccaaaaagcagaactcatagctctcaccaggcccaaaaatgtgtaaaatata

SEQ ID NO: 573945 - DNA, 146 bp, Homo sapiens
  misc_feature (143)..(143): n is a, c, g, or t
gtcaagcaaccactctgcggccttcccggcgtatttgcagcggggccttggggagggaatgggggttggacgggattgaggaaggtccgcacagcctgtttttgctcagttgcaataaacgtgacatattgggagcgttaccntta

SEQ ID NO: 573946 - DNA, 160 bp, Homo sapiens
ggctcggtaccctggcgtgtcccagcagcgaatttgacatcgtttttgttggcatttggatttactgttaggaatgtcactggtattctatacagattgtaatgaatctgtagattgctttgggtagtatggacattttaataatatcgattattccaat

SEQ ID NO: 573947 - DNA, 140 bp, Homo sapiens
gaactctggacactgcctggaggaatcaggcctgccgtagccagggaagggcgggaaacaaagacgacgctcagagagggcaacctttccctaaaggttacacaagcaccaaatttaggaaaatttgggttccccaattc

SEQ ID NO: 573948 - DNA, 164 bp, Homo sapiens
  misc_feature (36)..(36): n is a, c, g, or t
tctacagcgtctgacgtgaccactagatggctatangtttagacatatggctgggcgtggtggctcacgctgtaatccaagcactctgggaggccaaagcaggcaggtcacctaaggtcaggaatttgagacagcctggccaataatggtgaaacccctgtctc

SEQ ID NO: 573949 - DNA, 145 bp, Homo sapiens
ctgagctggtaccggctctggtgtaccgataagctgcaggttatccttgctctgtgcgccttttatttgtccttaaactacctcaccacgagccacaccaagagccacacgaagagccaccccaagggccacgcgaagagccaca

SEQ ID NO: 573950 - DNA, 374 bp, Homo sapiens
  misc_feature (374)..(374): n is a, c, g, or t
tcgacccacgcgtcgcccaccgcgtcccggaagggttttatgttgttaactcgtcggtcgcgctacgctcactccaccactccgcgcctcagtccccctaccaaccgtaccatcccagctcaatccaccgtccgcttaacccagctatctcacactctaccctaccaccacttacctcctcacccacaacaacatcacatctccgacaccccctcctctctcctcctccacctcacacccatccctcctcccccctacccgctcaccacccatcgctactccaccctccagacgcatcctcacctactaccacctcgaaccaccgccactccaacccacttccttactcacactcactctctatcacttcttan

SEQ ID NO: 573951 - DNA, 399 bp, Homo sapiens
ctcgtcaaaggacctgggcacgtgagtccaagtgctgctaacaactacactctagagtaaagaaaatagcttaaaatctcgccatcttgttcctcatttgtagagggggaatattaaaacagttcctgtatgacccacttcacaatggctgaaagagagcgtcaaatgagttcatggacaggagacagccctctcattgtaacgagatctcacccttgattcctctgctccacttatataacacatctctttgtctatgcccccaaaagtacaactcctatccaaaaatccccaagcgtgggcctttggcatcttgttcactccctccaggattttgctcacactgtaccctctgctggaatatgttttgtccgcactagatgttcaaggcacatctca

SEQ ID NO: 573952 - DNA, 1015 bp, Homo sapiens
agctgttcgtaagttcccgtgcctatgattcttgcttgcatagtgttcgtctatggctgatccaggcactctcttgcagtctcgaaacgctctccgaattcctgttgcgtttgcaatccttccggggtcctgtcatccatcggcctatcatcacatgactgtcatgtgtaccatgccaagctaccggctttcagggaatgagttacccttcgtaagctcatgctcagatcattgcatcctcctcccaaaattctagctaaaaggttcatccatcctggccagttgtgatgaccaatctcgtataattagggttattggtccgaattttgctatcctggtagtccgcttccatatatcataccgtacttcatctggcctctcccttggataggtgaactgggaaaagatagtagggtatattaggttacagattgttcgacctcattaagtcactttgtcgtaataatggggagaaggtaggaaacgcagctgatagaagaatattaggagttttactgattgaatgccaagcaagacgtattgacaaggcagcagttctttgactaagagagtcttattggatagtaaagctgaactataggttgtgggaggaaaggccagccaattgagagagaacttctgagattgggttgggagcagatgtaggcttgaaatacagtggtcctggtttgtgaactttacacgtgactgggtggaatcttggacgttataggaatcccaaatgtctagcgatgtgtcgcgtagatgtcagtatccatatactggggatgatggtccgtagctaacacattggtgtccctgtggctaactgtatcctggtgtgctcatgagaggggctcccgttgcattcactaagcggggcgccacggggaccattggggactatgctgtccctatggttgaagggtacctcccgaataacaggtcggcaccatgccacagcaaagcgattttattcccaaagcttggctggaaaaggttgttcacaacacag

SEQ ID NO: 573953 - DNA, 154 bp, Homo sapiens
tcactcatgcctctgacttgcagatgcctcatgccagagaacttatagtcttagaataggaaaaagtaaagaaatatcaacttccaagtatggcaagtaactacccaatgatttagtaattttcccgcccagttatgacttagggaagctgggg

SEQ ID NO: 573954 - DNA, 359 bp, Homo sapiens
ctactactactaaattcgcggcggctcgacctcagcatggagtgcaactgacaacttggcaattggccaggtgcagtggctcacgcctgtaatcccagcactttgggaggccgaggtgggtggattatctgaggtcaggagttcaagaccagcccagccaacatggtgaaacccggtctctactaaaaatacaaaaattagctgggcatggtggcgggctcctgtaatcccagctactcgggaggctgaggcaggagaatcacttgaattcgggagttggaggttggagagagtggagatccgcccctgcactccaaaccaggtgacagagtgagactctgtctcaagtcgacgcggcc

SEQ ID NO: 573955 - DNA, 381 bp, Homo sapiens
cggcatagcgcatacgcccagaactcctgggctcagcgatcctcccacctcagcctcctgagtagctaggactgcaggcatgcaccaccacacccagctaacttttgtatttttttttctgtagagacaggctatattacccaggctggtctcaaactcctgggctcaagcaatccacccgcctttgcctcccaaagtgatgggattacaggagtgagccaccatgcctggccactagttcaccaattaaaatgttaatctcatccaaaaacacagtccaagttgacacataaaatgaaccatcacagatagtatctaccttattctttgcccaggctggaatgcagtggtgcaatctcggctcactgcaacctccgcctc

SEQ ID NO: 573956 - DNA, 835 bp, Homo sapiens
gcagcatttttagttatgtggctgtttggcagaatgacaactaaggttttcccccatttggatttcaggaggacatgaatagtgtgtttaattgtaactcctcatacacttttaaaaccaacatcttttttcatacaatgttggtagtgtttgtccaggtaccttaactgtagcttgtgtaatgttgatgaatatctgtatcttacggtcttccataatggctaggttgatattcaaaaaaacctatttctgtgtttcgaggggtggggaagtaaaaacactaagtgtataatttgaacccgaggcatattgcttccagattctgatgtgtgagggaaaatactgtcacaatcgaacaatcttgacaatttacttaatcaagtaaccagtagttcatgcaaaaccaacttgtacagactaataaatcttttcgcacagtgattcagtttgctcagctcttgctatgtctatgtagatttcgtcatccatgtgttattaatttacactgatctctgctatgttaaccccccaaataaagttatttgtcctttaaggtggttactataatacccctcagctaagattccaggtacttacttactggggcagcttgtctctgtcatacaattgccacatgattcagccttctttgtgacttgaccacctctgcatatgtttgttgagatttactccaggtgggtcctttcggaagtacctctttgcttttaactcctctctgattcacgtcctatcttctcccgctctcgagttaccctcccttggctccatccgcattcctgcattggcccacccttttttgccgtttcggcacgct

SEQ ID NO: 573957 - DNA, 1211 bp, Homo sapiens
gacaggagcgatgcctgtatggggcaggcgagcagcgcgggatctgtccacctcgtccgtaactagtgtttggcctgccccagtgacagtgtgacgggctggcctgtgagtgtgtccatctggaagggagtccccggcattggggattgtggattcccgtctacccgcaaagtggagcctagccaaggggggcggagctgactgatcgcataaggcggatatggcactttcacggagctgcccatctaatcggtgaaggcgcgtgggagtagggtacgtgatgatttcctagggttgcgctaagcaaatacattctgggtgagcgacataattggacggcttgtggatcgatccatctagcatgttcgccttgagctcaattacaaagcggcggtggcattctcaggagcgtacacgcagtctctctgcacgtcatcattgtgccctgttcgttgagatgacatgtcttttattgggggtaaagaaacacacgcatcgaatcttagaggatagacgtggtcatcagtcagtcgtgccagtattctgtataagggtgtactaaccagcaattcggttgaaatcgtccctggtgcccttttaccacctcgagctgtttctaacgttggcggtgacatctggacttacgtccccagaacttaccctttttgtgggcaaggatcggtaaatgataagcgaaggggtttccattgcgttggccatagattggcggccccgtccgtagaactggcgtccattggtccgtggggaacttgagggaaatgggttgtttaaccgagggacggtttaggggccccaacggtttgtgcgggtttcggaccacgtttgggtcaggaacgttcttggggggcatatgcaaatctaccgaaaggcctggaacgagtagtttgcggacacaccgggaacagtagagctccaattggggtttccttggtaccatattccttttggggaaagcctacctttcccgtgtggtcttggagggcctcccttgggattttacgcaccttgggtgtgaaagccacccagaagtggcctagatttgccacaattaagttacccttggttgtgtgccattcaaacttagagcaaggctcgggttcccctaccaaggggaaagacactgggcccaacggggcgcgcgcaatatttgagcttaaaccacgaaagttggtccctgaggacatacgtag

SEQ ID NO: 573958 - DNA, 222 bp, Homo sapiens
aattctgggggaatggatggcattggtggcagagatggcatcgctggaattggaggaatggagtgagcggcgggactgtagtcattggagatggctgtgcttggatacagttgagtctaagacgttgggctcccaaagtgtatagcccccaatattttggaggagctagttcctacgactggctgtggcaaaatgtctagtatgtaagtagtatgctttcat

SEQ ID NO: 573959 - DNA, 198 bp, Homo sapiens
  misc_feature (22)..(22): n is a, c, g, or t
  misc_feature (41)..(42): n is a, c, g, or t
  misc_feature (95)..(95): n is a, c, g, or t
  misc_feature (161)..(161): n is a, c, g, or t
  misc_feature (188)..(188): n is a, c, g, or t
  misc_feature (191)..(191): n is a, c, g, or t
aagggataaaaggaagctttgncaccactctaccatcaaannggaattgaacattcccattaaggcagtaaaacaaaagccaatagcaaacatgnatttcattcaaccattgatagatctctgccgttattcttcagtttctcttctcgtctctctatttntttctctggttgtcgaccagctgactntgncatcgtt

SEQ ID NO: 573960 - DNA, 497 bp, Homo sapiens
  misc_feature (497)..(497): n is a, c, g, or t
aaggatgagcgagaaagtggtaggaccaggattcaaacataggtctctctgactccagagtccgtgtgcttcaactctaggctctgagaatggatgtgtgtccagctgttcttcaagccaatttcttccagagtccctgaaaatggttggaaatggctcattgtcatggtggaagagcctgctgatggaggaaataaaccactaccacagccaccatcatcagaaacaacaactctatcaccatagcaattggtggtaggatcctttgaacctgggaggtcaaggctccagtgagtctcagcagaggagtagggggtgggtggcagctagggttagggttacggttagggttaggccagtccagttgctgaggtgaaacggctgggaagcatccttctccccaacagccaaatcataaatcaactctgttgtctgtgccttcaaacatgtcctgaacctgccccatctcaccagctgcactaactccctctctagcn

SEQ ID NO: 573961 - DNA, 266 bp, Homo sapiens
  misc_feature (113)..(113): n is a, c, g, or t
ctgtgctcacactcctggagtcaagcgatcctcccacctactgtggcagcctgaagggttttaaacaggcctgtgtggtgaatgccttggtgggccttggtgggaggatgggncctgactccccttgtctctgtacccctcctctctcctcctctttagaatggaggcaacctgctgtgtgccgtggatgaatccaaggatcacatgctctcggtgtgggacctggggccgagagacccacggtggtggctgtccgggtggagggt

SEQ ID NO: 573962 - DNA, 967 bp, Homo sapiens
ataccaggtcctcacacgctcggaacgagaagcccctcatctgggacatccccaagaagattatgaaggcaacaaacaggagaagatgctggattaaaagatgtcacctgtggaacataggaaggacatcaccaaacaggatcaggtaactattcgatttatacgtaccgcacgctttgtattcaaaaattatctatacctcagtacacaatcacgcgaaaccaaaaagaaaagaacattattgtagctcacgctaattaactgaatactatactctccctggggggctcataacaaaatcgactgcgcctcaataccactaacacatttaaagatcaccaaaacaactcacctatcccgacgcgtaagtcgcataaccgcttaccgcaccactccaatcgttccgcgacagcaccagccgacgctcccccctatatcacaaatattgtatttcgccactcccccgtcccgtcaccgccgcaccaacaacaaacctaaaaaacacgctctacacacaacaagaatccatcaaaaaagatatggaggaatggaaaacgtacttgtaaccaacactagccgcacatccctccaccaatccgacacctacacccgcccatatgcatcacccaatactcagcattgtcctcactcctcacataaatcgaaacaccacccctacagtccccgcgccgccatcacgcgatcatcactcatcacccctaacctgttacccatactacacaaaagcataatcgagtaatagtaccagtccgaggtacacaatgcacaacaccattgttatacacctactaattatgatagccattcgagagcgacccaactatcccccaactccctatacataccaccgccctccaccccccccccgctacatatcataaccaccacatcctacccccataatgacactcagccctagatagatacataccataaacccatatat

SEQ ID NO: 573963 - DNA, 200 bp, Homo sapiens
tcagtataagacaccatagactactcagatggcatccctggaccaaccagtgaccggagagacattgccaccctagaagggaagaacacaagactagctggactttaccaactagctgatagtagagccctacgggccttgcagcaacacattaggtagttgagccaacgtatatggtatacagtaggacacactgggtg

SEQ ID NO: 573964 - DNA, 494 bp, Homo sapiens
  misc_feature (428)..(428): n is a, c, g, or t
attccctgagacaaaacagtattgaaattaggccaatgaataaccttccagtgacttctgcagtgttcaagtggagcaaagatccacacgtctctcactggaaatcaaaaactagaaatgattaagcttaatgaggaaggcatgtcaaaagctgagatcagccaaaagctaggccttttgcaccacttaagcttaattgccaatggcaagcaacgtttttttgagggtattagaagtgctactccagtgaacacaggaataagaagaaagcagaaaagccttattgctgttttgcagaaaggtttaaggggtcgtgaagaagatcaaactattcccaacatttcccttaagccaaagcctaatccaaagcaaagcccctactttttttaactataaacctttaatcttttttaatttttaaataaaanccggaaacagggaaaaaacctgccaaaaaaaaatatggaagctttgcaaaggcttctttttggttt

SEQ ID NO: 573965 - DNA, 332 bp, Homo sapiens
aagacggagctagggtgtgagggggcgagagaggtcggaggggcggagagagagaggtagaggaggactgggtgacgagaatcagtgtttcagggaggcatgctggctcgggatggtcgaaaagcagtcgagaatcaagccaaaagattgtcacagttttgtttcggaattatgcactctctgggaagaaaactttacgcacttcttttccacaagtggactaccggaatatgacaagtcacaggtggcgtgagtgacatgaccggctgtgtcccttcctacacatatatagacgcacgccgtgctcaacgtctcacggaaccatgcacacg

SEQ ID NO: 573966 - DNA, 934 bp, Homo sapiens
ccacccagagctgtggtccccgaagggtgttcgtatctgtcttggccatgttgtgcatctccaggtctcctctgctcagaagatccccagtgagccctcgatgactccattaccttgatgctagtgcgcaggcagactagaagacgaggtgagggacaagttcatacgatccctgctgcatcagtgtctgcctatagattagattagccgtcggtgccctatgcggctggacccatgacgtgtgagaaacctggcctttcagaggtcggtattgaagctggagctgccccttgagaacttcatggtcgaagggctgataaagccagacactgcaagtcagcccgggaccttgcgggttgacaaggcctttggcggcagtgccggcaaattggctcgtcacggggagactgtttgacctcctgggttctgccttcgcggggtggtcctggggccatgacgtgctgggtgtctcctgatgatcgggggtatgctgcttgggcctgtctgcggggctggactcggtcaccgtgctttctggttgtcacacgttagtccgggtagggccgtgaggtgggccgtgcccttgtacctcgtgttccgttgtcatggccacctcgagccttgttctccgctgtggcagctgggatgtgtaggcgggaagctgacataggaactgcttcctgtcgacttgccactctggtgttgcgcgcctctgcatttctattaccgtgtgattgctggcgcccattccgaccaagatttcggccttcccaggaattacaccgggggaccggccactgtaaaagagcccatctcgaacgcggtcaggtggggtcggaaaacccgcgcggggccaacatccggtttgtcagcagacccgccgcgcgggtttgcccagcttatctaccacgagaaaatgtaaataagatgactg

SEQ ID NO: 573967 - DNA, 377 bp, Homo sapiens
gagctcattcactcctcacaaacagccctgccaggcaggtcctcaggaactgttaacgcagagttaagagggtcagtttcaatctcagttcccattacttaacagataaggtaccttggacaagttactcaacctctttgtacccagtaaaagaaaagaaggataatagtagtagcaactttgttgggttattgcgaggattgagaaagggtttagatagagtgcctaaataggtactcaaaaaaatgttagctattggctgggtgcagtggctcacatttataatcccagcacggtgggaggcggaggcaaatgggtggcttgagctcaggagttcaagaccatcctgggcaacatggagaaaccccatttttaca

SEQ ID NO: 573968 - DNA, 459 bp, Homo sapiens
  misc_feature (61)..(61): n is a, c, g, or t
  misc_feature (454)..(454): n is a, c, g, or t
tttgagacaagatcttgctctgtcacccaggctggagtgcagtggtgtgagcatggctcantgcagcctctgcctcctgggctcaagcgatcctcctgcctcaacctcccaaagtagctgggaccacaagcatgcaccacaacgcctggctgacttttatattttttgtagagatggagtcttgcaatgttgcctaggctggtctcaaacttctgggctcaagcgatcctcccacctgggcctcccaaagtaatgggattacaggcgggacacttggtgcccgatcttaccctgtgaatccttcaacctgcctcaacttggagccaacagagctgctggcacctcctggaaagccgactgcgtgactgctgcatggcctggacctagaggctggaggggcttctctttgggcatgcactgcaatgtgggtcttgaagcgcccccacgtacgtgnaagct

SEQ ID NO: 573969 - DNA, 548 bp, Homo sapiens
  misc_feature (34)..(34): n is a, c, g, or t
  misc_feature (40)..(40): n is a, c, g, or t
  misc_feature (289)..(289): n is a, c, g, or t
  misc_feature (312)..(312): n is a, c, g, or t
  misc_feature (370)..(370): n is a, c, g, or t
  misc_feature (429)..(429): n is a, c, g, or t
  misc_feature (446)..(446): n is a, c, g, or t
  misc_feature (449)..(450): n is a, c, g, or t
  misc_feature (510)..(510): n is a, c, g, or t
aatcaacatggagcttttaaaggtggctaacggntaactntctgtgccaaggctgtgctgccatcctggatacaggcacacctgtcatcgtaggaccccactgaggaaatccgggcccgcatgcagccattggggaatccccttgctggctggggagtacatcatccggtgctcagaaatcccaaaactccccgcagtctcactcctcattgggggggtctggtttaatctcacggcccaggattacgtcatccagtttgctcagggtgacgtccgcctctgcttgtcnggcttccgggccttggacaatcntcgcctccagtacctgtgtggatcctcggcgacgttttcttgggggcgtatgtgaccncttcgaccgcggggacatgaagagcggcgcacgagtgggactggcgcgcgctcgccctncggagcggacctggganatnngagtaccgcaggcgcagtacccgggtgccgcccaggttgatgcatgcgcaccgggtagcnagatagcgctactcagtaaaaatccaatatttccattg

SEQ ID NO: 573970 - DNA, 160 bp, Homo sapiens
gtggttcttgtgctggggaacaccagttagtgtggagcagcccagccaagcactgtcaggaatcctggacgcagctggatagacacttctcctggtgtcacctgggtattaatttcattttcatgtgggtattataaccgagcacaagaaccacacgggt

SEQ ID NO: 573971 - DNA, 896 bp, Homo sapiens
gagcgggcggggacacttccctgggcgggactgtctcggtggcacccggtggaaccgaggagaacgtggagctgccggtgagcggcgaatatggacgactacagcctggatgagttccgtacggcgctggcaggaggagctggcgcagtgaccaggcgccgaagaagcggcgacgtgccctgtagtgctgccgagaggctgggctcggcggccggcaggtgggctccgggcgcagcagaacaggcctcgggggacccggcgctggcccagggtctccctggagggcgctggggaggccccccggcaggcgcggtgctgaactcgggccgacggggcacaggaccgtacgcggaggccgatcacgtatctcctctgggcccgcgagggcgaccgcaggggcgcgtggagccaagctgggtaggaaccagactcatcgcgctgaacctgaacatgataatgaacatgcatgtagcatcatacatcttggactatccaaacgttgcctttacggaacttgcgccaatcaaataatattttgcagatatactgggaaccaggtaaaagcaacctaagagaagaatgtgcgacagcggtgacgcaatgtacgttggcaaagcggtgcacttcggcaggaagggaaattgcacgcgcagccacgatggggataccaagcggcatggtagccccacgaccacgcgcacacagcgggcataccccaactacccggggaacataccagcccacccactcactcatgcgaccctaactctcatatagcactgaggcaaagcccaggccacatccctaccccaacagaaagtgtgcgcccaacgccacaaacggcaaccaaacactggattgacacaacagccccaaacctgcgcaacaacaccact

SEQ ID NO: 573972 - DNA, 229 bp, Homo sapiens
  misc_feature (150)..(150): n is a, c, g, or t
ttcgtcgaagaacaacggcacttatccagtgaaccactatcacgaaaaaaactctacgctctctatactaaatctcccctacaaatctccgttaattataactattcacagccacgagaacgtaatccgtgattttactatcgttccttngataaccactacttatcccctaccttggctatcatcacgccgatgaggcaaccagtccagaacgcctgaacgcaggcac

SEQ ID NO: 573973 - DNA, 672 bp, Homo sapiens
gccaaggacagctttgtgcctgaagaagtggctgcggctattgttttacactttttaaaatgacaggtggtagctgccaagtgtaaaatcaactgtgggccagataaatagacccacatattgtggacagtattcctgcaattgtcttggtgatctgatcagccaccaggctcaaagaaccctgttcatttaacaaattattgacctggactcctgttatatgccagggcctgtcctaggccctgggaacatgacattgagcaacagcatggcccctgtccttagagaacgaacattccagtgtgtgtgtagtaaggggcaagctgtcctgtaccttaccgatatattagcgtagtgtcatcgtgggtaaagtcgactagatctagttttgaaccaaacattattattgctgtattatacaagaggatatacgcatccagcagtcctcgatcttgtctgcagtaggattcacgatgagatcgactaggtgagtccacgacttagctatgatagggtatgggtgcccaggtagaatagaatacttggacacgtggaagacactgaatgggtccctcacggatgacatcggaagataatgtggcctaatcttcctccaacatgtgcacgggcatggtaagaacgtacatctgcgcagcaccagcggcagacgaa

SEQ ID NO: 573974 - DNA, 309 bp, Homo sapiens
  misc_feature (84)..(84): n is a, c, g, or t
  misc_feature (136)..(136): n is a, c, g, or t
  misc_feature (154)..(154): n is a, c, g, or t
  misc_feature (174)..(174): n is a, c, g, or t
  misc_feature (185)..(185): n is a, c, g, or t
  misc_feature (223)..(223): n is a, c, g, or t
  misc_feature (275)..(275): n is a, c, g, or t
ctgacctggcagcgggatggggaggaccagacccaggacacggagcttttggagaccaggcctgcagggaatggaaccttccanaagtgggcagctgtggtggtaccttctggagaggagcagagatacacctgcnatgtgcagcatgagggtntgcccaagcccctcaccctnaaatgggagcnatcttcccagcccaccgtccacatcgtgggcatcattnctggcctggttctccttggagctgtaatcactggagctgtggtcgctgcttntaatgttggaggaggaaccagctcaaattagaaa

SEQ ID NO: 573975 - DNA, 523 bp, Homo sapiens
cggagtgcgctgccagagaaggagggcgaggagctgggcgagggcgatgcggcccgatggatggacgcagcgtgcgctggagctttcgtcggacgatggcggtggagtgttgaggatggttatttgagtgatgtccctgtgcagagctgtatcaatgctgcagctggcctgctggctgcgtggacgacttcaagaatggccttctccaaggagaagatggagaagaccaaggtgcgtacccgcgagaacctggatgaagactgcgcctcaagaccaatggaaaacctggagaagacgctggcacaccctggagaagcgcatgaacaagctggtgcactgctgcctgtgtgcccgccgagctggctgcgagaaacatgaatgactgtctgctgggacaatgttgcgcaaatccttcacgcccgaccacgtggtgtactgcgcgctccaatgaccagcggtctacaaggtgccacccttcaccttccacgtcaagaagatccgcgagggccagtgtggaagtgct

SEQ ID NO: 573976 - DNA, 395 bp, Homo sapiens
  misc_feature (212)..(212): n is a, c, g, or t
  misc_feature (229)..(229): n is a, c, g, or t
tcaggaggcaggataacgttgactggagcagagtcagtgagcgagattgcacactccactcagcctggcacagtgtgagactccactcaaaaaaaaagagagagagaaactgagtccagaaagatagtactttcacagagtccacagagagtacgtcgtgcaggccggaccagtctagtttgggtacttttaaccctcggtgataaccttanttgtctctacaattctncatctacccttcagctattggctagtctgcagaagtgtgtctatcctagattaacccacccagctactttaaactataactttgtccccagatgggaactgcagaatctgcttctgattcacctagctgcctacctagagtagctaggggggtacccgagctcgaa

SEQ ID NO: 573977 - DNA, 322 bp, Homo sapiens
tatcatccttcctgcaccctgtgggctcctgaaactcacatgggtacaaaagatacagtaaagacataaataccacattttgacacatggaaacacaaggagtgtccagcaaaagagtagcagcagtgaggaagagctgccgagacgggtatacaggaagctaccctgtgtttctgagaccctttgtgacatctcacattttatccaagaaaggatgatgagacagaggcagagccattgttgttccgtgctgttcctgagtgtcaactatctgggggggacattcccagtgtatcacgaacgagcaggaatcttcagaggg

SEQ ID NO: 573978 - DNA, 256 bp, Homo sapiens
ggcgaccgagtacaattggctgacatcacagttgtctgcaccctgttgtggctctataagcaggttctagagcctctttccgccagcctttccaataccaaccgctggttcctaacctcaattaacaagcccagttccggctgtcttggcgagtgaaactgtgtaagagatggccagtttgatgctaaaagttgcagagaccaacctaaaggacacacacgcaagagagggctcacgggagagagcagagcccagc

SEQ ID NO: 573979 - DNA, 482 bp, Homo sapiens
  misc_feature (111)..(111): n is a, c, g, or t
  misc_feature (342)..(342): n is a, c, g, or t
  misc_feature (392)..(392): n is a, c, g, or t
  misc_feature (429)..(429): n is a, c, g, or t
aaaaaaaaacttcctacttcctaatgccccacagtatttgtcaaaataaacctggggaacagaagaaaaaagacattcctgaaaaataaggggtccagaagctgtagcagnaaaaatgtaacatcccttaatttttccaggaaatttaatagagaaaggcctactgttatgtgtgaatgaatacaaacccccagtaaagaagaggcccaggctcttgccctataatccccagcactttgggaagctgaggcgggagaattatttgagccccaggagctcaagaccagcccgggcaacatggggagaccctgtctctacaaaaagttagccaggtgtggtagncatgctgcggtcccagccactcgggaggctgaggcgggaggattgcttgnagccacctcaaggtgggtgcagtgagccatgtaatcngccactgcactcccgcctgagcaatgaaggaagaccctgtctcaaaaaaaaaa

SEQ ID NO: 573980 - DNA, 1152 bp, Homo sapiens
  misc_feature (463)..(463): n is a, c, g, or t
ggcaccctcggctgggtagcgccagcagagcgaccaaagcgtcccgacgcctatccaggtcctgcactccagaagccatagatagatgctccatgtgcggcggcggccaagtcccaacaagcctttccctggatggatgcatcggtaccgggggacttgcgcctggagaactatcctatccctgatccaggcccaaatgaggtcttgctgagagatgcattctagttggtaatctagtgtgctcagcatgtccacgtactgggaagtatggtcgaattgggaattattattgtgaaaatagcccatggtgctgggacatgaagtcttcgggaacagtgcgaaaagagtgggatcatcggtaaagcacctaaaatcctaggtgatcgtgttgccatcgagcctggtgctccccgataaaagtgatgcagattctgcaagatgggccgataccatctgtcacctntccatcttcttgctgttgccacgaccccccgtatgacgggaacctctggccgagttctagtaaggcacaagtgcaagcctgtttggttagcaatgcttccgtgagcaatgtcaccttatgacggaaggcagccctgcatcgaggccactttctgtggggatccatgcctgcaggagaggcggagttaccctgggacacaaggtccttgtgtgtggagctgggtcaatcgggatggtcactttgctctgtggcaaagcaatgggtagcagcgtcaaggtattggttgactgatctgtctgataccgattggtccacaggcaaagcagatggggctgatttatcctgccgatttccaagagagccccagggaatctcgctcggaagataaaagctcggtgggggttcaaccccgaaaatacccatgaatgcaccggggcacaggctcactcacaggggggagatttttagcaacaccgccctagtgttgggaccccctcgtttttcggccagctgacttgtgtaagaacaccgaccccattgggtaatcacacgcgttgtgtgatacaaaggacgatctatctacaacatagcgagcagagcaaaactatgtcaccaccagcagagataagcccacccaacagacttcgatacaacggtcgtgataaacatatgtgtcaagctacgaacca

SEQ ID NO: 573981 - DNA, 81 bp, Homo sapiens
gccgaggacacggctgtgtattactgtgtgactggttctgcttcgggcagttctcgctattttgacttctggggccaggga

SEQ ID NO: 573982 - DNA, 324 bp, Homo sapiens
cggcatgcgcactgaattcattgacaactgcatccctaccaagaaggcccgatagaagtacgagaaaccagcaacttccagcagggaaggaacaccacgtatggcatatatctgctgctcagaggacaaggaattctgatctttccttccgccaaagctgtcaacagcacaaccaatcagcttcaaagtcagaacacaatgtggcatcgtccacttgatatcgtacttgccgatggcagagtaatagtattcagccagaatgtaggccatctgtaagcaaaagggagcgcggacggcagcgatggcgcggcccattagtcgaag

SEQ ID NO: 573983 - DNA, 124 bp, Homo sapiens
gccaatctcaggctcagcagcactgcagcagatcatttcatcattgttagtggcagtgtggcgagttcagctaaatattttgagaccggtggggatagcgatcattcatggtcagcggaggtga

SEQ ID NO: 573984 - DNA, 263 bp, Homo sapiens
ccccagtcattccatacaaagacaaagaactctacaccaggcggccaccatgtctcgccgaaagttatgaagtggcagtttagctaatgcctgaaacgggtcctttatcttgatgttttacatttcaacaagaaattctgaaaacgtatcaaaatctctgagtaatggaagaaggcatcacctatctactagctaaggacaaagtggataagagctagcgtctaaaatgtttgagtaggtgtccgaagcaagaaagggagctg

SEQ ID NO: 573985 - DNA, 417 bp, Homo sapiens
gaggatcttacgctgctcctcttagaaacttaagagtactttatggagcccctccctaccccgagtagaacctaacagggacctcggtttgttcctgtgagtactgccaggacttgtttaatgggtgcttggggttatgggtttacctaccttatttttatctcctcctcctcctcttcatcatcatcttcgtcatggcagtgtgtaatattcctgggggggccagtgggaagagggttgggaggtttaatctcactaatttgaccggtgccagctggtgccgcttgtaagtcagtgtctttttgaaatccactgattgtgcgggttccgggtggcaagagggagactccatctcattgatatctacgtgtgtgtgctccaccgttgattcatgaggcatcaagacatgggccagcc

SEQ ID NO: 573986 - DNA, 409 bp, Homo sapiens
ctgccgatccttccacctctgtggaagggcggctccccctgccactttccccacttccgcgggggagtggcacactgccggccggctctctcgggggctgctcagatgttatccggatgttccctttagatgttcctcgtgcatgttatctctctcctcctttatagtcctcttccaccaatcccaactctgctacccacacgctgagtacgctgctctcctccaatcaggagcaggatcagctcctgcaggtcatcactcaagttggcgagagacagctgcgtagaagttgtttactcccttctcagcgccatattgtgggagagcagatgcatagaataagtcttaattccagtaacttagtctagtccgagttgctccccacagtccttttgcaatgcactttttt

SEQ ID NO: 573987 - DNA, 408 bp, Homo sapiens
atcccctcgtgtcatcccctctggagaatgtagcagcaaggtgccattttggaagcagggagcagccgtcattagacacagaatttgctagtgccttgatcttggacttcccagcctccagaactatgagaataaattgctgttatttataaactatccagtctcatgtatgttgtcctagcagcacaaatggactaagaaagaactcataatcaaaagtgtcaatcaaaacagctgccgtaaagacagatatacagagaccaatagaagagaatagagagcccggaaataaatcctcacgtataaggtcaaacggtttcaacagagagccaagaccattcaatgggaaagaacaataaatggtttcaacaaatggctgaagactggataggataacacgttcgcgag

SEQ ID NO: 573988 - DNA, 216 bp, Homo sapiens
  misc_feature (165)..(165): n is a, c, g, or t
taatcgtcacacgcacggagaaggatgggtttgatctctggtcctgtcagtgggttaggatctggccttgctgtgagctgaggtgtaggccacaaatgtggctcagaactgttactgctgtagctgtggcataggccagcagctgcagctatgattcaacccctngtctgggaacttccatatgccatgggtgtagcccttctccggtggcgtggt

SEQ ID NO: 573989 - DNA, 224 bp, Homo sapiens
cagcacaacagccctgccatgggtttgtttgtcttctctactgctcactcccaacctttcgtaatgccattctctacaaccttatttctgagctacgtctcagcttacacttgtgtaatctacacatcacgaccacccctaacacaaccaccaaaactcctattgtggtctgcactcgactaacttacaaaatgctagcaggaaactttcaaaaaaaaaccaaa

SEQ ID NO: 573990 - DNA, 181 bp, Homo sapiens
ggggctggagaagtgcaggcagcagctgcaggagtgagctccggcaggtcagctggccagctgttggaggagaggaagaagcgcgagacccacgatgcgctggccctggagtgctccagaaactgggtcctgctgctcaccaaggagcgggacggtatgctgtggctgcagtctgtgaggt

SEQ ID NO: 573991 - DNA, 1626 bp, Homo sapiens
tttgttgcgcctttgttatgatctgggtgggtcgtcgcctccacactggtgttgttgtgtgtcctcttcactgtatactgcttctcagcggcggcttgctgttttgttattagcctcgctgcacgctggccgcctcgtctgttagttctcgttgtttgtctccgcggggtgtctcttcattagtggtgggttatgcttctcgtaggtggcagcccgcctctggtggtggggtgtgttggctcttacagtgttttccttcgggcagtcccttctggtggggggcgtccccccccccgggtggatgcggggggggggcgcccatcatctatgggtgtgtatgtgggtgctggtgtgtgtgggtgacttcgtctgctttgtttttcggctgcgcggttctttttgttgttggtgccccttcgctgttgatctccactgtggtgtgtttctttgttatgtggggggggggatctctttctgtgtgttgtttattgtctctctctattctctggtcgggggtgggtgtctctcgtgtggggggaggtactttgtgtatgcccccccactaactatttttttgtttactcctttgtggtggtggggactattagttgtgggggcgtcgtattattattgattattggcggagatatgatataaatatctttttcgttcttggtgagggtccaccctggatggatgtttgtctctcctccccaccacccggtgtcactattataggccgtggagaagatgaatatagttggagatgaaagaggtgctttgtggaaagtttctgtgtggagtgctccctcattcttgtgtgtgtcatacagagggcgctccactgcacattacttctgttcctctgaagaaaagagcgcgttctgcggagaaaaataaacccgtgtgttgtggtgtgctcctccgcccaactgggcctccgctgctccgcgttgtgctctgcttctccgcgggcggtgttgttctcttcactccccgcggcgtctgttgttcttctgtcgtgcgccgcaactactgttgtgggggtggtgctgctggtcctgctgcaggtgctcctactgcgggtggttggtgggctgcacctgctattagtatatggtggtgtggttattttggcgagtatattagttgtgttttgtacacaccccactgcttgttcttctttatctccttgtggcggtggtgtattataaggacgccgcactccttactcctacgcgggtatgatgctgcagacactctgtgtgtgtgagacacactctgcgaagtgtgtgtgtgtgtgtgtgtgtgtgtgtgtgtgtagatatgtggtgtgttgtggtgtgtgtgttgggtgtatatatatggtgtgtgacacacacttgtggagagaaggtgactcacttgtcttgtgtgtgcacaaagctgcttgttgttttgttgtctggaccacgtgagttggtttaactgtggtcacaaaacactcttgtgagactcgtggttgttggtgggattttccaatgttgtttttttaaaagtgcattccctgtgctattttccaaaccttgagtttggccccccatttttggccgttccaaagtgttaaagactatttatcgttggttt

SEQ ID NO: 573992 - DNA, 1397 bp, Homo sapiens
catggtggggtgggtttcaggtcacattgtttcagtttcatgcattgccagcataaactcatgccagagcacacttaacagtcttcagcacatggcacacacacagtcaaagcacaatcatcaacttcccaagttggcaaggtaactccccaatgcatttcagtttattttccccccaagttggcaatggggcaagctgcggggcacagttacaatcatgcagccacttggcgtgtcaccagtgccattcacatttgggccacaggcacacagtgtccataaatattgcatcactgtcatcatgtattcacttccacacagtcatcagcagctattggcgggcacaggcaacagtcaattggcaacctggggggtccgggtctagcgcctcacgtgggctggcaccaattcaactcacacattcatgcgggcacacattgccaacaaagtaagtcacagcgcatcatcgggtcagtagtagtaggtatctcctttctggggcacatattatactaccagggtagcatctgccacactccacattcaaattttcaacaacaacctcacctcaatcagcaacaacttggcctagccagccccacaggggcacacgatggcgcttataactgggcatcccctttgcacaggggggcaatcttaccctcctatgcattggggtccagccccttccgggtccattccaatcccacaagggttccaaaggaaaatgtccccatcaaacatgcgcagccacaggcccacggcaacggcagggctccaacaggaccacaaccgacttcacaagctcgcaacacaaacaggagtgggttacgcgggcacacgaacacaatcaaaaatctcaaacaccccacgtcgggggctagcacacgcatgtggccgagagaccaccaacaggcaccaggcctacacgggggctacaagggaccccacaacccaacaacactatcgggcgacaccaccctgggaacacacactgcaaacacaccccgccaacaacagggcaccgggacacccctcgcgtcaacccgggaaccgcaagcgaactagggtggccacaccgataccagcaatgcaaacagcacaccactaacaacagagcgtacagccacgcggacgaacagcaggaaaacgcgcaccaacccttgccagcaccacaccaaagacacacagagagaaaaacaacctacgggcagcccaacaacacacccacgagacaccacgcgacaggacccacaagacacgcaaaaccgacagaccagggcagccgcagcaaagaaagggagacacagcaaaagagtcaaccgcccggggcagacacgcccaccgcacagagacgagaaacactaggaataaccagagacaccagacaaccacaa

SEQ ID NO: 573993 - DNA, 384 bp, Homo sapiens
ggcaggtgaggagaggagccctcttgctgggctggtgggatcgtccgccaggccatcgggggtgtgtcaggggcagggctggagggcggggggtttgctgtgggttgacggcaccacctagctgctccccgctctctgcacctctgccctggcagcagcaggagctgactgctcaccctgaaggagtgcctgagacaccttgccacctggtagcagcataccctcagcatacaggcttgacagggtccagagaacccaggggagacagacaccaagaaagacgatggcaagaaagttcctggccagcaacacccccctccacgccaggcaaactcttgcacataccgtcaagagccatgagggccggtcagcctctctggcagc

SEQ ID NO: 573994 - DNA, 1369 bp, Homo sapiens
  misc_feature (548)..(548): n is a, c, g, or t
  misc_feature (757)..(757): n is a, c, g, or t
ggacgcgtgggcgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaattagctttgaaggaaaattaccggacattcagaggaaagctatattttctcggcagtgggtgctctttttcaaagattagaatttttgtgaagcatgtgtttttcttagcgaatgtggtgtggatgaagggttgaacctgtggcttgaaggcattcgctctcaagcgtggaggggagtgggtgcgtgttaagaaagccacgttgggagcccacaagaaggccaccttccttattagttcgagcttaaggggctttccctttttctggcgccccgagcttnttggcgcgctgacacgggggtgactcttcctattttagaaccacattcttggtgcctttacaagctcaatagaatgtgtcttacctaagaagcgaaaagccacaggttttccagtgacgtggccaagaatttccctgaaattagacagttttggcctgaaaaggaaagttctaactttctggggacctcccagcggcgcaaagctttgnaacgcggccccacttctggtggtttcaaagagcgtcttgagagggccaaccgggtggtacagagacacccctgacacacgcgctaaggtttaacaattatgcggcttcctgtgacacatatgtgtaacctccctcccattagaaatgggggttccccccgcgttggcgaccgcagttgtttgctctgtgttatgcgagaattttctttagaacccttctgtggggagaattttccccccctgggtctggggcggaccaacttctttatttgggcgcgggcggtagaactcagttgtcaaggggcggataaccccgggagttgtcccccaaaggcatacatagtgggggggcagtcatgaaggacaccaatcaacgaccctttttgcgccgtgtgtgggaggaacaccattgtatggggcgcccccccacacatattgtggctgtttctgtgaagcgccaaccttctttgtaaaacacccgcttttgaaaggagtgcatatatgcagagacaccctgttgatcaacaacatacttggccgtagaatatcaggccatcattaagacgtattactaactgacacaagacggcaactcacatcgtggtagtccaca

SEQ ID NO: 573995 - DNA, 104 bp, Homo sapiens
gtatgtgagagggctcctacgtccgcgaaggccagccgctggtgcagattaacgacgtgttgctgcttgcgcccagtgtgcagcagcagcaggcgggcgtgcag

SEQ ID NO: 573996 - DNA, 202 bp, Homo sapiens
ctcggcgtgtgtgataacgaacgtatgcgcctgcgctacgcggaaggcccgtctcgtctctgcttcctgtctgcgccccgttcgtgtccatggcgggtgcgtgcgcggatggcctgtgaagtactggcagacgtgcgttgctccccgacatcacgcggcccaacatcgtggaggcgctgctacatggtgtccctgcccatgg

SEQ ID NO: 573997 - DNA, 250 bp, Homo sapiens
acttgatagaaacacgtctttagacatggaatgtctctcccggactgcaactaatacagtagcgtcgccttatgtagcagtttcacaggcactacctaagagataccaaactgttcatagtacatagtggtgtaactagaattgcatgtacagctcctaaggtaacaccattgaaagggacaacattcattagagatgcattaataccggaatatttccttacaatccaactgcactgctttgtacaccc

SEQ ID NO: 573998 - DNA, 166 bp, Homo sapiens
tacctcgggccatggacaacatgtggcatggttctgtgccacattcctgaagcaatcttcctgctagggccattggacacagaatccgagtgatgctgtacccctcaaggatttaaactaacgaaaaatcaataaataactgtggatttgccgcaggagggtaccg

SEQ ID NO: 573999 - DNA, 130 bp, Homo sapiens
ctggagtgtaaccctgaattacgattattatgattttcaagatcacatttctctgttattcggaagtacagggtcaatttagactaaatgatcggtgaataaagtgactttgtcttgatgtatctgagaa

SEQ ID NO: 574000 - DNA, 235 bp, Homo sapiens
atcgttgaggcaggacactgtcgatgctcttgatggggccaaggggcaagactggggatggtggtctcccccaggtcatagtaaataaggccacgtagaccgcacatgatgggcagcggccggctgcgctgagccgccatctcaggttggtgaagctgctgctgctgggtgcgcgatggtcttggttcagcagcacactcttgatgctctgctccatggcggtacttcctgggcc

SEQ ID NO: 574001 - DNA, 387 bp, Homo sapiens
aagaaagaccagatgccagttacagacacccaagagggtgccttctaatacaggaatgtggctaacagataagtataaatctagggagtcggacagagtctcactctgtcgcccagactggagtgcagtgaagcaatctcagctcactgcagtctcagcctcccaggctcacacaattctccagtcagactcccaggtagctacgattacaggcacccgccaccacgcacggataatattaagtatatatagtaaagacaggcttacaccatgttgtccaggctggcctcaaactcctgacctcaggtgatccacctgactcagactcccaaagtgcagagattacagatgtgagccaccgaaccaggtcaaaaaaaatttttgaga

SEQ ID NO: 574002 - DNA, 276 bp, Homo sapiens
agacgtatatgccatagctgttcctgatgtaccacttgtatccgccatcgcatgtcacgatgtggtaaaacgtcgggctattgagattcgtctctcctgtctctctctgtttcttgcgctctctcgctatcctgtgactccttgcactctgtccgtcctctctctttactagattctttctctctttctctttttattagattccctctctctgtctctgtctctgcctctctttctttattagattctctctctccctctctttccccctttctc

SEQ ID NO: 574003 - DNA, 441 bp, Homo sapiens
aaatgctcatgagatcagatttagcattaaggtagtattagtctatgctgagctcagtacacaagaaacaaaaacaaacataaaatcaacaaaaaaggaaacagtacatattattaaagtaaagactaaagtcgagaagttttattttaaaagaacagaacatttacaagacatcagttatttggtgccccatatgtcattaaaaaagtttacttataccttgtattattatttccctaggctagtcaagcagcaaaccattaatcggtcggagaaacctgcatgacatatgcccgactggctcttcgtcacccacttgaaggacactacccaatcgatggaagcctttaatcgcacagccctccctattagcggactactggcggatgcagacatgtactactcgagcagttacccatagatcgttacatggggatcctc

SEQ ID NO: 574004 - DNA, 166 bp, Homo sapiens
atgacgatagaagcggcggatgatgtcctaggagcgtgcgagcacacgaagtactcctgcttcagccgcagctccgtatccctcaaagaagtatacatttggatacaggacgcctggagatgactcaggcaagtgcctcagatgtgccctgtcgggctagtcgggg

SEQ ID NO: 574005 - DNA, 323 bp, Homo sapiens
tggcgctgcgcactatctatcaatccatggcgcatgccccggagatactgttccagaacgcggtgtcggcccagcagacagcaaaacaccctggcccaggcggccaccaaccagtgacgtgatgcagatctacagcgtcgataccaccgcaggtgcggcggccaccgagaaagtcgcccagggcggcgtgtcggataacctcaccagcctgttgaccgtgctcaagtcgttccagccgtaagcactgagcactaacggatgtggtacttactcaacccaggagtctccaccatgagtacagtcagcccgcaaatcactgatgc

SEQ ID NO: 574006 - DNA, 567 bp, Homo sapiens
  misc_feature (45)..(45): n is a, c, g, or t
  misc_feature (83)..(83): n is a, c, g, or t
  misc_feature (96)..(96): n is a, c, g, or t
  misc_feature (102)..(103): n is a, c, g, or t
  misc_feature (163)..(163): n is a, c, g, or t
  misc_feature (169)..(169): n is a, c, g, or t
  misc_feature (224)..(224): n is a, c, g, or t
  misc_feature (245)..(245): n is a, c, g, or t
  misc_feature (317)..(317): n is a, c, g, or t
ttgtgttgggtaccccgccgaaattcggccccattatggcccggnggacgtgatgatcttgtgcggatcttctggcaaagcanaccatggggactnaggagnngcggtgagggaagtctggatgctgtcggctcctacgacgatccgactgccgccttagagngaaganacctctccgagacctctcatcacagcccgtggaagcgttgtagctcccaagtagngctcatgagaagtgtactccnttgtgacagatatgcgaagatataacaccaagccctcctatggataccaatacgctctttccagacctacgngagatagagaaacttgacaggtttccttccgcgcataggagcccgccaacgatacaatgctttgcttcttctggtgggccaatcttttatcactacctagacggctccgtcctattgcctacctgggaccactgtgaagcctgggcacttttcccaacaaccagcacagggtttccactttggtccctttgatcaggatcaagctgggcactttaatgcctcaataggaccggtgcttggtgggttccct

SEQ ID NO: 574007 - DNA, 920 bp, Homo sapiens
  misc_feature (8)..(8): n is a, c, g, or t
  misc_feature (439)..(439): n is a, c, g, or t
ggagcccngactacgctaacaaaacaggccaccacatgcaccccaatgtggtcaacaaacggagggttagccctcctcggaacatataaccccccgtgtttaaagggcgaccactctaaaccaggggccacacccacaaggggtcaccaacgccctggggcccccctgggcggggagaatgcccacctgtctcagcggcgaacgttcacggcccacaaatcggtgctcaaagagcctccagcgacaccgggtctttacacacacgggtaattcttgcgctgccacacaacattatcttcatggcctaatcacggcgccatctttggccttggataaaaagaactgtggccccgcccacctgggtcaaccaccaatgaaagcccagcccccttgggggggcagtaagcacaaaagcatgcacctcagggaggaaggagantatacagccaccacttcgcggagaaacaagccggaacaccccacgtcttgtataagaagacaagtggccaaatgtatcccggcgtcacataaattggcgcggctcgccccttggaaaacccaagcaccacactgggagcccgcgtgaccacaagaagggagcgcgaaatgggaacccaccggggcaccaaagcctcaagctggcccccaggcgtgagaaccacgctaacctccactacccccggcgccacaagtagcagagatgtcaagggtctcacataaaacgacgccaccaacacaatgcaacgtcacgtccacgacgccgacgcgacgctcaagaagcccgcgcaaggaggtattaggcaccccccacccccgggagtgggttcccccccaggggtcagaccccaagagatggaaaaatataagccatccacaggccctctctaaaacaaccggcgcacccaccggcccacaagaca

SEQ ID NO: 574008 - DNA, 286 bp, Homo sapiens
ctctcaagatcccgatttccactgtttatagtaaaatatactttattttttaatacaatagcttccagcaatatactggtgctgatgttccatagaatagataaaatacattcatctataataagctttcatttgccttttctagaaattattaagaatatactccaattctgttcaacattacggcttgaggagttgaattttttccatgttatctatatactcttgtgtggcccataccttgatctgatttataaaggatggagttattaaaagctctacacta

SEQ ID NO: 574009 - DNA, 193 bp, Homo sapiens
tccttgtaatccaagcagtcgtccttgtaatccttcttgcatcatcagtgcgtgcttagcatatgcttgtctcaagagattaagtcatgcatgtctaagtacgcacggacgctacagtgaaactgtgaatggctcattaaatcagttatggctgctttggtcgctcgcttgtatactgcttgggttacacgga

SEQ ID NO: 574010 - DNA, 276 bp, Homo sapiens
  misc_feature (10)..(10): n is a, c, g, or t
  misc_feature (23)..(23): n is a, c, g, or t
  misc_feature (30)..(30): n is a, c, g, or t
gttgtagatngcgagagatggtntggattntcttgctgagttcttgaagactctagggtgcgttgatccacacaccaagcctcggcgatctgcgccaacgcccgattgatgtagctgcgcaacgtatataggtgaactgcagctgagcgtagagcacatttcgtacagattcgcttcaagcacagggtggtcgtattgcccgtacttctcttggttctacgcgtggagttcacaccggagctattggccaaacgttccagttccaacaaaccgttg

SEQ ID NO: 574011 - DNA, 904 bp, Homo sapiens
  misc_feature (4)..(4): n is a, c, g, or t
  misc_feature (278)..(278): n is a, c, g, or t
  misc_feature (338)..(338): n is a, c, g, or t
  misc_feature (413)..(413): n is a, c, g, or t
  misc_feature (475)..(475): n is a, c, g, or t
  misc_feature (507)..(507): n is a, c, g, or t
  misc_feature (510)..(510): n is a, c, g, or t
  misc_feature (514)..(515): n is a, c, g, or t
  misc_feature (518)..(518): n is a, c, g, or t
  misc_feature (535)..(535): n is a, c, g, or t
  misc_feature (546)..(547): n is a, c, g, or t
  misc_feature (553)..(553): n is a, c, g, or t
  misc_feature (556)..(557): n is a, c, g, or t
  misc_feature (560)..(560): n is a, c, g, or t
  misc_feature (572)..(572): n is a, c, g, or t
  misc_feature (574)..(578): n is a, c, g, or t
  misc_feature (583)..(585): n is a, c, g, or t
  misc_feature (590)..(590): n is a, c, g, or t
  misc_feature (595)..(595): n is a, c, g, or t
  misc_feature (597)..(597): n is a, c, g, or t
  misc_feature (601)..(601): n is a, c, g, or t
  misc_feature (603)..(603): n is a, c, g, or t
  misc_feature (605)..(605): n is a, c, g, or t
  misc_feature (607)..(607): n is a, c, g, or t
  misc_feature (613)..(613): n is a, c, g, or t
  misc_feature (615)..(616): n is a, c, g, or t
  misc_feature (619)..(619): n is a, c, g, or t
  misc_feature (624)..(624): n is a, c, g, or t
  misc_feature (628)..(629): n is a, c, g, or t
  misc_feature (633)..(634): n is a, c, g, or t
  misc_feature (636)..(637): n is a, c, g, or t
  misc_feature (639)..(639): n is a, c, g, or t
  misc_feature (642)..(643): n is a, c, g, or t
  misc_feature (649)..(649): n is a, c, g, or t
  misc_feature (654)..(655): n is a, c, g, or t
  misc_feature (673)..(673): n is a, c, g, or t
  misc_feature (678)..(678): n is a, c, g, or t
  misc_feature (680)..(680): n is a, c, g, or t
  misc_feature (683)..(683): n is a, c, g, or t
  misc_feature (685)..(685): n is a, c, g, or t
  misc_feature (690)..(690): n is a, c, g, or t
  misc_feature (692)..(692): n is a, c, g, or t
  misc_feature (694)..(695): n is a, c, g, or t
  misc_feature (697)..(697): n is a, c, g, or t
  misc_feature (712)..(714): n is a, c, g, or t
  misc_feature (716)..(716): n is a, c, g, or t
  misc_feature (721)..(721): n is a, c, g, or t
  misc_feature (736)..(736): n is a, c, g, or t
  misc_feature (738)..(738): n is a, c, g, or t
  misc_feature (742)..(742): n is a, c, g, or t
  misc_feature (757)..(757): n is a, c, g, or t
  misc_feature (760)..(760): n is a, c, g, or t
  misc_feature (764)..(764): n is a, c, g, or t
  misc_feature (770)..(770): n is a, c, g, or t
  misc_feature (772)..(772): n is a, c, g, or t
  misc_feature (777)..(777): n is a, c, g, or t
  misc_feature (780)..(780): n is a, c, g, or t
  misc_feature (783)..(783): n is a, c, g, or t
  misc_feature (786)..(786): n is a, c, g, or t
  misc_feature (801)..(801): n is a, c, g, or t
  misc_feature (803)..(804): n is a, c, g, or t
  misc_feature (807)..(807): n is a, c, g, or t
  misc_feature (862)..(862): n is a, c, g, or t
  misc_feature (892)..(892): n is a, c, g, or t
cgtngtgtcattttcagcctggtgtggggtgagtggtacccaacggccggggcgccgcgtccgcagaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggccttggctggaaaagacccagtacagtgtagccgtgatgtggtcatttgtcctgatgccanccttgaagatgcaaaaaaagagggaccatatgatgtggtggttctaccaggaggtaatcntggcgcacagaatttatctgagtctgctgctgtgaaggatatactgaaggagcaggaaaaccggaagggcctganatcccccatctgtgcaggtcctactgctctgttggctcatgaaatagtttttggaagtaaanttacaacacaccctctttctaaagacaaaatnatnaatnnagntcattacacctactctnagaatcctgtnnaaaaanacnnccntattcttacaancnnnnntcctnnnaccancttcnanttancncntncaatantnnaancccgnaatnncaannanntntcnnctcaanttaannctccactttttcttaaanactanancancnaactncnannancacttatataaacannncnttatnaatccattctcactntnttcnctctaaacaaaacanttntatnttaatntnttcanaantcnctntccttactacttttncnnaantatttaattcacaactacacatatatttctcatcctacaaattttttctatacanttctaatcctttttttcataaaaacatttnatttatcaaact

SEQ ID NO: 574012 - DNA, 194 bp, Homo sapiens
  misc_feature (131)..(131): n is a, c, g, or t
tcattaagcaggcaattctatcaactagtaggtctttcctatcatgcataattaactcacaaacctaggtcactaacatctatatcacgtcactgccaagactataatctgagcaacattatatgatagcnacacatagctttatagtacagatactctttacggactccacttatgactccctaaagcccatg

SEQ ID NO: 574013 - DNA, 193 bp, Homo sapiens
gcgatcataatattctggctggaattagtattaaagggtaatgtatgcatatgctttattatttgaaattaacagttgatgaaatgtcaaagcatgcactaatgggcacatttctgtttttcccgattaaccagtcattggcaatatgcaccaggacaagcatgcacatcccactcatgcaatttgctgccac

SEQ ID NO: 574014 - DNA, 598 bp, Homo sapiens
  misc_feature (4)..(4): n is a, c, g, or t
  misc_feature (278)..(278): n is a, c, g, or t
  misc_feature (338)..(338): n is a, c, g, or t
  misc_feature (413)..(413): n is a, c, g, or t
  misc_feature (475)..(475): n is a, c, g, or t
  misc_feature (507)..(507): n is a, c, g, or t
  misc_feature (510)..(510): n is a, c, g, or t
  misc_feature (514)..(515): n is a, c, g, or t
  misc_feature (518)..(518): n is a, c, g, or t
  misc_feature (535)..(535): n is a, c, g, or t
cgtngtgtcattttcagcctggtgtggggtgagtggtacccaacggccggggcgccgcgtccgcagaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggccttggctggaaaagacccagtacagtgtagccgtgatgtggtcatttgtcctgatgccanccttgaagatgcaaaaaaagagggaccatatgatgtggtggttctaccaggaggtaatcntggcgcacagaatttatctgagtctgctgctgtgaaggatatactgaaggagcaggaaaaccggaagggcctganatcccccatctgtgcaggtcctactgctctgttggctcatgaaatagtttttggaagtaaanttacaacacaccctctttctaaagacaaaatnatnaatnnagntcattacacctactctnagaatcctgtggcttccattttttaacccctgattggcgaagaggtggccgctaattgtaact

SEQ ID NO: 574015 - DNA, 726 bp, Homo sapiens
ccggacaatgtttgtatattttttatttttatttatttatttgggggaagaaaattgagagatgaggggaacagagaggggggagggggagaggggggggagaattgggggggacacaggacttcccccggagacacgggggcgtgcggagcggcggtcaccacgcggaacaacgaactcacacaagaacaggacggggagaacaaaaagcgggcgccaggaaacacaacaacagacgagagaaaaaaacgagcgaatcacagggggggcgacacacgggggagctaacgacacgcgagagagaagaacacggaggagaggagcaaacacaccaaggcgcggagccacccagagagcgggcaacaggacggacagcgagagaccgacaacaaaaagagggaggcaagaagaaacaggagcggggagggacgacacgcaccaaggcaacgggcgacgacggagaaaacacacagcagagccgcacacacgaggcaacaaacaacagcgaagagaggagcaagagagagagaagagccgggaaaaacgcaagccggagtagagaaacacaacaagggggaaacgtggggagaagaaaagaaggcagagggcgccaaaaacacaaggcagagcagacagaaaacacgagcgaacgcgaacagaggggagaaacacaaggagggaaaacacaccaaggacccacaaaagaaaaaaaaaaacaagaacaaa

SEQ ID NO: 574016 - DNA, 409 bp, Homo sapiens
atttggtcccgacaagatgacatagatttgcaaaaagatgatgaggataccaagagaggcacttggctcaaaaaatttggtgctcagaatgtagctcggagcgattgacatttccgaacaggaaacttacattggcaaggataactgagaaaagaaaaaagtcatggtaggtcgaggtggttcaacaaacacaattggtcgaaccgaaatggaaacgttttagcaggagttactgtgcatctggacacgtggcacttcattttatctcggagcgcagtgccgggacctggggcttggcatctcgccctccctgcgcttcgcaacgttcccctaaagcaatcttctcgaggtacgcccacagccacgacgttggtcacgcacgcggcggcatacaaaacgcaaaagacaa

SEQ ID NO: 574017 - DNA, 112 bp, Homo sapiens
agaaggccagcttgaggagcgagtaaccagctccataaattcacatcgaccagttttttgggatactaatggaacccacccgtatttttattgaaggagcattggcttgcat

SEQ ID NO: 574018 - DNA, 847 bp, Homo sapiens
gcggtagcggcggtggtacgcgggctccccagcggcatgcctgtgccccccgggcgcgatggctactcgtcagcgtcgggaatcccactggcgaggcggcttctccggctcctgctagcgccatcgggcggggtctgctcgctagccgcgcgaagtaggctggctgtccgtctggcgaccgactgtcgaagggcaagatgcatgtgtggtgcgctgacctgcttggctgctgtctgagtcgtagttgcgcggccgtgctcttcgagggccccgcctcctctggtgccgtgcgccgattccttcgtatcagtgccgggacaccatcaatcgcgcgtcaccatggggctctccatcctcacccacgacgtgcctagccagtcctcaatactgggccgcttctggtggaggcggggggacatgcctgtgtgtgagctgggcgatgcttgtgtgtgtgtcggctgtaccgatgtgtttcggcccacgcggactatctggccgctgtgtgccactgccgggcgtcccacgtccctgccgcagcccgggcctggtgtgaccgactcccgcgtgtaggcgcatgtccgccagcggaggtgtgaggcatggtgttggcacccgtgctcgcgcgccactccggtgggccgaacatgacgtcgcacctgctgcttgggaggtgtcgccaggggcctgtcgcggcacagctcagttttcgtgacggtagcggcttgcgccctgtccagtgtacaagtcacgggaccgccttatcgccgggaccggtccaagcgtgggccgtcaagtgcattagccccaggcgttgggcttgtggcctgcgttccgagttaaggtcgcc

SEQ ID NO: 574019 - DNA, 603 bp, Homo sapiens
gctgtaccatgtcactgtgcatgcgttgcccgatcattattgcagccccgtagcaggcagctccacctccgtattccgtgacacgaaaaccgggactcagaacgaagccccctaggaactcacctccgcattccgataaagatcaccgtgtccagccctttactaagcacaatcaaagacgccctcggcttacttctcgttcgctgtctcgtcctgtaatgatattaacactatgtctcaccagacctcctaggcgacccagacaattatagccgctagccaacccgcttaaacacccctccccacatcaagcccgaatgatatttcctagttcgcgctacacaattctctcgatcgcgtccctaacaaagtaggaggcgtccttgccctattactatccatcctcatcctagcaataatccccatcctccatatatccaaacaacaaagcataatatttcgcccactaagccaatcactctattgactccatagccgcagacctcctcattctaacctgaatcggaggacaaccagtaagctacccttttaccatcattggacaagtagcatccgtactatactacaccacggatcctaatc

SEQ ID NO: 574020 - DNA, 141 bp, Homo sapiens
tgaggtcaggggagctgcacttgtatctgggactccgatctctcttcctccacccggtctcccgttcctcccttcccaaatgtgcatttttcaccccatcctcagagattttttttggtgccgccattcacattcctgata

SEQ ID NO: 574021 - DNA, 773 bp, Homo sapiens
gggccgctgccgggcatggcttccagtccgcggagggcgaggcggcggtggacagcggccccggcacccagctgcccgccgcccgcaagccgagcgcccgtccgccgcgccccgagcccgcgcttcctatctcagcagccctgccgccgccgccgaggacaagcgagcggcccatgatgcagggccatcaagtgtgataggtgcgtgggagacggagcatgtaggtaaaacttgcctactgatcagttacacaagcaatgcattatcctggagactatatacccttactggtctgtgaccaatttatgtctgccaatgataatgggtagaatggaaaacgcggttgaatctgggctttatgggaatacaaggctggacaaagaaaggattaatgacaagattacaggcgcacgacttatttcgcctaaatcccgggaacaaaacagagacgtgataggaaccattatacactcttagtgccgtgagcagaccccacttatgaatggaaggctccgatgaccagttcaattttggacacaaattggatacagaatgacacaagcggcatgggaaaatacccagtggaacgcggatgcacgggggacaaccacaacacattgggtcacaccaagcaaaagcattccacccaattccaagtccccattacgaattgcagagataacacctaacaaccacctgcaggacttgactaaaacggggggcacttgacccttcgagcacggaccccaccaggaaccttccgacacgaaaaa

SEQ ID NO: 574022 - DNA, 169 bp, Homo sapiens
cgcggtgcaggtgtgggactaccggtgcagtgtgtgggactcccggtgcaggtgtgggcctacccggtgcaggtgtggaactacccggtgcaggtgtgggacctaccggtgccggtgtgagaactaccggtgcaggtgtgggcctacccggttgcaggtgtggaacctc

SEQ ID NO: 574023 - DNA, 131 bp, Homo sapiens
tgtcggtacctgacaccgcgagtaccagacctgtattcgcagaaaagtcgagtggacgaagttgttgcgcaacaacttcgtccatactgacctgacctcaagaagtgtatggggtctcggctgtgtgcagt

SEQ ID NO: 574024 - DNA, 236 bp, Homo sapiens
ttaggtttgtttaggaaacccagcctcccgtttattttggccgctggggtggccccaactgctggacttttggcctgggaaaacatgttaagcccccctcattcccccccggggccctcctcccggatggcccctgggctaccccttttttcagccctggtttaaataccccccccgggggcttttttaaaaaaggtgggttttaaaaaggccccccattaaagcccggtggttga

SEQ ID NO: 574025 - DNA, 293 bp, Homo sapiens
  misc_feature (257)..(257): n is a, c, g, or t
cagaagtggccagttaatggggcttcattcccctgcactttggaaatgaccagcagtcccaaatgcatttgagagtattttcactcatgagagaaaacgtgcttctcagattctgaaggctttctgagtgaaaaccagacaaaacagacagtaagagtgctaataagtatgagacatctttctttttgttttccccccaccccaatctctcacctctggcttaaattcttaattttatggaaatggatacttggctnggtgcggtggcttcatgcctgtaatgccagcacctt

SEQ ID NO: 574026 - DNA, 243 bp, Homo sapiens
tcccagtagcggacgatgtgagagaagtactggagtaagtctgactctaagagatgaaaatctagtattatggagtataattctcccaagggaaaaacgccagtagaacatcagacagcttgtgctttagttctcaatgcacgccaggatctgaaaagtgtcctcagaagactactagaagagacgaaacggaacctgtgccttttacttctgaggtgaaaagatccaaaatggctacttcag

SEQ ID NO: 574027 - DNA, 99 bp, Homo sapiens
agcctgggacctgaagacacggctgtgtattactgtgtgagagatcggtctgtatattgtagttcgagtggatgccatggcctcgaccactggggccag

SEQ ID NO: 574028 - DNA, 1218 bp, Homo sapiens
  misc_feature (122)..(122): n is a, c, g, or t
  misc_feature (288)..(288): n is a, c, g, or t
  misc_feature (291)..(291): n is a, c, g, or t
  misc_feature (313)..(313): n is a, c, g, or t
  misc_feature (343)..(343): n is a, c, g, or t
  misc_feature (621)..(621): n is a, c, g, or t
aggtacacgcccttccacagatctcgcatactcttgtggaacaccaccctcttacgagtttccaccagagtttgagatatgattagtaatatgtgtattgatgtgatactgcctctgtcagncacagaggaggtcactcacaacttctactgtagatgtctgaagtcaccatataacgagaagcattgtaaaatagaggaatactattaacctctagcgcacaatggactaattcatatagcatgtcaactttaatccttatataaaggagacgcaatatatacgcancantctggcgatttgatattgatgntacccacaaatatatgttccttacatatgntcaccattgttttggtgatgtcgtataagccacccaagtcaggtccttgttagtgtagggtcacaagtgcgcgatgggcactgcagaggatccagcatggtgctcttagccatatgataacaggatgatataggggcatggctattcgatctcatgtcctcctcttagcccagttccctggctatctggaagaacgtcaaagtaacctttaatcaccgcatgtcgacggatctgttcgttggataacgactcttttcccctgttactagtggcttccnttatgggcttagaacttgggtggaggtctttgcgctcacgaacggtttggggcccagttgtgtaaagcgatagagggctaaagacagctgtgaaaaggctatatctatgtaataactcctagaaattgggctgatccgattggggatatgaggcttaatggggcgaacgctatagacgcgaataatagattgggtagtgggaaggtggaaatacctctcagttaagaagaactttattcaaatccaataatacaggttgggtcaatgcaccatagcatggcatagtataccgttgacgaaggaaattggattaactggcgggcttgttgtgcacattgggtactattggttggcactcattgcctccgatccagttaaactgcgcctagggttacaattccaactccaattggttgcccgtcccccttatttaaaccctattttcaaaggttggcggagccccacaattttatgcaacatatttcaagggcgatgagacgaggtatccacaaacgtgtgtgtggggaagcccctgggagacttggtcaccgttcccatcgtgggggcgccaaacttgggtccaaaggggcaatcccc

SEQ ID NO: 574029 - DNA, 379 bp, Homo sapiens
aaagaaactgtgtgaaatgtgagaatgctgccctgaagtgcctgcaatcctcagcccacagcccagaggccccagctcaatgtcctggtgtgttgccaacccagtgattgatgaggagggtgaggtcaatggctttgtgggtgctatgcgtgagaaggatggagaagctgagtgtcctccctgcatcccgccaccaagtgccttcctgaaggcctgggtgtattggccaggagaggacacagaggaagaggaagatgaggaagaagatgagtgacagtgactctggatcagatgaggaagagggagaagctgaggcttcctcttccactcctgctacatggtgtcttcttgaagtcctgggtctatcagccaggagagg

SEQ ID NO: 574030 - DNA, 245 bp, Homo sapiens
ctcaacgctttactacttcaatagattcaggtttagccgagcatgagatactattatacagaagcagaaaacgaacaaaaacccgggtaggacaggtactggtagtgatgtcaggatattgtacaagagaataaaaatattcaggagaatgatatttcatacatgctatttatcaaagagaaaagatatatacgtatgagatttattactgtaatgataaaaattacgagtcatcgccgatatac

SEQ ID NO: 574031 - DNA, 1608 bp, Homo sapiens
cttgtcttcgatggcggcgtggtggggtgctggggggtgtgttgtggccggctcgggttagggtatgtctggtgtgtgtgtggtggcggccggtgcgctgtggggggacgggtgttgtgtggtggggcgctgcgtgctgggcttggtgtggctcggtgacgtctggagattcttgtgtccgccgtggtgggggtttcgccctgtaggcgtgtgtaggtgcgggttgttgtcgtcgctggtggcgttgttgcgtggtcgttgtggcttatgggtgtgcgcggtggccggtgcgtgtgctgtccggtgtggcgtggtgggggtcggttcgcgccgtgcgcggtgggtgcggtgggcggggaggggtgggagcgaggtgcgggggtcttgtgtgttggtgggtgatggtgtgaagggcaagtcgtgcgtcgccgtgaggagtgggtgtcgcgcgtagatgtgggttgggcggcggggtggttggaggttgggaaagggtaggggttgtagggtttgctgcgagatgtgagaaagtcgagatgtgtggatggggaggtgatgtgatatgtggagatgtgagaagtggggagggagagttgtgtaggtagtctagtcggagatgttggtttcgtgtggtgtggtgcggcccggctggtgggtgtggtggcgcgggtggtgtgccgggggccggggggaggtggggagggtgtgggctgggaggcggtgggttgttgcgcggttggggtggtcgaggggggcaggggggtgcagaggcgcatggtggagtcaggggggatgtagtgcgctggggtttcaggtggtgggtggagagttgggtgcgagggtttgtgttggaggatgtgggatgggggaggatgcactggtgagagggggagagggtgtgggtggcgagagaggggtcagtatgcgcggagatggtgcgcaagggtgctcgcggtggtggcgcgcaggcgcgttttgagaggtggtggaaggaggtggaggcgtgggtgcagaggggggtgggcggagagggtgtgggtgggaggggtgtgtgtgtgtgtgtgtgtgtgagagtgagcgggggagaggctgtgtcgacagtgtgcgtgtggaggtgtgcaggtcggtgagctgtagagtaggcagagtttagtgtgtagtagtgtgtgtagagatttaggtgtggatgggtaatgcgtggagagaggggagaatagtgtgtgttgcttgcagtttcttggggagtctgagtcgtaggcaaaaggccgaggagtcgtgaagagttcagagtagtgatgtagctgttgtgttagctgtgtatagaaattagtgcgttgtggtgtttaaaatgagtcttttaagaaagagttaaggacatcgctagagcgcttaagtaggttagagagagaggttaaattatcaaggcctagtttgtgcagtttgcgtttttttgataaaaggtaagttgctgattaagtctaagttggaattgataattccagtagtcttagattaaaatgaggatattttctcctagattttctcatgttatgcctatgcatttatatatctaaccattaatttcataatccagaggttcaccataaa

SEQ ID NO: 574032 - DNA, 715 bp, Homo sapiens
ctgtccccttggtcctcaggcggtcgtggctggcgtgtggctggcggttgggccgaggcggggtggcctcagtggccgaggtggctggatcgcgtagcaggtggaaggagggatgggagccgcaggcgcagacccaccctgccatgaagcccccctgcagcctgtgcaggagacatggcggacgcagcatctcctgtgctctgtggtaaactggacctgctgtgtgtgtgaccctgacgtgcccatgcatgatatgaggatgcgcaccaggggagctcatcgagcagaccaagcgcgtgtatgaccaggttggcacccagtgagtttgaggacgtgtcctacgagagcacgctcaaggcgctggccgatgtggaggtcacctacacagttcagaggaatatccttgacttcccccatgcatgtttccgccctccaaggacatccggaacagccagcacaggaggccgacaagagagctctcttgagcttcgacgtggagctgacgcatgagcggaggacgtgtaccatgaggactcgtgtggctccagggagaccacgttcagaaaggactcaactgacggcccgacggcctgcggcgggtaccttggacggcgcgctacctcgaacgctgcggccgcgagacaactggggccttcagccatcccccatgagacgacctcagggaccaagcactccacatcggcaatcatagcac

SEQ ID NO: 574033 - DNA, 291 bp, Homo sapiens
aaatttcactttcctatgcaaataatcttaactttggaagattatttattcttagtgaaaatacccatatatgcagtctttggcttcattctaaagttgtaaaaatccatatcaccttttctaaggtccctctcagtcacagcacaagaacggggccagctcctcctgtaacaagacaggcacagaacatcttccacatggtggtgacttcaggggtcagcaacagtgcccagatagtgcatttccttgacgtgacttctgtgtcccatctatctctccaggaacacatca

SEQ ID NO: 574034 - DNA, 778 bp, Homo sapiens
ccccctaaggcgtatcccccgcgccctcgccttcgttttctttgttgtgtctcgcccccgcgttgcgagcatctccctcccctccctgtatgtccttgccgctccgcttgcactcgcagtctccctctgtttgctgggcgtcgcgcccactcccccgccttcgctcgtctcaatgttcgcccctctctctcctccggacgggctgctctctcgccgcttagttggtcgcgccccctcccccgacgcgacgtgactgttttgtggagaggctcgttactttctgccgcggccgacactcttctcgtgatgtcagtctgcctcgcgctcgtcaccgccccccccgctctggttcactctacgccttgttgagggggaaccttctactcctctgttgggtggttccccacccccctatgtttgtctcgtcgttctcgtcacatttatttacaactatgcctctctctcgctcgtccagcggcagctcccctcactttatgttttgtctcgcgccccccggtatctctctcctctctctctccattgttgctcgccgcccacacacgcacactgggtggtgcctcgctctctcccccaacccctcatcctcacctcatgaaaccccctccttctccccgctggttacacacacccctcctgtgctttatcctaccacctcgctcacgccctcacttctctctctcctcctgtctctctcccctccccgccgcctcctctctctctctccgcggcgcgtcctttcctctctttgtattaaata

SEQ ID NO: 574035 - DNA, 731 bp, Homo sapiens
  misc_feature (322)..(322): n is a, c, g, or t
  misc_feature (341)..(342): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (365)..(365): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (395)..(397): n is a, c, g, or t
  misc_feature (411)..(411): n is a, c, g, or t
  misc_feature (414)..(415): n is a, c, g, or t
  misc_feature (522)..(522): n is a, c, g, or t
  misc_feature (582)..(582): n is a, c, g, or t
  misc_feature (585)..(585): n is a, c, g, or t
  misc_feature (589)..(589): n is a, c, g, or t
  misc_feature (596)..(596): n is a, c, g, or t
  misc_feature (604)..(604): n is a, c, g, or t
  misc_feature (607)..(607): n is a, c, g, or t
  misc_feature (609)..(609): n is a, c, g, or t
  misc_feature (612)..(612): n is a, c, g, or t
  misc_feature (614)..(614): n is a, c, g, or t
  misc_feature (622)..(622): n is a, c, g, or t
  misc_feature (624)..(625): n is a, c, g, or t
  misc_feature (629)..(629): n is a, c, g, or t
  misc_feature (631)..(631): n is a, c, g, or t
  misc_feature (635)..(635): n is a, c, g, or t
  misc_feature (639)..(640): n is a, c, g, or t
  misc_feature (659)..(659): n is a, c, g, or t
  misc_feature (669)..(671): n is a, c, g, or t
  misc_feature (674)..(674): n is a, c, g, or t
  misc_feature (676)..(676): n is a, c, g, or t
  misc_feature (678)..(678): n is a, c, g, or t
  misc_feature (680)..(680): n is a, c, g, or t
  misc_feature (687)..(687): n is a, c, g, or t
  misc_feature (697)..(697): n is a, c, g, or t
  misc_feature (705)..(705): n is a, c, g, or t
  misc_feature (709)..(709): n is a, c, g, or t
  misc_feature (714)..(714): n is a, c, g, or t
  misc_feature (718)..(718): n is a, c, g, or t
  misc_feature (720)..(720): n is a, c, g, or t
gccctcccgattccccgacagcagatatactaaatcctgcatgtaatatatctgctgtcatcttacttggaccaacttcccatttacttatctttaaactatacagttacatcttaattccatccaaagaagatacagttttaagacagaagtgtactctctactatgccatttactgtacagttagcaagcaaagtgttaaatggagaagatacttgtttttattcaaccttttgagattcagattgactacatgttaactgaatgtctaaagtgatgatcgttgtgccctccaagttagtcttcaatcttttgggtttgnatgaaggttttacataagnnttattnangncaaggggggtggntaataaatgtatatancantnaataatgtnnngtaggtgtagattnccnnatgcatttggatgtacagatcgactacagagtacttttttcttatgatgattggtgtagaaatgtgtgatttgggtgggcttttacatcttgcctaccattgcatgnaacattggggtttcttcaaaatgtgtgtgtcatacttcttttgggaggggggttgttttnttntgtntattttntgagactnctncnggngncaaatttntnntttngngacncttnnttttgttaatcctgtctgngacacttaannntcntntnangcattantgctttagantgttcaantaanatttnctgncnaaaaaaaaaaa

SEQ ID NO: 574036 - DNA, 1762 bp, Homo sapiens
  misc_feature (206)..(206): n is a, c, g, or t
  misc_feature (209)..(209): n is a, c, g, or t
  misc_feature (875)..(875): n is a, c, g, or t
gggagtctgacacatgaggcggtgacctctgacaaacgcaaatgtgagggagcagtggagatatgagtgatatgatgaagctgtgagactgtgaatgaatggggagtaaaggacttctcgttgacctgtggaggaacgaaggacaggattcacggatgctctccagctgcacactgagacggtcatggacgcgttcgcgtcagagnctntgcgaagagagtcgtgactcgtcgccgtcactggcatgtaggaccgatgcgacgacatggaacaagggggtgactgagacatgtgggagaggccgggagggcgtgtccagacatggctgacatcaaggaagcaacgcctggatggtacgtggaaacgcccggggaaggagctgtgtcgtctgggcggccgtggcgcccgaggcgctagcaaggtggaacacttgttgattgatgcctacatcgtgtatgagcacggtagaagaccgacgaaaccgaaatgtctatcaatgacgcacataaagtagttgtggacaacacgagggagacgcgatgaggaggctggcgtacgtagggcaccaaactggggagggagttgcaaagacgggtaggcgtgaccctgtgtgctaagctcttagtgggggtaatgtgcatgtgttgcagtaaagggaaggtgatcgaaagcgatgtgcgtctgagggcattcagaaagaaagggaactctacaggagggttgtgcgaatacgcaaggaggggtttggggatatctacgcttgtcctggagggggctacttgttcgcgcagtggacaaggggaacgaaattccgttcgtccttcgccatgacggccagggaaagaaattgcgcacgaggggcggcttctaggctntttacctgtgctggtgaggacaccgtggttgggattggcatactgcatgtggtcgatacttgctaagcccttgagggcattgggcttgactagggagccggcagacttgcatgggcttacaacgtacctcggacttttggacatttaggtacccattcttccaaaagagttggcgccgaccattggtttgggcgaaccgtattgggcgccccttccccaaagattggcttttccacattaggacagcgtgcctggtgaggagacctgtatcatgcgcccatggagagttattgcccgacaaaggcggacttggagccccgaggtgaacttatcactgttcctcccatgggtttgcgtttcacaggattgtataccttatgctgcgagaacacaatgacgtcttgcagccgctaagggattcggccgggcgaagatagacactctgtggggccgccgtatgtaaaacaacaatggcgcacgagtatgttccacatccaagaaagccagacaggcggtttgtgagagactcaccctccgggaacaatgggccccgggccgaatcacgcggcgacgagagaacattctagcggagcagggaccacgtcgcgacgatctagacgagggcccacagagaacagatgaagcgccacatcaaccaagacgtgagaccgcggacgaaggcgatgattatcactacgaacgatgagtgacatgcagagacgagcacgacggaactgcacgagcagacggctcatccaacctccgcacaatcgagaaggagattgacgacacaaagaagaggctgactgggacgactccgcagcgtgcagcgaccaattagcaacaacccgacaagaagcgacgaacagcctcgcgactgacatata

SEQ ID NO: 574037 - DNA, 443 bp, Homo sapiens
gcacgaggagagagagagagaaggaggagggaagggggataacctcgaggaacagcacacagcaggtgcgaccgccatcttaatgtccttgattgcgtgcagatggtgtggaagtggctggcaccagaacagcccaatgagaaggaatgagcagacaatggagatttatgtagaagagagtgagcatggacacaggtacaattgtcaggaggagttgcttagaaagttatatcgtgacccacttccactcctgcccgttcatcacctaacactgacagatcatctaatgtccattacggagtgatacgatggacacgtccccatgatcctgggaccaaacataatggctgggagggacaccgagatcgaccaccgaccgctgccatccgacgccactatcacctacatcactgagggacccacacccagccttcacaagcctc

SEQ ID NO: 574038 - DNA, 239 bp, Homo sapiens
ggacgacaataagaagctgcatgacaataaaggtaaataagtacagtgtccctggtatccatggggtataggttcctggaccgtccccccaacccacagacaccaaaaatccaagtatactcaagtcccttacataaaatgacatatttgtatataaccaacgcacatccgcctgtatactttatccctagactaatacctaatgcaatgtaaatgctattgaaacttctaaaactagg

SEQ ID NO: 574039 - DNA, 240 bp, Homo sapiens
gggcagctgaactactccatgtgatactatatgatggacacattcactaaatttgtctaaatcccgtagaatgtacaacaactcagaataaacgctaaggtaaactatgggctttggaggataacaatgtgtccatgttggttcatcagttgcaacatatgtaccactcttgtgcaggatgttgataattggggaggcatactacaccaagagtaaaccctaatgtaaactattggcttt

SEQ ID NO: 574040 - DNA, 313 bp, Homo sapiens
cagacagactctggcagagggggctggggcgtccagcgtggtcagcatctgggggagtgagaaggcaggaaggataaaggattttccagagagtgtgactgaagaacagtaggctaaggaagctacagccatgggccactggttctcgggaatttagagaaggaagcagagacaactgaagacagactggccgggaacacggaggatctgggatggaagaggggagagctgggaagccgcgcctctgagtagcgtgggggcagagtcggcatcctaggtgggtgcaggtgtatgcggaagcagcattcattca

SEQ ID NO: 574041 - DNA, 125 bp, Homo sapiens
  misc_feature (25)..(25): n is a, c, g, or t
agctgcggctgccctgattatcccntgcaaaaacgtgcagaggcattgttcgcaggtgccttccgccccagttgcatgcattcatcacagagctctacgcatatctggtggacgcattcggttca

SEQ ID NO: 574042 - DNA, 242 bp, Homo sapiens
catgcccatccaggtggttccatcagtgcttgtgcccggtgcataagaacagcactggtccctgctgtagaggaggttggtgcaatcagtcaagttacatagctgagggttggggtcaactgatgccagcacagagaggtgggttcgttcatcccagagaaacctgggcctgttggtggggtaagacgtctttccgaggaggcaaagttagccaagatccgagggtgcgtggagagcggggt

SEQ ID NO: 574043 - DNA, 1376 bp, Homo sapiens
ggattggacggcctcgagtgcttaccgctcttcgtctgcttgttcgcaggactcggcgccaccgtcgggccccggggtcctcgggtagattctgcgacgctcgcgaagttaatccgcaaggcaaccagtgatcgagctatacacatggcagataaccaaagaccaaccaacgaatccagcccttcaagggctgtctaactgtccatatgatggtttgcgcatgatttcgaccatctcgcaggggtatacgatgcgagttgcgacacaggaggagtcctatcggatcgatagcaaatggaatgcgaccgagatcaggtagggatgggccttgtcgaatccgaatctgatgggaaggaacttttcgacacttgaattgagtgcgttttggcttgtgcctccattacgggtgagaggcacaatccgctcgagcatagaactcgccaattcagcacgtgtggcattcgccgcgaatgccatttgcacacttgaacgtggccccctctatggggttcgcaccactaacaacattctatgcagcactaagtagatttgcccatggaacgccgactggttttatcgggatgaacaggaaaagtttgagacaattgtgaacatccatgaaacttcaccctgacacagggacctgtttcaaatccaagaaaatagcgtgccgttatgtgaacattgggctcatagggaactgaaagacggaaatggcaaaaaacaaggaggcaacacacacttgtgcaaggggaaagcggcactttaatcacctacacggcacggcatggacctggacatgggaatacccaaacgcccaacattggggacgcgcagcaacctaccgggggagtattctaaccaccggaacttcgaaccgggcaaccacgaatgggcagctactccggacccacggttgggattatcacaccggtacagcgaagaacaggcccaccccccgttaacattgtcaagaacgcgagacccaccaacacccgcgtgcggaacataccttgtatgcaaacatcatccacaacacgatttgcagaaacacgtggaccgaagccaccacgattcgagtttccccgtccgaaaacagaccaactttggtgtgagggaccccataggagacggaaccccaaagaccggacattcagcaacggttcggacagaacagggcaacaaccggttatatgagggtcaacctcaatagcatattcacttctgcccaaacgggtttgagatccaattgtgggcacacttatgaaccttgccagtcatttggaatacccgatatcaggttcacaagtaccgagcgagtgttgtaggcacccccacaaagccgcttccaatatcgaggaactcaccctagcgtg

SEQ ID NO: 574044 - DNA, 414 bp, Homo sapiens
cctgaagatcttagtatcccccaatcgttacaaaggctacataactctaaacggaatgggaggccaaactctaggtcagctgagatcctggagaacatatcctagatcctgtctcattccctatagcggataacactccagccgtgtacatctcaggagcctgctagaagacagtgagtacgggagaggaggggagctagcttccaacctactccacacttgactcccataggacaacagtaagtgtcagggcatgtgccaaatcaagtggccagtacctctaggctggagacgtaggatatcctagccatacagatgcaatggaacagagaagagaaaggcggttccattgtcaccatagtgagccatacatttgcccagggaaccgggtcccggctaaggggctaggtatgc

SEQ ID NO: 574045 - DNA, 657 bp, Homo sapiens
ggagagctggacagccagatccaggagacaagcatctaatgatgacattctggtctcgtacttcgcgtctcccccgtgattagcccggcttgtgtcccctgtggccctctcccttaccctcctgcccatgtcactgcaggattgagagcctgaacaggtctgacggttgcggggaagatgcgcagggtcccggcaccggagcacggtggggcggagctattggtctcctcggtcacctctgtagaagtttcgccgtgggcgggtcgcgcgagaaatcggcgcgtcccggcgtccgtgtggccgcgccgtttggcccgggtcgtggatcgcagcgtacgagccgagggatgtctgcgttgaggctgccgtgtctgggccttgactcgctagggactcggcttcccgtgccgtgcgtgtggctgctggcctgggggacatggcagtgtgcgctcgtgcacccagagaccttcctcgtcgacatcctcgctaggccatgggagcatccatgctcgccatagctttgtggtcatgtgcccccatcgacatagcgccaactagcgtccgtggaaggcaggtccgggcaggagggtctgtgggtaggtctggaaggctgaaggaagggaatcctcaggaggagagagacacagatactatcgt

SEQ ID NO: 574046 - DNA, 477 bp, Homo sapiens
  misc_feature (162)..(162): n is a, c, g, or t
  misc_feature (164)..(164): n is a, c, g, or t
  misc_feature (172)..(173): n is a, c, g, or t
  misc_feature (177)..(177): n is a, c, g, or t
  misc_feature (182)..(182): n is a, c, g, or t
  misc_feature (184)..(184): n is a, c, g, or t
  misc_feature (189)..(190): n is a, c, g, or t
  misc_feature (192)..(193): n is a, c, g, or t
  misc_feature (223)..(223): n is a, c, g, or t
  misc_feature (227)..(227): n is a, c, g, or t
  misc_feature (477)..(477): n is a, c, g, or t
gtcctcagtgcagggcaacaggactttaggttcaagatggtgactgcagccatgctgctacagtgctgcccagtgcttgcccggggccccacaagcctcctaggcaaggtggttaagactcaccagttcctgtttggtattggacgctgtcccatcctggcnanccaaggannaaantgttntnaaatnnannttaaggaaaaaaaggatggaggagattatnaatnttgggagaagggaaaatgtaaattaatgatgtaggaaataaaggatgggaagagcaagattgtgcagaaggcagaccccagaagtccaggaagatgtgaagcgcctttcaagaaagatatgaatagataaatggtataagtaagaataaggaagaaattttaaggtaaaaaggagaaggagaagatatatgggaaggtaaaaaaaatgattaagaaaaatatgaatggaaaatatgtattaagttatgan

SEQ ID NO: 574047 - DNA, 723 bp, Homo sapiens
  misc_feature (177)..(177): n is a, c, g, or t
  misc_feature (188)..(188): n is a, c, g, or t
  misc_feature (206)..(206): n is a, c, g, or t
  misc_feature (225)..(225): n is a, c, g, or t
  misc_feature (235)..(235): n is a, c, g, or t
  misc_feature (239)..(239): n is a, c, g, or t
actgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcagangctgttccggngccacagcaagacgcgcngagttcctggcgcacagcnccaaggtgcnctcngtgtgtgcctgtgatgtttgcgactgtggctgtctgcctagcctcgtgggtccttctgacaagacgtgccagctgtcttcttgctggatgaagtgaccggtttgtgtcaaatgaaaacaattatcgtgggacatgtggtgatagttgtggaccatgctttgtttggcatccaatgtaatcctgacctattttgttactgtgctgtccggagataaaaccattctgcatctgggatgtgatggactacaaaatgcattgccactgtgaacactaaaggggagaacattaatatctgctggagtcctgcatgggcagaccattgctgtagtgcaacaaggatgatgtggtgacctttattgatgccaagacacaccgttccaaagcagaagagcagttcaagttcgaggtcaacgaaatctcctggaacaatgacaataatatgttcttcctgacaatggcatggttgttcacatctcagtaacca

SEQ ID NO: 574048 - DNA, 368 bp, Homo sapiens
gtcctcgatcgtcagagttagtcatcagtctggacacagataccatgccgtacgtacgatgacgtgatttagcatattcaataattcaagctgtgatcatataacctagagatttgccgagaatctctaaagtctgcgagggtcgaaaaccctctgtgctgggacagacggtgaatatataaggcttgctaggccatattttctctgtcataaccattcagtactattatagacaatacataatataaatggacctggctgcatttcaataacattctatttacaaaacaggtagggagctggatttggccagaaaactgtggggtttgaacacagtttgccaacccttgctctaaagaatgccctag

SEQ ID NO: 574049 - DNA, 220 bp, Homo sapiens
tcagaagtaaacatgtattcctaccctatctcatacccacaagtgtgaactttaccaggacaggatgtaagttataatcatcctcatggtcccaacatagagcatgcaacatgtactcaataaaggtttactgaattagtctgaaattcacctcgctcagggagagttagaaaaagctcgtatacatgagactttcagatgaccttttcatttatgttcc

SEQ ID NO: 574050 - DNA, 350 bp, Homo sapiens
  misc_feature (177)..(177): n is a, c, g, or t
  misc_feature (188)..(188): n is a, c, g, or t
  misc_feature (206)..(206): n is a, c, g, or t
  misc_feature (225)..(225): n is a, c, g, or t
  misc_feature (235)..(235): n is a, c, g, or t
  misc_feature (239)..(239): n is a, c, g, or t
  misc_feature (246)..(246): n is a, c, g, or t
  misc_feature (273)..(275): n is a, c, g, or t
  misc_feature (332)..(332): n is a, c, g, or t
actgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcagangctgttccggngccacagcaagacgcgcngagttcctggcgcacagcnccaaggtgcnctcngtggctnggaagttgccacggggcgtcgctaccnnnggggggggtccttcgacaagacgcccagcgtcttctgctggggaaaagaacccggcnttggtcaaagaaaacaat

SEQ ID NO: 574051 - DNA, 669 bp, Homo sapiens
agcggagcgtgagcccctcaaacctcgcggaactcctccctgcaaatggagccaggacgccctccctcatggtctgccctttaaccagggcagggtgacgtacggacctccacagtagtacgcggtcactgccttagcagtgaggcctcagggcccggtgctggcactggcctagcgtggactcgtaagcatggctggcgcctgactggctcgtgtgcgctcacagctgctggcggactgtaggtgcgcgcgcggtcgccatggcagcgcagccgccgcggccagtgggtgagaggagcatggggagctcccggtgaggcgccgtgcgccggcagtcccgtgttgggcctccagtcagccagtactccgggcgcgacctggcggtcacgcggatctccagaatctggtctccaaagattatctaatctggttggaacatccgcaaaatagtcctttatattgcatatctccagaatggatacgaattagacttggctagcagcaggaatccataacatgcggagcaccgttatgcagtagaagacgtacggtagattgattctccaaatttaaaatgtctgcttaaggtagatgtggtatacctcgtggagcgggttatatctgcgaacgctcaaacgataccctcttacttccctgtcatgattggcc

SEQ ID NO: 574052 - DNA, 154 bp, Homo sapiens
taactcacacatctgacagagatgttatggagctgctcaaggctgccgttgtttttgtatgttcagaagccctacaggtccttggagggtgggtttctcagtaccaacagtggataactgttggagactactgcaggacatttctttttctttt

SEQ ID NO: 574053 - DNA, 232 bp, Homo sapiens
tccagtacccgagcatgcatgcctgcctgcgggtcgacgtgtattcaccactgcggtgcatgcatccctgaacaagatccggcgacacgtgagaaccagtgatgacctccaaatatcgttaagctggagcctggacgacgtgtaatcaccactgcggtgcatgcctccctgtacaagttccgtcgacacgtgagcaccgtgctgacctccaaatatcgttaagctggagcct

SEQ ID NO: 574054 - DNA, 94 bp, Homo sapiens
taacctgttttatttcataggtacatgaggtatggtgtataaaaaaagagataagatttacccaacatcaacaaaataaaaacccaaaatagtg

SEQ ID NO: 574055 - DNA, 393 bp, Homo sapiens
gcacgagcacagatgatgtgttttcaaaatcaaatgattggagctcctcatcatcttccccggtaaactgctcggtttcagatccattatccagatacctcaacgggctagtgtacgcaattgaagggtacctataaaacaaagtacgttcctctttcaactgaaaaaacccccgataatcctttgacaagaaataatacataatataatctcgctttctgacaagacttttcagttcttggtactctaattcccgttcgaaaatcggatatgtgccagcaatttcgtcagttattatagcgtttataatagcctcgtagtcatcgggctcaattctattttcgtagttgaacagacggtaaaaagggctacagtcataattatgctcgcatt

SEQ ID NO: 574056 - DNA, 420 bp, Homo sapiens
  misc_feature (167)..(167): n is a, c, g, or t
  misc_feature (390)..(390): n is a, c, g, or t
  misc_feature (392)..(392): n is a, c, g, or t
  misc_feature (410)..(410): n is a, c, g, or t
tggtttaaaaagatgttttaattaagtaaaaaccagggaaaaccacaaaataaataagtatggataaatggataaaaagtacaagtcttcaccccatcacatcaacttttggcaaggatgtaagggaaatggatacattactgcattgttaaagtagaagtatattnttgcacagccactttggaagacaatttggctatatccatttttttttttttaaagacagagtctcactgtgtcaccccaggctgaaatgcagtggtgcaatctcagctcactgcaacctccgcctcccaggttcaagtaattcttgtgcctcagcctcctgagtaactgggattacaggcacccaccaccacacccagctaatttttgtatttttagtagagntntgggttttaccatgttgnccaagctggt

SEQ ID NO: 574057 - DNA, 423 bp, Homo sapiens
  misc_feature (49)..(49): n is a, c, g, or t
  misc_feature (306)..(306): n is a, c, g, or t
  misc_feature (317)..(317): n is a, c, g, or t
  misc_feature (320)..(322): n is a, c, g, or t
  misc_feature (423)..(423): n is a, c, g, or t
ccctcctcggcgtcctggtcccggccgtgcccgcggtgtcccgggaggnaggggcgggccgggggtcgggaggagtcacgtgccccctcccgccccaggtcgtcctctcagcatgggggtcccgcggccctcagccctgggcgctggggctcctgctcttttcctcccttccttgggagccctgggcgcagaaacgccaccctcctcccctccctgaaccaccctaccgcggtgtccctcgccctgccccggggacccctgccttcctgggtgccggctggctgggcccgcagcagtacctgagcnacaatagcctncgnnncgaggcggagcctgtggagcttgggtctgggaaaaccaggtgtcctggtattgggagaaagagaccacatgaactgatgtgacaatgtgatgaatgccccn

SEQ ID NO: 574058 - DNA, 373 bp, Homo sapiens
ccggggccagggcaccagcacatgttccacggccggcagcaacttttccaggggctccagcagctttaggggctcccggggccctggccggagccggagtcaaagccggagccagagccaaaggccaggacagaaaccccgagaggaaccaaaatgacccttgttggggcattgaaaatatcatgagtgccccggggaaggggagtagggatgtcttttcccccccaccagtgatgagtggggctagctgaagcccattggtttccccgatttcaattgggtgagaaggcaaagagctagctcctccctttttttttttttccccctgagacttgtttataaaaaacaaaacaataaaaagagtttggtcaga

SEQ ID NO: 574059 - DNA, 117 bp, Homo sapiens
aggaggacacggcgggccacactcatagcgagcctcggctgaagcggctgggcatgacgccgcctctctgacgtcccccatagatcttggtcatggagccaacccctagcgccaccc

SEQ ID NO: 574060 - DNA, 866 bp, Homo sapiens
  misc_feature (332)..(332): n is a, c, g, or t
  misc_feature (338)..(339): n is a, c, g, or t
  misc_feature (344)..(344): n is a, c, g, or t
  misc_feature (350)..(350): n is a, c, g, or t
  misc_feature (353)..(353): n is a, c, g, or t
  misc_feature (358)..(358): n is a, c, g, or t
  misc_feature (361)..(362): n is a, c, g, or t
  misc_feature (367)..(367): n is a, c, g, or t
  misc_feature (372)..(372): n is a, c, g, or t
  misc_feature (377)..(378): n is a, c, g, or t
  misc_feature (384)..(384): n is a, c, g, or t
  misc_feature (386)..(386): n is a, c, g, or t
  misc_feature (388)..(388): n is a, c, g, or t
  misc_feature (404)..(404): n is a, c, g, or t
  misc_feature (407)..(407): n is a, c, g, or t
  misc_feature (413)..(413): n is a, c, g, or t
  misc_feature (416)..(416): n is a, c, g, or t
  misc_feature (440)..(440): n is a, c, g, or t
  misc_feature (458)..(458): n is a, c, g, or t
ggaaataagaaattaattataattataatttcataaattataaacataattccataagtgtagtctaaaggaaaataagaaattaagctataatttttggaaaggcatttcattacgtaagtgcgtgggcatggctgtatcacagcaaatcacgatgaagcagcctaaggcttcatgtttgtttgtttttttttggagactgagtctcgctctgttgcccgggccggagtgcagtggcgcgatctcggctcactgtaacctccgcctcccgggttcgggtggttctcctgcttcagcctcccgagtggctgggattgcaggcgcctgccacnatgccnngctantttttnaanttttngtnnagacngggtntcacnntgttgncnangctggtctcgaactcntgncctcangtnatccacccacctaggcctcccaangtgatgggattacaggcntgagccactgcacccgtccgaggcttaatcttatgtgtagattcaccaacaatcttatatgtacatcaacagctgtaaatatcaactgatacaggtgtgctagattggcaacgcaaatacatgattttctgaaatagcaaataacttgataaagtttcaaaatcaaaatataaacttgcattcctggaaaattgtatttcttaaaacagtgcaaaaatacattgcattggtaagtaaaatggaatttgatcagataattataaggatatttttttcatctacctgaccgtggcacattggagaggtaggtgggctgtgctgtgtggctgcgtctcacactggacgtctaatgtccttgaccccctccgagctgagtgccagacacactcgccaaccactcccgtggga

SEQ ID NO: 574061 - DNA, 646 bp, Homo sapiens
gaccagtgttgatctgtaatgtaatagaaaatctgatagaccagcacttctggcttttttttttttgggtacaacaatgcaagatgctctgatagcattggctaacgggaccaggaggatctaaaaaggaccagcctaatgtagaagggggttattgggaccagaggctttagatacattatttatagatcctacatatacttttatcagtagaaggatttcattatagatgtataaggaaaagggatatggcaaaaattatgtaatagataccaaattagggaagttgggcaatttacaagggcatatctcagtcaaggtacacagatggcagtgccataagcaagtctataaatatcggtggaaagacatccccctacatttaaaatggtcggccctaataatcaaaggcagttaacaaagtatatgggctgtgtgtcatgaaatagttcaggttcagatggaacggtagggtaacggtagggtttatggagattatgacattgattgcccaaaaataagtcttagaaaatcctcaattttagggtaaatagtaatacaactaggtcattcatttggacatctaggagtcaaattgcaagatcccctagtaatacactatttaactaataggtttactgtacag

SEQ ID NO: 574062 - DNA, 601 bp, Homo sapiens
  misc_feature (1)..(1): n is a, c, g, or t
  misc_feature (67)..(67): n is a, c, g, or t
  misc_feature (73)..(74): n is a, c, g, or t
  misc_feature (79)..(79): n is a, c, g, or t
  misc_feature (85)..(85): n is a, c, g, or t
  misc_feature (88)..(88): n is a, c, g, or t
  misc_feature (93)..(93): n is a, c, g, or t
  misc_feature (96)..(97): n is a, c, g, or t
  misc_feature (102)..(102): n is a, c, g, or t
  misc_feature (107)..(107): n is a, c, g, or t
  misc_feature (112)..(113): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (139)..(139): n is a, c, g, or t
  misc_feature (142)..(142): n is a, c, g, or t
  misc_feature (148)..(148): n is a, c, g, or t
  misc_feature (151)..(151): n is a, c, g, or t
  misc_feature (175)..(175): n is a, c, g, or t
  misc_feature (193)..(193): n is a, c, g, or t
ngaagctgtgcccccattctggctctcaagagccttctatggacggggcgtggtggctcacgccacnatgccnngctantttttnaanttttngtnnagacngggtntcacnntgttgncnangctggtctcgaactcntgncctcangtnatccacccacctaggcctcccaangtgatgggattacaggcntgagccactgcacccgtccgaggcttaatcttatgtgtagattcaccaacaatcttatatgtacatcaacagctgtaaatatcaactgatacaggtgtgctagattggcaacgcaaatacatgattttctgaaatagcaaataacttgataaagtttcaaaatcaaaatataaacttgcattcctggaaaattgtatttcttaaaacagtgcaaaaatacattgcattggtaagtaaaatggaatttgatcagataattataaggatatttttttcatctacctgaccgtggcacattggagaggtaggtgggctgtgctgtgtggctgcgtctcacactggacgtctaatgtccttgaccccctccgagctgagtgccagacacactcgccaaccactcccgtggga

SEQ ID NO: 574063 - DNA, 738 bp, Homo sapiens
tagttcccacgataagaagacccgcccgtgcatccttgcttcttatatggctggagaaaaaataaacccccacagaccggggtgttattcccacatgtcggccccccctcaaggacatccttgtggagtgcttcacgtacgctaatctcttggcaccacacccttggtgggcaccctctgtataagtgccgttgggcacactcgtctccgtagacatattcttcgcgatatgtctctagcgtatgatccgccagagtttacgagtgccacaccacacttctgtcttcctccccctcaagggcggcggaacatataaatatatatctactgttctctctcgcgaccactttctgtgcgcgcccctctctaatcataggaaggtaaccatgagtgtgctctgtttctgtgttatcccatcctgttggctacctcactctcccaccttggtctggtgagatacttatgctccccgagacagccaccaaaaacgctcgcgagaatctatagcctttctcactgaggagagatgatcgggccgcacctcttctacgccgtactcgctccccgagtgacccccaagatttcctgctttctatttctccccgaaccctcacacagtgtgtcacaacacatctaaagaggtactccctctttttcccacctgcgtcattaacctttgccccctgatcatttaaaaacaaaaaaatattaagaaagcttctaccccacattaaacaa

SEQ ID NO: 574064 - DNA, 149 bp, Homo sapiens
taaaagtaacaataatgaaagattacttactgtttatatgtctgccactgattatttaaccagaatatatgttagaacgggctggactgatatttgatccttcttcttttaggaaaaattattataataaatattcagttctctgtaat

SEQ ID NO: 574065 - DNA, 280 bp, Homo sapiens
aagggcgggtatcgaaggatacggtgtggtttacatgcaggtaaaaggtctgctatcgcgacctaaatttgatggaaaagaattggagaccaacgcgtcggccaggaaagtatagagccgagcttcagattatcgattcgatctttcctttttgcgaatagcaaaatccttgatcgagaaacttgtgttgagagcttcattggccgcatttaaaaaatcctggtcgggagtcttaacctcgacccaattgatttgtccgaatgtttggtccaccccgcca

SEQ ID NO: 574066 - DNA, 197 bp, Homo sapiens
tacctggggccccgacattggggctggccccatctctacaagagagaatacaacacaatgggcaggcatggtggtgtgtgcctgtaatcccagctactcaggaggctgaggtaggagaattgcttgaacctggcagggcagaggttgcagcaagccgagatcacgccactgctctccagcctggttgagactgtctc

SEQ ID NO: 574067 - DNA, 675 bp, Homo sapiens
  misc_feature (132)..(132): n is a, c, g, or t
agtgtgacctgtaacaattcaagcaaaaatgaattttccctgattctagagaagaatcccctggtggagtatgtggaagagctgcccacccccccctttggtgggacctttgggggggagcgccgggagtanctttcttcttgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtaactttgctgaaa

SEQ ID NO: 574068 - DNA, 385 bp, Homo sapiens
aggcaaaattaccagacagagggaaagttagagagcgaaggagagttagggagcgaaataagggtcgtaggaaagtgtttagtcgaggacgacgcatttaggaaagttaaaagaaaaatcaacaaggggtcggtctaccattctaaggagctcaaagaggttacatacgacacgaaccctagtaacgaggatacgacaagagaacccgataacacggtcaaggcgtaggacgagaagagagtacatagaaaccgggggtgcccccgcggacgtaaagcccataggattttcctcatttcagaggcttaagggaacctatgggaggtcgtacggttttatgaagggataccgaagataccttccacgaggcgttttcggtaggtcc

SEQ ID NO: 574069 - DNA, 314 bp, Homo sapiens
ccgatatgtgagcacaattctagatgatgcaaaacatttattccaagccatgctacagaaagctactgttgatgccgatgatgtgcgataggaatccagtgccgcgctgatccgtcttttaactctcctcccccaagcgattttttattcgctattgcaaggcaaagaaatcaaaccacctttgccattgatcaagccatattcaggtcctaggttgccaactgatagatactgcttaacagctccaaaatataggctgcaatctttacagaaaaaggcatcaacttctgcgggaagaataacagacccgcggt

SEQ ID NO: 574070 - DNA, 136 bp, Homo sapiens
agatctagacgatccccctacattgcaggagttggagtagggtcactagtttcccactttcagtatatttcgatgtcagaaataacgcatcttaggaatgactaaatcagataatggcagtttactgctgcacaac

SEQ ID NO: 574071 - DNA, 175 bp, Homo sapiens
  misc_feature (24)..(24): n is a, c, g, or t
ttgcttggttacatgaggctgaangcctgctgggtgtgtgcccagattgttaaggcattctaagtcacgggatgagataggagttcagcacaagatgccggtcataaagagcttgctgataaaacaggttgcggtaaagaagctggccaaatcccacccaaaccaagcaacccct

SEQ ID NO: 574072 - DNA, 887 bp, Homo sapiens
agccaacatggcggcggaacgcggcgcgggggcagcaacagtcgcaggagatgatggcaggttgacaggcgggtcgagtctgaagaatccggcgatgaagaagggaagaaacacagcagtggctatctgtgccgacctcagtgaacagagcctgaaggatgggcgaggagcggggggaggaggcccccagaagaagaacatgagctgcctggtggacatggaaccccatccaacctggacagagatgcaagaggcatgtggatgtgaatcactatcgccatagggcaacgattgcccggaattggagactctctgcctccgcaaaaatttaattaaatgcatgagaatcggtgaggagctacagagtcttcgaagagctggatctttagcgaaaccagatcaagaagatggagaatctggaggcgctaacagagtctggagatcctagatatttctttaaatctgtgagaaacatcgacggggttgacaaagtgaccccgattgaaaaaatcttcttggtcaacaattaaatcagtaacattgagaacttaagcaacttacatcaactacagactgcaagagctgcggacctaaccggcatcggggcaacggaaaatatttggacccttaccagctgggaaggttgttcggggcaaccacactctacagctcgaacctggtgggccaccacccgtaagcccagagtagaaccgtgcacaactatgggttgaccggagcccggggccctaccacggtggactaggggggacaaacccagtgggtgcacagacacagatccacaccagagtgacactcgtcccaaccggagtggccaccacagcctagggtttggtcgcgaaagcctaacaaaatggtgttatgaggta

SEQ ID NO: 574073 - DNA, 332 bp, Homo sapiens
agccttcagatgggtgctcatcttgttcagcatcagaggatcactcaggagagaagccctatgatgtaatgagtgtgggaaggcctttagtcaaagctcattatcttaagtcagcatcggagaattcacagtggagagaaacctatattatataatgttaaagaatgtgggaaagcttaatggatggtgctcagagctcattagacatcggagagtatcatgccagaaaagagccttcccattaatatgaaggggagaacgtctaccaaacaaattctacatcggtctaatctactttaggactggatcccataataagttataagttcctt

SEQ ID NO: 574074 - DNA, 677 bp, Homo sapiens
acggcaaatgctgtagatccagaaactaggctatacgggatgtaacaaggatccagagttaagaatatctagaatattttataaactataaagctgcaacacatgatatttacgctctagttactagaaaactaaggaaagcacttatgagctctgaataaagtaacatggaaagcacttatactaatcgacaaaaaaaccttctaatgcattatcagaaagattttctaatacaaggaggcatattgctcagtcagaaggggttctataagaaaagcacttactaagttagcgactaacagaacaaccagtttaaagatgaattaaatgcccaattaggggaggcatggcaggtgtaagagaaaggaaaagcttaagaatacatttcctgataataccaacctttctttcatcatctactgcatttgacagaaattaaccttttagagtttatacccgtgaccactttcattccttgtacaatgtagtgtaaatctccacttcgtattttgtcaaaatactgtctttgtcctttgatcacacacaccccacccggcacaccacaggtaaacagaatcttcattagaggaaatagcagtctgttcacatcccgcaaagctggtcaaaactcgtataatcccaagatgtccaagactgagtgtacgccatccatacga

SEQ ID NO: 574075 - DNA, 172 bp, Homo sapiens
ttgggggggggggtttggggtcccttttggattcggcggttccggggggggggggggtttgtgccgattccttttttttgggggtttgttttgctgcttttccattttgtttccccgcccgggaaggggggggaaaagccttttttccccccccaaaaaattgtaacattca

SEQ ID NO: 574076 - DNA, 508 bp, Homo sapiens
cagaacacatctcataacagtagaattaccactattgttctacatggtgattcaattaacttatactcttactaacaataattcaacatccaactactctttctatcttccaacatgcaatataatttccttcattactagtaaatattttatttgtataggatttacatttcttctagtgtgctgtaagtaatatgtgttttgtgtattataattattctaaatgttagcattttttttcactttaaacattaatcctatgttacccaaagagtatctgaaacaggtctcaattaatttaagactttcttttgtcatgcttaaagacatgccagtgacacagcctcaggacgtcctgactacatgtgctccaggtggttggcctacaacttgcttgtatacattttagagagacataagatatcaatcagtatgtgtaagatgtacatttatttggtttggaaaggtgggacaatgggtaggggggcagtggagagtggggacttca

SEQ ID NO: 574077 - DNA, 335 bp, Homo sapiens
aacgggtgatgcggttgacaaccactgccctgagtgatccagctctgctattgaattaacgccaccatttatcacgcaggagacaggaccgagagaacatgtcgcagtcgctcttcttatgacgcccgtgaagagaggccacggtcagaacggctcaagcagtgctatctgacactcaatttaactcgcgagtctcctgaattaccacaagagagggcgtactgaatatgaaaagcagacaccaagccctggacttgacgttccttagcagaaatacactgtcaaaggagagatcgcttaagccgtggagtacgagcttacagagtgctacgatc

SEQ ID NO: 574078 - DNA, 426 bp, Homo sapiens
tccgactaggtacttcgtgactacagtcttccgcgctacaatacgtgctgactacgtacttcgcgactacgtacttctgagtacactacttccgactacatacttcagactacatacttccgactacatacttctgactacatacttccggactcctactaaaaaggactaccttaagagcatggaaaagtggcttactgacaaggaaacccccgaagagtaagggagggcatgtggacaattaagaagtgatggcatactctttaaacttataattaactacgtttacttatatatcacacgtaatacaaaacacagtctcttgcagaactggttcagattacttaaataccagatacatgattaggcctctacataagtgtatgggagttacttatgtttatatcggaagtatgtagtccggaa

SEQ ID NO: 574079 - DNA, 240 bp, Homo sapiens
aggatgtaggctgctgcaagacatctacattcatttacacgcattacagagacacaggctggggagggtaagcaactgctcgcagacataaagttggcaagtagtccagtcaggattcgaaccagctccagtgccctagttaggtccaaatccactcagatggggaaatggtgagtcaggcagaagcaacaaccaggggcccattcaggaaacatcaggcctgcctgaatctctagcaag

SEQ ID NO: 574080 - DNA, 291 bp, Homo sapiens
gtttttttatttctactgtcaatgatgtgcaaaccttttactggttgcatggaaatcagccaagtttataatccttaatcttatgttctcaagcttggattaatacatatggatgttactctcttgcacaaatatcttgatacatcaatttgtctggttaaaaataggtggtagatattgaggccaggatattgcaaatacatgaggcttcatgcacttaaggagtatttctggataggatttgcatcttcctgggaacttttctggattatttccactctaggcaggatg

SEQ ID NO: 574081 - DNA, 106 bp, Homo sapiens
gtcatagcatatactcacattacatacatttatatacaacatttatacaacaaactaaaatgtcataaaaaacaatcctcttaagagaatggcgtgaacccgggag

SEQ ID NO: 574082 - DNA, 154 bp, Homo sapiens
  misc_feature (21)..(22): n is a, c, g, or t
ttttttttttttaaatccccnngtaaaaccagaatcccccccccccccctttttttctaaaaaaacccttttaaataaggccaatggggcaaattttagggggggccccgtccccctgttaaacaaaatgccaaaaaaagtttttttttgttta

SEQ ID NO: 574083 - DNA, 123 bp, Homo sapiens
agatcccctttcatcccaggaagccagcccaagagggtgtcctctggcccatttctgcaaaaattctcaggccctcttcaggtgcaccgtgaccccattggctccatgtgagtgcagggcaga

SEQ ID NO: 574084 - DNA, 130 bp, Homo sapiens
ttactggtcgcagcggggttagcagcggaatcgcggggtatgctgttcgaattcataagaacaggaaggttagaacatagggtcttgagtgacaaaatattttgtgtagagttcaggctcttggtgaagg

SEQ ID NO: 574085 - DNA, 233 bp, Homo sapiens
  misc_feature (2)..(2): n is a, c, g, or t
gntcggactgtggtgtagagtgtagacatgatgtagtgacttatttatttattcggggtggagtctcgctctggtcgccgagctaaagtgcagtggcgaatctcggctcattgcaagctccggctcccgcgttcaagcattctcctgtctcagcctcctgagcagctgggattacaggcgtgcaccacatcacccatctaatttttgtatttttagtagaggcagggttttgc

SEQ ID NO: 574086 - DNA, 175 bp, Homo sapiens
tctgcagaaatacacagaaatcatgctacttgatggagtaacgcagtaagaatcctttacctgaccagttttactgcttcacttctatttgaattcccaatttcttcccagtaataaatcaagaggcagaggtcgggtgtggtggctcatgcctacaatcccagcactttgggag

SEQ ID NO: 574087 - DNA, 396 bp, Homo sapiens
caccagagacatgtactcaacaacacaaatacccgaccaaagtctttaagaaagcaaaagaggccgggcacagtggctcacacctgtaatcccagcactctaggaggccaaggtgggtggaccacttgaggtcaggagttcgagaccagcctggccaacatggcaaaacctcgtctctactgaaaatataaaaattagccaggcatggtggcacacgcctgtaatcccagcagtttgggaggctgaggcaggaggctcatttaaggtcaggagttcgagaccagcccgggcaacatggcaaaaccccgtctctactaaaaatacaaaaagttagccaggtgtggtggtgcacgcctgtagtccaagctactcgggaggctgtcgggctagtcgggg

SEQ ID NO: 574088 - DNA, 857 bp, Homo sapiens
  misc_feature (94)..(94): n is a, c, g, or t
gagtaccagctccccactgccctgagggcgggcggccctgcggcggagggaaaaaggaagaggagaaggaaatggtcccgaatccctgcagtgngtccaggcctctcccgggtgccagtctttctgtaggtgcggcacaacgccaggcaaaagaagaggaagggaatttaatcctaatcggtgaaggtcgattgagggtctgctgtagcaggtggctcgcttgaagcgagggaggaagttcctccgatcagtagagatttgaaaagattgttgggagtggcacaccactagggaacaaagaagaaggggcgaactgcttgtctctggaggaggtcaaaccccagaatcagctcttgtggccttgaaagtggctgaagacgatcaccctccagaggtttgagccagtcccacagcttcctcccccagctgagtgactactctattcctggggtccctgctatgtgtcggggacgaatgggcatgggtacgccgaggaaaagtaggctggtgaccgcagcctgatgatgggggctgggcctgctatggcatttatagactgcctaggggaagaaacgacccaggaaaaattggctgagggtgcatctggggatgtgatgatgctgggactggtccggggccggattaatgactggtctgatgatgatgctgacgcatgagagcaggagtattttggaccacctgggtcgattggctgattgacgacgtagccagagggcaggtaccggcatgggggcgaagggtccatgagaacgctgcccaagaaagttgggggaagcgaacattgacgattgggcggggcacaattggggcggagaccaacaaaaagtgaagcaaac

SEQ ID NO: 574089 - DNA, 1153 bp, Homo sapiens
tgcagaccttcgatgcgcaccgtggccctggggacctgtggcagccctccaaggtggccaccaccagcgtcatcaccatcgtcaatgtccaccgagctctcctccacctcctgtgcccattcatcgtgcgttgcagtccatacgttgcctgtgcctgtgtgtggctggtgggtgtggctgtggctggctgtggctggcgtggcaggctgggtgggggcacattccctcgtacctgtcactgggatgcagacatctcagacatccgagtccaagcgcaggccccatcgaggcgcaggcagtcacaccaggaagagactgtattgcagggtgaagagtgggctcccgtgggcccagagctgcacgccggtccacagacacactcacgccctgccacctgctccccgacaggatgtgtctgtgtagtgggaattggtatcttgcacccgtgggagtcgggacatataatggaaaggccctcgggaagttccgcgtactctgattgggggctgccggaagacacggccccaggagtcagagccctgtggtcaggtctagcatggggctggataccactcctgctgtaagcaaacttcgacacctgtacctgcaacggactcccagacggtgcggtgagaccatcaatgccctgaccggattctgcagacccccggcgcaggagcatggatggatagtggccaggaaggcttccgatcctttccagattggtcacgatagcagtgcaccgtgaacccgggcatgacaacaagcacggggcatgagtgaatctggcaccaagtgatgacacgagccgcaagcagtaaaagatgagaacgcgtgatgtgaagagacacatgggcagtccaaaggcaagaaggagtgaaaggagtagcaagctcgaagagcgggaccagaggggcagagcgcatgaggaccaccgaatggaggaaagaagcgggcacaagagaagagaagtaccccaggagacacagggaacaccaagaaaggcgtcgacgcaaaccgcagacaacccgcggacaaaggaggaccagccccaagaaatgagaccaagaaggcaccgaggaacaggaagaagagaaggccaacattacaggaggaaacaaacaagcgacaggacacacacacaagcagaagg

SEQ ID NO: 574090 - DNA, 111 bp, Homo sapiens
aagcagatcgagaccgggcccttcctcgaggcggtgtcccacctgccgcccttcttcgattgccttgggtccccagtgctgttagaataaaaagcctcgtgtcggaaaaaa

SEQ ID NO: 574091 - DNA, 325 bp, Homo sapiens
aattcgcggcgcgtcgacacggctgcgagaagacgaagaagggcactcaggaggctgaggcaggagaatggcgtgaacccggaaggcggacttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggagttgcatgagctgagctcataccactgcactccagcctgaacagagtgagatcctgtc

SEQ ID NO: 574092 - DNA, 647 bp, Homo sapiens
catgatggcccacacctgtaatcccagcactttgggaggccgaggtgggactcttgaggtcaggagtccaagatcaccctggccaatgtggtgaaacaccatctctactaaaaatacaaaaattatctggccgtggtggtgcacacctgtaatcccagctattcggaaggctgaggcaggagaatcacttgaacccaggaggtggaggctgcagtgagcagagattgtaccactgcactacagcctgggcaacagagctaaactccgtctcaaaaaaaaaaaaaatcggcgttagtccaagaattgaaacctttcggcttctatccagctgagtaattaaaaggtctaattaatagcaaatttagaaaataaattatccccggtggcatacgggtccccggcatcatataaaagggtccatatgcttcacatagtatccctgggtgaatttaatactgaactgggggaatcgggaatgaataacgtggaggtgtgcagaatctttcatcttcagccataatattttaacttttgaagacaccaaaagaacgtccatggtagagcaaactggcccttacttttaaaaagatcgacttttcaaagttcacaacttcctcccaagacaaatctccaggtggtccccacta

SEQ ID NO: 574093 - DNA, 224 bp, Homo sapiens
cgcttggtaccagctgggcaacaaggtgagactccatccccagaaacaattaaaaacaaacaaacaaacaaacaaacaaacaaaagcaagctgggcatggtggctcacacctgcagttccagccactcaggaggctgaggcaggattgtttgagcccaggaggtcaaggctggagtgagctgcgattctaccactgcactccagcctgggcaacagagcgagac

SEQ ID NO: 574094 - DNA, 630 bp, Homo sapiens
aagtgtcttggggtaccctgccccccccggagtaatggatatgtcgaaccacgcgctcgagactgtgcctgtcgcatcctggtgtacaggtacctgtcggtggttactgcccacgaaggcagtgtgcccccaccactctcctccagacccaggtggggaccagcccctcaccacctcccagtgacaccagccataccctattgcttcctatggcctccaccacaacatagcctcctaaagcgacacatcgtcgtcatcagactgtctgtgaatgcagaccccgacatcccagcgagatctggaggtcatgaaactctgcatccaggttattaagttgaaatgtggcttcatcactattccttggacatgtatcacaaaaatgcagatcccctctatgccaatgctggaaggttctgcactacacgactcagtgtctccagcgccctctacagcacaccgtgccataccacaatgagcatccaagagcccctaccacgccgtaccaatgagtcggttcaacgcctacgtgatggagcattggtgtatggatgtattgcagccatggtggtggagaacaccatgggacgccatattagcgaacgaggagtgaaggcaggagcagggccgtca

SEQ ID NO: 574095 - DNA, 309 bp, Homo sapiens
gccggaccggcatactggacttctggtctcctacctcatttccccatcagagattatatactcctccttaatcttaaggggcttgcagaagggcggaggttcatcttctgtaactgcttcctgctgatgttatgtggcatatgaccctgcctagcactggatgaggtaaaatccctggtatacctgtgctaaaagaggccaaagttagatgtctttatcttctgggtcagaagaggggatgggttgaaagacttgtgccagcatcatctttacatgggattattgtaatctggagaaggtcccggtatg

SEQ ID NO: 574096 - DNA, 264 bp, Homo sapiens
tcgactcatagagtgatcccttttagctgtccaccagtttcccggtcaggtatacacggatggggctgaggcgggggagaagactggggaggtggagagggctggagccagatagcgtcctgggagtgttgaggagagaggctgcaggccccatgagcacagcgtgggactagtgcccattcggtgggccatgtgggccactctttacccacggctggtggaccgcagtctgctgccacagtccaacggaggtgctgacaggtt

SEQ ID NO: 574097 - DNA, 210 bp, Homo sapiens
tgtatcttagaaatcagtgtgatatattgctatgctgtgagttcgcccaacggtcttggagtgcagtggcacaatcttggctcaccgcacccccgcctcccggggttcaagcaattctctgctcagctcagagagcggggtgcagcgctcacgcacacagactaaatttatttagtagagcaggtacatgtgcagctgctcacctgacta

SEQ ID NO: 574098 - DNA, 971 bp, Homo sapiens
gtcagctccatttggggaccagagccatccagaacctgagtcctggaatgcagcccagcactgccaacaggaccggtcccaaggtgggctggggccaccggctggatggcttcccccctgggcggccttctccagacaatctgaaccaaatctgccttcctaaccgtcagcatgtggtatatggtcccgtgggaaccgtagccatcagtccagcgtactcgccaaccgtcatctcgccagggtgagaccgctcaattgcctggagattggatagttcccgcgtgcgtgccactgcgcgcagcctagcacaaagccgcctagatgtgtgccaaactgtgtggtgggaggaagcaatgagcgcgattctgtgaggccgagattctcggtcaagacccgtaccccactggttgtctgcatcgcggcctagggtggaggctcggattctcctagcgttcgcaggaggaagctccccgagccgacacctaccaggctccgggtcctgctcccagccatcagcctgatattgtccatcgggtcttgagctggccttaccctcctggggtggccacattggacagatatcaagaacatctgccgatcctgaggcgcttccgtctctgtgccacgcaaccctgccagctatctgaccccctagaaagggagctgctggcactgatccaactggcagagggagttccagcgctgctgccgccaggggaacaatcacacctgtacatggaaggcctgggaggatacccttgacaaatactgtgaccgggagtatagctgtgaagacccagcacacttgtgtgggcccaaaccttcccagccctaactcgggatgagtggcttggccgtcgggccccttacccccactatgaccgggaatttcttgaccattggagatcagcgaagtcaccccaacctcatggggccactctgtggaacccaaagagttctcacaagcgtac

SEQ ID NO: 574099 - DNA, 332 bp, Homo sapiens
tatatatgacgaactactagtcccagtatatgactcactatcggggaaacactatgtcttaggacagagggaaatacaaggtgacacacagaatttaatttcgattcttatgggtatgagtaagcacctaacacctactaaccaaacaaaattcttcttcccttcagagattcttggtccttacccaaaacaccccttgcaacaaccacactaccctgttaccagaccctgcctgcagtcacattttccatctcatacttttattcactacaaattccaaaactcttgaagtatgaatgactgattctttttttttttttttttgggaaatg

SEQ ID NO: 574100 - DNA, 131 bp, Homo sapiens
gtcagtgctgtaggaagtcagaccactattactggcaacaatccaggaagccaaacaataacccccataataattagcccgaaatggccaggacttgattcataactgatagcttcccatatgtctgtccc

SEQ ID NO: 574101 - DNA, 253 bp, Homo sapiens
agtcgtgtacgggtctctggtcaggtccttcacgaagtgccacacctttgcgcctgcagagtttatcatatgatacccgcgcatgcaggctatggtggtgctccgcctgtccattgagggccccagcaaggtggacatcaacacagcagagcaggaggactgggacgtgcagggtcacctactgccccacatgagccaggcaactacatcatcaccagcaggacttcagccgagtaccgagcacgactatcgt

SEQ ID NO: 574102 - DNA, 684 bp, Homo sapiens
  misc_feature (47)..(47): n is a, c, g, or t
  misc_feature (102)..(102): n is a, c, g, or t
  misc_feature (104)..(104): n is a, c, g, or t
  misc_feature (212)..(212): n is a, c, g, or t
  misc_feature (443)..(443): n is a, c, g, or t
  misc_feature (598)..(598): n is a, c, g, or t
  misc_feature (602)..(602): n is a, c, g, or t
  misc_feature (638)..(638): n is a, c, g, or t
  misc_feature (641)..(641): n is a, c, g, or t
aaggatcagttggtagagcaatgactgttatcattgggtccctggtncgagtcaggtcgtggagccagatagagaaaagcctgtagaaatacaggctttttntncttgggatttgacccagcaatccagacgcttagcatgacgccatctctaatccttcgattcagaggtaaggccaatgaaagtcgctgcagtcgtttcaaccaaaggcnggccggggaaaaccgcggttggcgccaatctaggcgcgttctgcgccgacgcgtgtcattgaccttactgatcgatctcgatcccagccgtcactgtccttgttctatacgctaatgcgtgaggcgccgggcgggacctaccaactgatcgttaataatgaaatgcctccgcggagcgctttcttctgtcggtaatgaggtgaagcgctgagcaaggcatttgataaaatngctagcgaatgtggccgcggaagtatcaacggcctttaataattcactattatgaaaaactatgatcagtgcataggtgtagacgctaattcaaaaccaccattgataacgaactgaacgcccatacaaaccagtagaaaaccaacgactcgggnaatngcatcgattcctgactcaccaagcactttcatgatncgncccgaacatcttaagctatccagaaaataagcgcagtaatgat

SEQ ID NO: 574103 - DNA, 171 bp, Homo sapiens
aggccttaggtgctgttccatgggaaagatggtgttggtgtcctgcctgtctgccccagcccagatttccctgtgttattccatcatttttcatattctggtggcccccacccctggaggagcccagttcgtttgagttagttaagttgggtaataccagcttaaaggcag

SEQ ID NO: 574104 - DNA, 386 bp, Homo sapiens
tacctgcatctgtgctccaatctagcgctggccctctggacacttatgaactcttaacttgtcttttctcatccctttgaccccgccagactgtgtagccctcaggcctggtgttgggcccgatcacctcaacatcccattgtgattttaatttgcattacccaaaaggctaataatgttgaacatcttttcatatgcttacttgctacctttataggtttttcttttagcccattttcttttctttcttcttcttttttgtcttaagtgcctggcttatttcactcagcacaatgtcctcaagattgattcatgtagtggcacatgtcagaatttccttgcctttgaaggccgaataatattctgtgggaggcacagattgcagt

SEQ ID NO: 574105 - DNA, 702 bp, Homo sapiens
gccgaattcggcacgagctcacctcctctcactgctagaatattcaccaagggtttgcatttgggaagtcccttaccagctcctgcttagagctggtagggccatacatgtccacactcccaactggtggctctcccgctgaatggggcctcagcaggtgcccaggctgctacaaccttggccactctgtttctccaccccagcactgggcatggtaattagcctttccccatgttaatttattcagttttttcacgggtcaactgaattccccacttcctgggtaagaagcatgatctcctttaatttcacgtctaagatcctggcagcttcccctagctggttcctctgtagtcctgctgggactgtcagctcatttaaatgtggggctgcagaatgctttatgtctcccccacccccttaccttttacagaggaacctttcatcaggaataatgaatattgctgccctgggggctttgctaatactggtcataccttgagaggagaggtatttgaaccttttctttatgggtgaccttctcaaattttaaaaattggttatggcttaggccccttactggttaacatggatgaagtctaccaatactccggttgggaaaccttggatgggtcttgtcaacatttaagcctttaattcccttaccttgttacaattaggggtaggcctacctttggggtg

SEQ ID NO: 574106 - DNA, 930 bp, Homo sapiens
ggaaagcggagcgtccgggacgcggcgggactcgagtgtttcggaaaaggagcgtctccccaggcggtggttgtcttcactagcgatggggtaaaaggaggacgcaatacctggttcaacttgagcagacggagtctcgctatgttgcccaggctggggtgcagtggcgtgatctctgctcactgcaagctccgcctcccgggttcacgccattctcctgcctcagcctcccgagtagctgggaccacaggcgcccgccaccacgcccggctgattttttttatttttagtagagacggggtttcaccgtgttagccaggatgatctcaatctcctgacctcgtgatccgcccgcctgggcctcccaaagtgctgggattacaggtgtgagccaccggcctggcgagcatgttaatttaagcaaatgaatgtccctgggaatgatcttcaaggagaattaaagtgggatagagaagtcatctatctgcacctgtgtctgaaccagaatgacgaggcacttccatgtcagctagttactggagcaggcggagtaaggagtacccctgggcttctgccccgaaacaccacggtacttcaaaacaatattacattaatttcctgcttgttcttgagaacgcactggtttgaaaaatcggatggggtgatacctgtctcatccgtcatttaccaagctcctttaatcacttcctccagaccattccttgagcactactatgtgccggcagggtaattcattgagcccctgctgtgtggccgggccgttggaggactctagcaattattcctaggtccgcgcctggtaactcaacaggtaccaatggcggttctggcctggttcgcgaacaagaggcgcggcccactagccaaagatcccgcgcatgaaaccgggcggcatagacaaaccgcgca

SEQ ID NO: 574107 - DNA, 727 bp, Homo sapiens
gcacgactctgggagtggggaaacagacgagcggtcctctgctgcagaagtcctcggggtggcttctcacaagtctgcgaaggggaaagggttgtgagaccaagcagacccaactccagctcccagcaggaggtggctgcgccacactcaggaggcctcttggtttcagggtctctctgtctctctctcagcctcttcctcgcttctctgtctctctgtctctctctctctctctccctcgtcgactcccccaaacatgtccaccggctccctcagcgatgtggaggaacttcaagaggtggagatgtgggaatgtgacgggttgaaaatggattcgaacaaggaatttgtgacttgcaacgagagcaccgaggagagctccaactgcgagaatgggtctccccaaaaggggcgcagggggctgggcaagaggaggaaggcgcccacctaagaagagcccccctgagtcggggtctagcgcaggaggggaagtcaggtccaatcgcaagcaggcgcagcaacgcgcgagagcggtgcccgcatgcgagtgctgagcaatggcttctccagactcaagagcagcctgacctggtgtgacccccagacagcaagctctccaaggctggtagcacgctcaggctggagtccagctacatcgcccacttgaggcagatcctggtctaactgacaaataccgagaagcgggtacattcacccggtcaagctg

SEQ ID NO: 574108 - DNA, 107 bp, Homo sapiens
gactctagatgatcccacctggcctcccaaagtgctgtgaatacaggcgtgagccactgtgcctggcctgtcaagtattttttaaaggtttattctgagccaatatt

SEQ ID NO: 574109 - DNA, 308 bp, Homo sapiens
ggaccgattcacggcaggcttgtgatattagattttttaaagaagcaatatagaagttagattttaatcaaatttgtatgggtttctaggtaatttttacaaatatgcttgttggcttcagctggtctcctaccgtctgctcttggatggagatggggacggggcgtggagttcaaaacactgtgtaattttgtatctctgattgtcttgagttaagagctgctgaagaagttattttattatcttttatatataaggaataaatccccgcctttagttccttcatttcagtctactgttccgggggt

SEQ ID NO: 574110 - DNA, 283 bp, Homo sapiens
gaaggcacctgcatgttaaaacaagccagtacagcagcaggagcacccacctgggctgcctgggactattaattggagggaaatccaaagatttgtctgtttcaggcccttagatgtaggctgtctttgtgacagcatccttctacccaatcgtgcctccaccctcctcttgcctctctgcattcccagacagcgctccacagtgccctggtggacctcagaacaggcctgagagcagtgatgtgcaccagaggctgtgttctctaggtcatgggaatgggtt

SEQ ID NO: 574111 - DNA, 294 bp, Homo sapiens
tagcagtgaggatgaacagagatcactcttgtggccatcttggttttggtgggttttagctggcttctttattgcaacctgttttgtcatcaagatctttaagacctgtatcttgtgttgacctcctagctcatcctgtgatttggaatgccctaaccatctggaatgcagcccagcaggttttagcctccttgtacccagcctctattcaagatggagttgctctggctcacacgcctttgaaaatttcccaaaaccaaggcggctattgcaaaactaccaaatatgtaaaaa

SEQ ID NO: 574112 - DNA, 246 bp, Homo sapiens
cgatataagttcgagagtagcagtaaagtttggcgtagttcaagtttatgtatcagggagtatgagtagatgcatagattgtgcatacaagcagcagcatcaattgtcgaacattttcatctccctaaaaataaatcccatacccattagcaatcatttcccatttctccccaacctccccccaactgcagtcctaggccacctctactccatgttccattttcatgcatctgccactgcttggtg

SEQ ID NO: 574113 - DNA, 939 bp, Homo sapiens
ggctttccaggtcttctcccggtgaaccggatgctctgtcagtctcctcctctgcgtcctcggcgggccgggtcctcgcaaagccgtgcatcccggagtgcccagccagcgggctcccggaggctgcctgggcagtgcgtgtgcgcggtaggagctggggcgcgcacgggtaccgcgcgttgggaggagaccattgcccttgccgcgatgggggcccggggcctctccttcaccgcggtaaggcaaccgggcgccggcgttggggtaccctgcccaaccggggagcttcctttcctttctcctggtggctgctgggcacctgaaatcccagctgccggggagcacctggcaagcaacaacggggacgaacttcttttaagcgttgcaccaacgttcgcaagcgcagtcgtgtagggaacgtggggactcccccagacgggctccaaatcttcccggaagcgtatgtgtggatctaacgtccggaaaacaatttattagacggtgcaccccaccccttcgcgaaagagatattcccgttgaattgggtctaatggttcaccgtgcatccttacaggccctcacagggggcaaggtgtccctgttgctgccaggcacaacgctaagtgtaacaattttccacattacttgcgggaacctccctgggcgcaaatacactctggctatgggcacaaagcccttcttccgggtatggggtggccctactgactcgaggggaaccgaccgtttaccagcaggcttcagcgttgacactctgtcccctacaattcgcagtgctttttcgctccccagagggcgagcccttaagaaacagttgatcttttggccccccccaaagcatttgggttggcgacctgggcacattgacatggtgctgctggccagaagcgggtccatatccggtagccaccccccaattag

SEQ ID NO: 574114 - DNA, 920 bp, Homo sapiens
gttggttgtaaaactatgcaatatgattaaacctgacataaaactgcacacagaagcaataaatacgcggtatctctcgtaatccgggttttttcccttgtaccggggaaacctccaccaagggctgcccccaaaggtgttcccccccaatataccgtttcggaaaccctctgttattgccctcaatatattccgggcggacccttgtggtgcccactccccaatgcccaaagcattgggacttctttaggtttccctcaaggttttgtaaaaagatcgtcttcctcacaccccgagccctccgtctccggtaagcccaaggaacacgccgtgcctgcccaccgggccccccgcaggttgggcagagaggagagccctttgctcctacctcctgggtaaaaaggtccccgtggcaacccgcggagtcctaggcaagtcaaggttaccaaaaagggggggctgctccccacagaccttcgtgggaggcccaggccgattcttcttcgagcaagtatgcgggtagaaatacaaacagtctcggcaagatcctggcttggtgtcacaattgtggcacaacttggggaagccaatcttcagtgcaatcttgcgctttctatctccaccaaaaaacacccgtcatgtcggtgttctctattactccccacgataggactttatcggtcttttcgtaaaagaccatcgcatgcccttgcagtcttataatacaaaagcaatgcttccatattctagaagatcttccgattcaggtcttcacatccctcccccatgtttaattgggcgtcttgatcatatcttggaagatgcgccccaatttcgcaccccgtttacgcttgccgtttaaaaacccgaacgtgaattttcccccagaaaatccctgttcaagtaacccaaacataaca

SEQ ID NO: 574115 - DNA, 119 bp, Homo sapiens
cgtgacagctaccgtttcatcaacgaacctgcacgtgtcaccagaagcgctgcattgattgttcaggccggcgccaacatagccaatcgttacgcctgcagcggtaatatggccattat

SEQ ID NO: 574116 - DNA, 118 bp, Homo sapiens
agccggcccgattagcccgcagcagagctgcaggtgtctgccgcgacaccgaggttcagctcatctcgtctctttccggaacctccacctcagcgctcccaaatctccgctgaatgat

SEQ ID NO: 574117 - DNA, 195 bp, Homo sapiens
  misc_feature (65)..(65): n is a, c, g, or t
  misc_feature (86)..(86): n is a, c, g, or t
  misc_feature (111)..(111): n is a, c, g, or t
aggaagggtaggggagtagtgagggtttaggaagattggggttggggaaggatagtaatagggtntgagtctttgggtaggggggnttagggggttgtaaacattgaccanttttagaaggggatgggggtgggagagggctccccttatacttcctcacagggttaaggcctctccaggctcatgggtcgacgc

SEQ ID NO: 574118 - DNA, 406 bp, Homo sapiens
  misc_feature (218)..(218): n is a, c, g, or t
  misc_feature (311)..(311): n is a, c, g, or t
  misc_feature (374)..(374): n is a, c, g, or t
  misc_feature (393)..(393): n is a, c, g, or t
ttccccggtttttaaacccgccagaatcatagggttactcattgtcgcaacttgcaaggtcgtctctttttgttgctgatgaaactgacctataaccgaagtaatatccccagtgccgcagtaggtagtgcaccaaccctgacgacatcattattaagaccttctttacgatgaagcgaccgtccggcagtgttgatggcgtcaagaactctgactgnatgcgttaaaaattgttcgccgggtaaggtaagttgcgccccctgacgaccacgctcaaacaagcgagcgccagtcagctgctccagttattnaatgtttagagagcgcaggttgactcaaattaagggtttcagccgcgcgccccaaagtccttnttgtgcgacactacgaatntatgaaggtggcg

SEQ ID NO: 574119 - DNA, 187 bp, Homo sapiens
agtctgacgcttgtgattaacaggccaaatagaacgctggggactggtggagtcctctagaggaaaaaatgatgaacagatacatatgagatacctgctacagttatatgtctacctagttgttagaatgtaggaagggttttccacatatattatcttgtgtaatcctcacagtaaccctgttcaa

SEQ ID NO: 574120 - DNA, 100 bp, Homo sapiens
acggccgtgtattactgtgcgagaaccctttattttgatagtagtggcccaggaaatgatgcttttgatatctggggccaagggacaatggtcaccgtct

SEQ ID NO: 574121 - DNA, 883 bp, Homo sapiens
gcactctccggccggccgcctgcccgtcggctcctccgtgcgccgccagcctcgcgccgcgccgtcaccatgagcccggcctactcgtccagcgcagctggcgtgtcctcctagcgcgcaccttcggctggggccccgggcttcccggctcggctccccgagtgagctcgcccgtgttccgcgctgggcggcgctttcggctctcatggtgctcctgccaagcctcggtgacagtacccatagtgtacccaggtgtcgtggcacgtcgaggcagaggccgggggcctggggtcgctgtgggccatcacggcaggggaccacccagaacagaccctcctccttacgagcgcagtagatgaaaatgaccggatcatcccttatatgctgaggctcggtagtctacatttctgattaatgccatgggttaacccttgcaactataaagtgacattcagagccaagacatgacaagtagaccacaaacaaggcaacacaacatacaaacaaacaaaggcacgaactcggcagaaaagaaaaacagcaagacccaaaagagcaagacaggaacgaacaacacacacagcacataggcaaaaaagaaagaaaccgaattgagagaaacgaaaaaaaaaagaaaacaacagacacaaaaaaagacaacgacacgaacacaaatcaaacaagaaaccgaaagagaaagcaaaggcaaacaacaaataacagaaaaacaaaacacagaagacaaacacaaaaaaaacaaacaaaaaaaaaaaacaacaggcaaacgaaaacaaaaacagaagaaaaagaaacagtgcacacaaaaacaacaaagaaaagcaggaacaaaacacaacaagaaacacaaaagaaagaaaacaga

SEQ ID NO: 574122 - DNA, 553 bp, Homo sapiens
  misc_feature (485)..(485): n is a, c, g, or t
tgagcaagcggggaaggggctataagaaactacttcttcatcgtccggagagggtgacgggggtcactacaataagtggaagccagggtccgccttagtacgcgccgggccagggctggttgttcagtcaggcaccaccgccttgcttgtggtcacacatcgggacatgaatgagaaggaactggaagctcaggaggcacggaagtgcccagctagaaaaccacgaacgggaggaggaagaggaagatggagatggagacagaagagaaaggagggtgggggctcagatgaggagcaggagatgtggcagcagcagtgagagggagggcagtgaagatgagcacttcgggcagcgagagtgaccgggaggaaggtgactgggacgaggccagtgacaagagtggctgtggtgaggacgagagcagcgaggatgaggcccgggctgccctgtgacaaagaggagatcttgggcagtgatgctgatnctgaggaggatgccgactctgatgatgaggacagaggaccggcccaaggtggcagtgacaatgatcag

SEQ ID NO: 574123 - DNA, 779 bp, Homo sapiens
  misc_feature (18)..(18): n is a, c, g, or t
  misc_feature (62)..(62): n is a, c, g, or t
  misc_feature (64)..(64): n is a, c, g, or t
  misc_feature (104)..(104): n is a, c, g, or t
  misc_feature (141)..(141): n is a, c, g, or t
  misc_feature (146)..(146): n is a, c, g, or t
  misc_feature (170)..(170): n is a, c, g, or t
  misc_feature (188)..(188): n is a, c, g, or t
  misc_feature (206)..(207): n is a, c, g, or t
  misc_feature (213)..(213): n is a, c, g, or t
  misc_feature (218)..(218): n is a, c, g, or t
  misc_feature (221)..(222): n is a, c, g, or t
  misc_feature (298)..(298): n is a, c, g, or t
  misc_feature (313)..(313): n is a, c, g, or t
  misc_feature (315)..(315): n is a, c, g, or t
  misc_feature (322)..(322): n is a, c, g, or t
  misc_feature (327)..(327): n is a, c, g, or t
  misc_feature (334)..(334): n is a, c, g, or t
  misc_feature (338)..(338): n is a, c, g, or t
  misc_feature (343)..(343): n is a, c, g, or t
  misc_feature (362)..(362): n is a, c, g, or t
  misc_feature (372)..(372): n is a, c, g, or t
  misc_feature (376)..(376): n is a, c, g, or t
  misc_feature (394)..(394): n is a, c, g, or t
  misc_feature (398)..(398): n is a, c, g, or t
  misc_feature (466)..(466): n is a, c, g, or t
  misc_feature (558)..(558): n is a, c, g, or t
  misc_feature (588)..(588): n is a, c, g, or t
  misc_feature (591)..(591): n is a, c, g, or t
  misc_feature (668)..(668): n is a, c, g, or t
  misc_feature (715)..(715): n is a, c, g, or t
  misc_feature (761)..(761): n is a, c, g, or t
ctcgaacacgagcacgcncagctcccgcgcgtgggccagcagcagctcaaagtccacttgcnanaggaactggttatacaggacaccctcagtgaaccggagtntgtccctttccagctcccagagccggatctggtcggngatgnaagggggcagcacaggtgtctgtntgaacatcactgggtggnctcttgtacttaggaaannaattanatacnggnntgtgatgccactggcgattgcatgctgcacactctcccgggtcacctgcgccaccaccatgtaggggaaccgatanaacatctaaaaaaananggaaatnagggnaatctgnagcnccgantccgtgtaggaataaagtnggtaattagnttcnacgaaaataaaacctggntgangcaaagtgcccccagctccagaaaaacctgaagagagaatgatggccaggagtgtggggtagtaacgncgagatttcctcttcctctggaaaacaagcccaaactcacgcagatgttgcaggaagttcaacagagaatcactcataccttccacagagtnatccttgcccagagtagagaagctgagctngtngaggaaggagagatctctaccaggtccatgccccggctctgggctgtctgcaaatactgcaacataaagtaccaganctgagccggggtggtcagccaacaggaactggaagccagcggaagtnatgcagggcggctctccaggttcagtactcttcatgagcccagctngctgaggagctgagccaa

SEQ ID NO: 574124 - DNA, 117 bp, Homo sapiens
ggcggggcgaatgaggtcactcatgggaccttgagcaagtcacacggctatggacacttctaaaagtaagggctatggaaatttctaagaattagggggtccggagctcgatatcgt

SEQ ID NO: 574125 - DNA, 371 bp, Homo sapiens
gctttttttatgaaatgtaaagaaagaaccccctttgtattttttgtaatcccccctttgtggccaggcctgccccgcccactttgtatatatgtaagttaaacccgggcaggggctgtgcccgtttttgtactttggtgatttttaaaaattgaatctttggccttgccttgattgtataataattttgagcccaggtctcgctgtgttgctcaggctggtttcaaactcttaagatcaagcaatccgcccccctcaccctcccaaagtgttgagttcccaggggtgacccccccccaggcctgattgtaatttttttttttttttttttcctggttatgggaagggagaaataaaatcctccaccccca

SEQ ID NO: 574126 - DNA, 212 bp, Homo sapiens
ctgtcaagtagctgacgactacatggtgtgttgccacacacccagctcattacgcgtatcggggagcagagagggggacacaacatgtcgaacagacagaggtggaactcctgatctcaagtgatccacccgcctaggcctcccaacatgctgggatcgaaggcgtgagccaccacacccagcctggatcctctgatcttattacaatatgc

SEQ ID NO: 574127 - DNA, 200 bp, Homo sapiens
tatatcatttctcacctaatgttcttcacatccatagctatcaccacagcaaatccatagattttggtaaacattaaagcagcgctaggttttcaaattactatcattcattatgatctttgttttgtatgaaatgttgaaatgtttgagacagagtctcggtctgtcacccaggctggagtgcagtggcgcgatctctg

SEQ ID NO: 574128 - DNA, 127 bp, Homo sapiens
  misc_feature (89)..(89): n is a, c, g, or t
gatcccaggagacaccagggccagagtgaccacagcagggcaggcatcatcgtgtgtgtgtgtgtgtggatgtgtgtgtgtgggttttntaaagaattcttgaccaataaaagcaaaaactgtcaaa

SEQ ID NO: 574129 - DNA, 403 bp, Homo sapiens
actgagtgtgagcttgggggaaggcagaggcacctgttcaccgctgaccctgggtgcagatgggcatgccgggtatactgactgtgctttcctggggcctgtctccctaccaggtcagcctggggtcctctggcgcagggggccatgcactgcctcctgtgggcagtgggatcagcacttccactttgctcagggctagagcaggctgctgcgggtgtgaagacttaggaaacgaattcggaaggaaggaaaggattttgcacttcccaagctagaggaacatgaatagagccgggctgccaggccaagggtctgtaagacggcggctcttcagagactctgcaaatgctgagaaaggaaggctccccaagggcagttcctgtgggcgttactctgagttttc

SEQ ID NO: 574130 - DNA, 712 bp, Homo sapiens
agcggtacgtgagagcgcggcgggaaggtagcgcagtcgggcggcccgcggccccggcgcggcctccgctagggccaagacccgcacacctgccgggccggggagaagccgggggccgcgcgcaggcgaggacccgccggccggcccggggaagatctcaggacgcggaccgggcagctcgggtccgacggtgagcccgggcggaggacgcgcccaccggaggtgcggcctcggagctccagacccagcccactcggggctggggtccccaggaggaggccgacggccgaggctggtgtgcgcctgggagccagcgcagatccctgcgggagcaggaggagccagagccggagggagccgcggtgcccggcctatgcaccgggcgcagataggctgggaggcgcgggccctgatggcgcgtggccggtggcgctggggactgctcggcaggcctgccgtctctcccggaccgtctgggctcgcgctcgcagcttcggactctgcgtagctgctggcgcggccgccgtcgggccgtgcgggagcccccgaggcgcagggtcccgcggtgcccggaacggacagacccggaggggggtcgaccgctgtcgcgagctactacgagcgtgatgggccagtgggacccggccttcaactggcagcatccggagcctacagcttctgcttgcggcacgtgcggataccgcttctgctg

SEQ ID NO: 574131 - DNA, 156 bp, Homo sapiens
gatctagaggtccctgatatgcggtctcaatatgggattcaggtcttagcaaccaaaatctgaaaacgctcctaaaggggatgaaaaggtaacataattaaacatacacacagtcacacacagagagacatacatacaatacacagagatacacac

SEQ ID NO: 574132 - DNA, 109 bp, Homo sapiens
atagctttgtagggtccctgaaaagcatatttggatttaatcttttctcacaccgctaataaaagacatacctgagactgggtgaatttataaaggaaagaggttatgg

SEQ ID NO: 574133 - DNA, 970 bp, Homo sapiens
gcatatcaactagttgcgcgtatgtatcttttcatctgaaaggacaatgggtgggggaagagctccactgaggatgcgaggctacgggagggcctgggtctcgacgccgtgcccgcctgccgatccaaccactcgcacgggggagacacaagatacgcgtaactcttttacatttgtccgtgtgtgagtcgaatctaggcgagcgtgtgcatcgcgcgcgaggcgtccatataccgcgttcctagttccacctccaagacactataacatccatcaatacaacatatctagtgtaagcgccaagaacttacatacataacagtgtctgctcggcttactaccccgaaagcaagaatatacaggagtctcagtcgtcacatgccccggcgatggggtggggctcgtataagcggggacatatgagattgtgcgagccttaactatttgtctcgattagtaacatatagattctgtgcgcggtgccttgtaaggatactgtggtcctagtaattatacttgtagtgccaagcccgcgttttacatactggtaaatttcgagtgagaggggtaattatctcttgatccaatagatctggagccacttctcttggtaaaatcaaccaagtctctttgcgcctggactatcaagcggccttacctgatgccgtgagaggaattcgtactctggcactgcaacacagcggcgaaccattgattggggcgaacgctgtttacagacccgcgatacccgagagttctagtaaaatgaatcactcgtgcgaaatttagatagctctctaaaaggacaatataggcttagaacagagactcatgcagaaaacttgggaaaaacaataaacaagtgaaccaaaacacatttagatagtgagagttggccgtgcggaagaggtccttgactggagtgtcttggaaggcgggcatcccacgacggtgggggattgtacggggc

SEQ ID NO: 574134 - DNA, 1362 bp, Homo sapiens
ccgcatgggccggaggagagccccggccggtgggtcgctgggacgggccccttatgcgccactcagactcagccggcagccgcaacgcccatcgcctcacacctgacctccctggcttgcacacaacgctgaacctcaactgactggcctactgcactctgcgcgcgctcgctctctacactccttcagctcacgctgcactgcacacagcagccctcccccttgcactgacctctccccttgcccttacctgccaacgcacaccctctgtcccacgcggcacacccaacgcaacgcctacttcgcctacgccctgcacgcacacacctctacacctacttctaaccgctctctgctgtcccctgccctgcacgcgccctaagcacaccctgcgcacctaccctgcctcctctctccgcacgcgccacgcacgccgccacgccacgcaccactcttcacgcgccacacgcccttcccctatctgccaacatcggcctacaccacatcgcatcaccatcccaacagtcctctcgcctcctggcttggcactcacttagccccctggcatgcgacgatggcatccctaagataaccccttgggccaaatcccctaatcacaccaccttaatcccttcatctccgcccctcacgcctacaccgtcacaacccctccccacacaatctcaccatcgcccacaccgcacgccaacacaccgcccaccttcacccaccctcttccttcctcccttaaccccaccaacttggaccgccaccgccaacccacacacttccccacccaccccctctccctggcccttccccccggggcgcgccccccatcaaaccgcaatcatacccgccaaacgccgggcccacacccccccaccgcggccccaccgacgcggcgccgccatgcggccgccccccctcacacgtctcccccggggccccccccccactatccccccccccgaacgccgccaccctccctccgggccaccccacccgccccgccaagctcgcgcaccgcctcccacaggcgcgcgcaacccggtcatctccacccccggcgctcccgacggcccccccaccggcccgccttccccatgcgccgcacacagccaaaagatcctctcccacacctctcctcgcccccgcccacgccacccacgcgccctggccaccccacatccttcaccggccgtcggcggagcattccacccaacgcgcgaacgcttcaccgcccttccagcgcaacatcggcgtcccctcccgggcgaccaccaagcccccccctacgccactatcccacccctgtggcgattccccaacggcggcatctcgcgcccttgccgacacgca

SEQ ID NO: 574135 - DNA, 365 bp, Homo sapiens
ttacatgattacaatacgagtctctgtacctgtgggtatcatcagttcagcgaagggtccccagcggttggggagagccccaagcttgagaacagtaagtgaacaattgttgtactgaaccacttagttacgaaacagctgatcatcaaacaacctgtgtgtaatatgtattcctcctacacacgtagcacccttcagcaggaccctataagactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 574136 - DNA, 117 bp, Homo sapiens
gtgtgagttactattactgtctcaatttctgtctctgtcaagaagagattcaaggtctccttctgctgggctctgctttcttccagcaaaatttttatttcatcagtttctgcttcc

SEQ ID NO: 574137 - DNA, 100 bp, Homo sapiens
tcgtgggttcctgcagatgttgcgcaaaggcatagtgccatggtgagaagcggtgcacgaagcagcgtctccagcaggcgcttgactgtagttggaatga

SEQ ID NO: 574138 - DNA, 479 bp, Homo sapiens
tcagcctggtaagaatgggtacagaaccataaagaatgaatgatcagaggatggctccagatccaaagtagggttgtccctatagagaaaagattttaccaatcttttaagacagggattggtaaatactttcttaaagggcctgacagctaatattttagggtttatggcccatacagtctctgtctcaactgtttctgctgttttagcacaaaaatagctacagacaaaacttaaatgaatggacgtgactgtgtttcaataaagctttatttataaaagcaggaagtgggccagatttggcctatgtggtttgtctaacatggttataagaagaaggaattggtggataaatatcatgactttgttaatgcctatttaatcatgttccttaaatatattgtttagtaaacttctttatagaattacccatatagtaatttttgttttcaaataataaacttaaaatgatactaaaa

SEQ ID NO: 574139 - DNA, 207 bp, Homo sapiens
cgactcccggactggacgactgtctgacgggcctgaccggacggtcggaccggtgctgctggtggtggctggcttctgtcccggtacggacgctaccacagacgactacggtctgacctggtgcccctccctttggcctggcctctcacctacgtgtgggttcggctgctcttgaccctcttcgcctcgggtgctccttcctcctcc

SEQ ID NO: 574140 - DNA, 779 bp, Homo sapiens
cgccattctcctgcctcagcctcccgagtagctgggactacaggcgccagccaccacgccccgctaatttttttttttgtatttttagtagagacggggtttcaccgtgttagccaggaaggtctcgatctcctgacctcgttgatccgcccgcctcggcctcccaaagtgctgggattacaggcgtgagccaccgcgcccggccggtgatagtggttttttagaattttttccccttatcacaagactgaactgaaaattgatgcaatcacatgatggaatattggttcaatctgacagattaagggtctaggaagaaaacattaatttggatttcaccaaagaaaaacagttggttgaaaatcaatcagctctcatacatagctaagaacaatattcactgcttttcaagccatcaaatgctttcaatcaaatatctaaaacacggtggttaaaatgtcaactagcacttttcttaacgctatttcctggatttaaaaacgagacctgtcatagcatatcctatcttctagattgggatcctctgggtcaagagcaagccttgagcaagcctctgaagagctgcatctctaactgcaagcattcccaagtacttatatatatatgagcaggcactggcacctctactcttactgacaattcgctgacgtggtcacatattaacaacgctgttctttgaacctaggaccacttgggtggaactcatattgccaatgttttattacaggcataggccgaaattacaatttcaaaattaa

SEQ ID NO: 574141 - DNA, 403 bp, Homo sapiens
cacagaagagaccgttgctgtatgttgtttatgcggggaaacgtcatatcgggggcaccgattattaggggaactagtcagttgccactgcctccgattgtgatgggtattactatgaatgacagattattacaaatgcatgggctgtgacgattacctttgttagaatctgttcgcttacacctaaaaggtcgcctgtgctggtcccatctcgctctcttctcttgtcgagatggacaagagaacagagattgagatgtcttctgtatagtaggactgatatgacttgcttatggactggatagaagggctgtggggacgacagaattgcataaatactctagattttgccttggaccgatggtagcccttgattgatgattgtgaagggtgagatcagaca

SEQ ID NO: 574142 - DNA, 101 bp, Homo sapiens
  misc_feature (25)..(25): n is a, c, g, or t
ctggatccccccggtaaatgtagantactgtggcaaatgcctttatttcacctatcaagaccttagatagactagtgcacataattcagtactggtggagt

SEQ ID NO: 574143 - DNA, 295 bp, Homo sapiens
gctgggtgaacagcgccgccgatcttcctgaccacctgctcaggaatccgaggatcatccgtgcatcacgtaacgatttggttacaggttttggcgattgcgatgaaggttaaatgaaaggtctacggacaccgatgtgccgaggcatggggatcttcgaggaaagaaggtgcaagtaatgacagcgctacgctattgcagcgtagaatcatgtacctagcgcaatacgatcatccgaccgagcagcgtgtgctgtttcaaccccaagacggcctgcagcgcattgagcacgtcg

SEQ ID NO: 574144 - DNA, 815 bp, Homo sapiens
cagtggattaatctctttacccaattccggctccctaaattggtcgcgctgtgctattgcgccccctggttatttgggagtggccacaacgggagtcaacaagtgcgattgcgaaagtttgttcgtggaagcttatacaggcggaaaggcgattgtattttcgcccgttcttgtggttaagaaagacctgggaagtactggttcgccctgctaatttttgttgtgaaacttcctgggtggaagctctgctccctttggctgttataatgtggttcccgtgctactccccattgtttgtgtgtagagggcttttccgaactattccccctttgggttctgctttgcttgttcgttgaatatgtgtccgtgcctgtttctggtgggtgtcattcctgatgccgtgtggccagaagtcttctggggctggcctggtgcagcccagtttgtccccgtaagcttcaactggagggttaattggatgtcttgatcccgtagttcctgcccacaccccactctgtttaatccagtggtgggaagacccggtttctcagaactgtttgtttccaagttggcccacagttaagtttaggtagtaaaagactggtttatgtatgaaccaatgcgttcctggttaaacacttctcagaaagagaaagagaggaagatgttttgtggacaccccgttgggtttctttttttgcgtttggcacttttaagattattagttttttaaatccgtacttttttatgggaacaacttggcccaaaatttgtcacccgaattttgagacccctttaaaaaggtttagtgagga

SEQ ID NO: 574145 - DNA, 948 bp, Homo sapiens
  misc_feature (45)..(45): n is a, c, g, or t
  misc_feature (61)..(61): n is a, c, g, or t
  misc_feature (107)..(107): n is a, c, g, or t
  misc_feature (124)..(124): n is a, c, g, or t
  misc_feature (133)..(133): n is a, c, g, or t
  misc_feature (138)..(138): n is a, c, g, or t
  misc_feature (143)..(143): n is a, c, g, or t
  misc_feature (159)..(159): n is a, c, g, or t
  misc_feature (163)..(163): n is a, c, g, or t
  misc_feature (184)..(184): n is a, c, g, or t
  misc_feature (191)..(191): n is a, c, g, or t
  misc_feature (223)..(223): n is a, c, g, or t
  misc_feature (232)..(232): n is a, c, g, or t
  misc_feature (347)..(347): n is a, c, g, or t
  misc_feature (577)..(577): n is a, c, g, or t
  misc_feature (585)..(586): n is a, c, g, or t
  misc_feature (614)..(614): n is a, c, g, or t
  misc_feature (716)..(716): n is a, c, g, or t
  misc_feature (723)..(723): n is a, c, g, or t
  misc_feature (742)..(742): n is a, c, g, or t
  misc_feature (749)..(749): n is a, c, g, or t
  misc_feature (758)..(758): n is a, c, g, or t
  misc_feature (768)..(768): n is a, c, g, or t
  misc_feature (776)..(776): n is a, c, g, or t
  misc_feature (848)..(848): n is a, c, g, or t
acacatatgatggccgaggtgatagtgtggtttatggactgaggncaaaatctaagaagantcgcagacctgacatccagtaccctgatgctacagacgaggacacncctcacacatggaaagngaggagttnaatgntgcanacaaggccatccccgntgcncaggacctgaacgcgctttcngattggnacagccgtgggaaggacagttatgaaacgagncagctggangaccagagtgctcgaaacccacacgcgcacaagcagtccagataatataagcggaaagctaatgatgagagcaatgagcatcccgaagtgattgatagtcaggaacttcccaaanacagccgtgaattccacagccatgaatatcacagccaggaagatatgctggttgaagaccccaaaagtaaggaagaagataaacacctgaaatttcgtaatttcacaggaattagaaagtgcatcttctgaggtcaattaataaggagaaaacaatacaattcctcactagcatttagtcaaaagaaaaaatgctttatagcaaaatgaaagagaacatgaaatgcttcnagcacagnnaagagggtgaatgagtatctattgtgantcgtggaaataacgtgatgtcgtttgataaggtagtatagttagtggctatcatagcgaaacaccctgaaaactaaaagcatacagggttatgtctatgtcnatactanagaagaaatgcaaactatnacagtantataatatntgttaatctntcatgaanagaaatttatgtagacgcaaagcgaagagatacttttacccactaaaaaagagaatataacattttatgtcnctataatcttttgttttttaagttagtgtatattttgttgtgattatctttttttacattcaagataaaagatttattcacaccacaaaaagatgtcgac

SEQ ID NO: 574146 - DNA, 924 bp, Homo sapiens
  misc_feature (226)..(226): n is a, c, g, or t
agtgtctgttgtcctcctcgcgtatccgacgtggacctcccttgtgtccccgtgtgttccccatatgcgttctcccccgtacggccaccaccttgtgtgactgccccatcttgtacgaagccttagatgttccttgccgcccgacatgccgggattctcccatctccggggccccacttcggggcttggtcccctctccccggggggttcttaagctccggaagcnccccagctgcggttcccccacggggcttcctacaagccccgtcgttggtttggagtccattcggcgcatacctcgccctgggccccactaatttccggtgggggccgttgtctcccccacctccaccctatgggacacaacatcacccacaactaattccgcggctcactccttgatactcacaccgctgcactcacagaaaatttttctccccaaacagtcggctcaccaccaggttcctcctaggtgcccgcggcactactgcgctttgaaggatcaatactccagacgaagatcctgaccatattgtgaatccaaacgtctgatgagtccccctcactcacacaagaaagccttgctccctaattaaattttctcccctccgatgactctccccggaaactcccccctgagtgcccccggccgcacccgccatccacaaagcggccgcgaaatgcgtcacaacagacgcggggccccaggttctctcccaaggccccacaaccctcccagccgagcaagggcgcaaatgtcccgaggaggagtctcgggcaccaccaaagtaacacactagatgggcccgcatcgccgaggagaggcaccccgggggggcttacagccagacaacaaggaggccaccgcgaatgacgacaccacttgacccccctccccccgccccgaaaaacacccacataaca

SEQ ID NO: 574147 - DNA, 104 bp, Homo sapiens
atttccactctggcatgtaatgcaatgtactggtctgcttctaggtagagtgtggcaaaatctcctgtgagagtgcaggcatgccggccaggtagtgggtctgc

SEQ ID NO: 574148 - DNA, 258 bp, Homo sapiens
cgatctagaggatcagatttggaagagagatatgccaccagcattttattaagggttgagaattgcttgcgccaagctgtgtccaggcagctcagatgcttcagtcagacccttactcagtgccggctcgagattatctatttgatgggctcaaggggcattctctcgggaacattcagaccggcctccttacttttcgatgaggctgaggtccgtaaaattattagagttggcaaaggattttgggaattatcttac

SEQ ID NO: 574149 - DNA, 889 bp, Homo sapiens
gaaaacgctctaggggcgtacattgctagttggagccggctgtgtcttgctgtcccgcggagtggaagcgcgtgctctttgtctatgtgtccctggcctatggcgctgctaggctctccacgcgtgaagcacggaaatcaccacatgcctgcgggagcgtccggaatgtcgttggtgcgtagattcttctcatttccgagcaaatcaacatgcatttatatatctagctgtggaattatatcctagtctgacacctttacatcgagtgctgaagtacggactcagcttgctagttactactgatcttgagctctatctaatacctaaataatgtggtgggaacacacctgaaacgtatctgtgcttataccaagctgtttcagttctctgcacaaactggattagtagttatctcataatattgtcgcatgtgtgctgcaatggtcctggtcacagatgtgcagttccgatatttgattgtgacaacgactggaaggagtatgacagtgctcccactataaaaggtctcatgacaagctatcccaggatgaatcactccgtgcaggtgatttcagcacaagattcaacatgcttccggtcgacaattttcctagccactgtagggacagtattcttggtttcatatcgattctggctgttttttataccacgagcgaacgggattcggattgtacctggaaaccatgtgtcacagaagtcggtaacccacaggttttaattgaccaattacctgagggaaacgttcaggcctttcagttcattttaactaagttacaatcccaacaacaagttgatttgccattgcgttgggcctacagaaattccttgtcaaattgaactgatgatgaccttgagggaacaattcatg

SEQ ID NO: 574150 - DNA, 219 bp, Homo sapiens
  misc_feature (193)..(193): n is a, c, g, or t
catttatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtataattttttggtagacattnatcttcatatttcttggatatatacc

SEQ ID NO: 574151 - DNA, 424 bp, Homo sapiens
  misc_feature (67)..(67): n is a, c, g, or t
  misc_feature (78)..(78): n is a, c, g, or t
  misc_feature (190)..(190): n is a, c, g, or t
  misc_feature (205)..(205): n is a, c, g, or t
  misc_feature (304)..(304): n is a, c, g, or t
ccaatgattccaccatccagatacaaatactgttaacaactggagcatatcatactcctatctaggntatatatattnttacacacaatagacacatataataagtgctatgtggtatgactttttctccattaccaatatattaatgaggctggtgttttatgtgacttaaataaatcctggtccatcnggcaatatataattnttaaatgggttgcatgaatacccacttatacaagatgtgtcataatttctttaaagccaggtcacctttgtgttggagttaaattgtgtttttattttnttgctattataaggagttgctaaaaaagaatatgctgtgtagcaaaatattgtgtacctcacctctgacttctccttctttatgaataaatatattaaaaatagaaatggtgtggaccta

SEQ ID NO: 574152 - DNA, 307 bp, Homo sapiens
attatccaggagaacttccccaatatagcaagcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaaagagctgagggagttaagagggccaaccttagggcacgtgggcattattaaaggtcttaaaagc

SEQ ID NO: 574153 - DNA, 265 bp, Homo sapiens
ctagagcaggtcatcaggccaggatgagagaggttatcaaaggtgctctggtgtgctttgctccacgtgcttaggcctggaaggaaaggtggtggcacagaggttggcagaacctggtgttagtcaaacacacatctggggagagccctctaccttccttctactccacttaaggtggaagcattccaggagacagagaatgtgaccaggatgcacagtttaatctgaacccctggcttcgttcagtgctacttcacttgccagc

SEQ ID NO: 574154 - DNA, 486 bp, Homo sapiens
  misc_feature (56)..(56): n is a, c, g, or t
  misc_feature (59)..(59): n is a, c, g, or t
  misc_feature (92)..(92): n is a, c, g, or t
  misc_feature (109)..(109): n is a, c, g, or t
  misc_feature (112)..(112): n is a, c, g, or t
  misc_feature (376)..(376): n is a, c, g, or t
  misc_feature (401)..(401): n is a, c, g, or t
  misc_feature (424)..(424): n is a, c, g, or t
  misc_feature (468)..(468): n is a, c, g, or t
ctgggcagaccccagaagatgtgggcatcacggctgctcagtgcccccctgcgtgnccnttcctgcccctgcctttctggtgccctttgagnccagggaggcgtcccgnaangtggaggcgtgacgctgctggggccttccttcgtgaggaggagagcacgagagccttcccgggctcggccgccaggactttcacccggttctgccgagtccccctcctcgtgccctcagtgggacgctgacctcagagctgcgtcctgggcctctttcctcagctgggcttttacaaagggcgacaagcaaggtccgggaagtttgtgaagtcagcctttaaaaagtctttccttgctggccaacgacttgaaggctgggcgtngccgggtgcagcttgatctcgcctnacaaggaagtggttgggggggtncaaggccccgaacaattccctgtaatcggggggttggctggccnaaggaagggccggccttt

SEQ ID NO: 574155 - DNA, 830 bp, Homo sapiens
  misc_feature (19)..(19): n is a, c, g, or t
  misc_feature (84)..(84): n is a, c, g, or t
  misc_feature (110)..(110): n is a, c, g, or t
  misc_feature (115)..(115): n is a, c, g, or t
  misc_feature (125)..(126): n is a, c, g, or t
  misc_feature (128)..(130): n is a, c, g, or t
  misc_feature (238)..(238): n is a, c, g, or t
  misc_feature (373)..(373): n is a, c, g, or t
  misc_feature (381)..(382): n is a, c, g, or t
  misc_feature (384)..(384): n is a, c, g, or t
  misc_feature (398)..(400): n is a, c, g, or t
  misc_feature (408)..(408): n is a, c, g, or t
  misc_feature (415)..(415): n is a, c, g, or t
  misc_feature (426)..(426): n is a, c, g, or t
  misc_feature (455)..(455): n is a, c, g, or t
  misc_feature (466)..(466): n is a, c, g, or t
  misc_feature (508)..(508): n is a, c, g, or t
  misc_feature (511)..(511): n is a, c, g, or t
  misc_feature (516)..(516): n is a, c, g, or t
  misc_feature (525)..(525): n is a, c, g, or t
  misc_feature (534)..(534): n is a, c, g, or t
  misc_feature (543)..(543): n is a, c, g, or t
  misc_feature (588)..(588): n is a, c, g, or t
  misc_feature (595)..(596): n is a, c, g, or t
  misc_feature (827)..(827): n is a, c, g, or t
cccggcaccctcccctgancttcctggctactcatttccagcgaagtttaatctatttttaataatcgttcagttttcaagganatggaggagctgttttttcccacggngcggnggccctgggnngnnngggcccagaggttccggccgcgatgccgtcagcgccttcggcagagtgactgaagcgagatttcgttctcagaagtgagatgcaacgatttcgagggaccagggaggnggcggcgccgcggggccacagcccagccccgcgccccgaccgcgtcacagccaaagccccgccggggtgcgcgctgcagaggggacacgccgctcatcaactggggcagccgcggtcggtcggccggtggcgggnggcagggnngnggtggggtccgggnnngccacggngcccggngtcacccgcgnggccgccccggtggtgcgtggggggcggngcggggcgggncgggcgctcaaaactcctcgtgcacgctgcggcgtagtccancancttgntgcccgtgnagaactcgntgtacttgngcacctcctcgggctccaggtggtggttctggttctcgtcggcgnggcgatnntctgcttggcctcgttcagcgcgttgtactcgttcatggggtccatgtagctctccagctcctcggcggtcacgatgccgtcgtggttggagtcaatgagctcctcaaactccttttttctgtctttcaccagttgtcgtcaatgtcctggccctgctggttctccacggtgcccacgggcagggagatgaactcgggcacagagagctgcttgtcaccatcctggtccangtg

SEQ ID NO: 574156 - DNA, 563 bp, Homo sapiens
  misc_feature (19)..(19): n is a, c, g, or t
  misc_feature (84)..(84): n is a, c, g, or t
  misc_feature (110)..(110): n is a, c, g, or t
  misc_feature (115)..(115): n is a, c, g, or t
  misc_feature (125)..(126): n is a, c, g, or t
  misc_feature (128)..(130): n is a, c, g, or t
  misc_feature (238)..(238): n is a, c, g, or t
  misc_feature (373)..(373): n is a, c, g, or t
  misc_feature (379)..(379): n is a, c, g, or t
  misc_feature (387)..(387): n is a, c, g, or t
  misc_feature (392)..(392): n is a, c, g, or t
  misc_feature (403)..(403): n is a, c, g, or t
  misc_feature (405)..(405): n is a, c, g, or t
  misc_feature (410)..(412): n is a, c, g, or t
  misc_feature (426)..(426): n is a, c, g, or t
  misc_feature (438)..(438): n is a, c, g, or t
  misc_feature (441)..(441): n is a, c, g, or t
  misc_feature (443)..(443): n is a, c, g, or t
  misc_feature (445)..(445): n is a, c, g, or t
  misc_feature (455)..(455): n is a, c, g, or t
  misc_feature (481)..(481): n is a, c, g, or t
  misc_feature (494)..(494): n is a, c, g, or t
  misc_feature (512)..(512): n is a, c, g, or t
cccggcaccctcccctgancttcctggctactcatttccagcgaagtttaatctatttttaataatcgttcagttttcaagganatggaggagctgttttttcccacggngcggnggccctgggnngnnngggcccagaggttccggccgcgatgccgtcagcgccttcggcagagtgactgaagcgagatttcgttctcagaagtgagatgcaacgatttcgagggaccagggaggnggcggcgccgcggggccacagcccagccccgcgccccgaccgcgtcacagccaaagccccgccggggtgcgcgctgcagaggggacacgccgctcatcaactggggcagccgcggtcggtcggccggtggcgggnggcacncaacaccnccccncccccacaccnanccccnnnccacgcaaaacacnccaacaaaaccnccncncnccccccaccncaccccacccaacccacagaaaaaanaagacgcaaacancaccacgacgaaaaaacnggcagcaaacgcaacaaagacagcgaaggcactaaagaagacccagaaacc

SEQ ID NO: 574157 - DNA, 265 bp, Homo sapiens
tggaggttgcagtgagccgagatcgcgacactgtactccagcctgggcgacagagtgaaactcccatctcaaaaaacaagcaaacaagacttcgcagtgcatagccctgtaacatgcacatattggatgaatgtacttgcggtggcatatgtcatgttgttaccaaagacacacaattcaaatgatgttatttttggcacaagttatgtttcaaggaaggacaaagccacccacttacattccatctcacactgcacacaatatg

SEQ ID NO: 574158 - DNA, 326 bp, Homo sapiens
  misc_feature (25)..(25): n is a, c, g, or t
cgggaccaccgcgaaaccctgtgtntactaaaaatacattttttaatgctgggtacagtggctcatgcctgtaatgccagcgctttgtgagaccgaggtggggggatcacctgaggtcaggagttcaagaccagcctgaccaatatgatgaaaccccatctctactaaaaatacaaaaattagctggtcgtggtggcaggcacctgtaatcccaggtacttgggaggctgacacaggagattcacttgaaccctgtaggcggaggttgcaaggagccgagattgcaccattgcactccggcctgagcaagaatgaaacgctgtctc

SEQ ID NO: 574159 - DNA, 196 bp, Homo sapiens
ccacaatcgaggcggaagtgagtatttcctattcggcgacagaattctccgatccgtgcctagcagacgaggaggcgtccttgcccgattagtatgcatcctcatcctgagcaataatgccccatcctccatatatccaaacaagagagcaatcggacgccccaagggggggggacctcgaaaagtcagacgaggc

SEQ ID NO: 574160 - DNA, 356 bp, Homo sapiens
  misc_feature (222)..(222): n is a, c, g, or t
ctggcatccacgcatggcatctacttcaagaatcagaaagggcactctggacttcacccaacatggactcgttgagctgaagctgcagataaccacattcaagggcggaaccttctgccccagctttgccatatgataagctttcctgcttggctcttattcttccacaagagaggactttctcaggccctgcttgctaccggttcagcaactctgcagaanatgtccatccttgttggcttcctcagctcctgcccttcgcctgaattcccagctttggtggcagtgcctcatcttcaactttattgctcccctttacctcaccctactgcctcccatgcgtggattgcctgggt

SEQ ID NO: 574161 - DNA, 549 bp, Homo sapiens
  misc_feature (57)..(57): n is a, c, g, or t
  misc_feature (116)..(116): n is a, c, g, or t
  misc_feature (377)..(378): n is a, c, g, or t
  misc_feature (382)..(384): n is a, c, g, or t
  misc_feature (406)..(406): n is a, c, g, or t
  misc_feature (410)..(410): n is a, c, g, or t
cttggcggtactgcttatttctttattcttttattctgcgttgcatccaaacattgnttcactttgatcattcatctccataaaatttgaattgctaaataaggcctactccctanataccaaactcccttccttaggaaaaagaggggtgccaaaaaccccccaattttttttgggggaagggggggtccccccccttagccccccatttttttttgcgccaaattttttttttcttcccccccggggcgccagaaatccccccaatcggtaatgggagaagggaactttttgaagaggaacgcccctcgggggaaaacccgcggagcctacaccctgttgaaaaaaaaatgttccggcggagaaaattttgtggnngggnnnaatctccctctccattttcaangcanattcctaggtttttaatgtttgtaatggaaacctttatgagaggactctgattttgagaaatgccgtgtgggactctgctggggtggtaaaatgaggggtatccgcatcttcacctctggcatgatagggggtgggggg

SEQ ID NO: 574162 - DNA, 455 bp, Homo sapiens
  misc_feature (57)..(57): n is a, c, g, or t
  misc_feature (116)..(116): n is a, c, g, or t
cttggcggtactgcttatttctttattcttttattctgcgttgcatccaaacattgnttcactttgatcattcatctccataaaatttgaattgctaaataaggcctactccctanataccaaactccatacctaacaaaatggcagtttacaaaggtcttagatactatatcccaagaagtatatgcagcatagaggtggccaatattcagaagctacattttcttatactgcccaagtgatcatgaataaccaaaacatttgaaatgaattaaaatttacttatggtcagaaatgcacttgaggattaatccccagaattgcaactcatggagaaaaaaggtagtggagaattcaatcctgtttaacccaattattttttggctttagggaagtccatttttaaagggcaatttcccaaggtttttaaaaggttgggaatgaaaaaccttttt

SEQ ID NO: 574163 - DNA, 1096 bp, Homo sapiens
gctcaaaattgaaggcacggaaacttgtgcagtacggaacgtcctggcagactcttcgaccggctggctggcatgatgtgttggtgagtcagacgaccacacgaatttcatgatgcatttctcacattgaacgagttcgtgtactgcggagacctgtagataatgacaacgcatctgactggttataggaagatctgaacaccagtgcttgtgacgtcctggcatagatcaatgaatgggtataaggcgacctgcacaagcgacaaaggactgggggacgtctagagcgcatttgcaaagatatgtctgatggaaactaggactcaaaatggtgagaagtaccataatggatgactgatatactacctggtgataccgagtacaggagtcgcagttttgcatggtatgtgaatatacccatgggttgccattgggatgagcaaggctggatatgcttaactgtataaatgaagacaatcttctagttgacatgactcactccgaaggcctggttcgagcagtagaccatgtgggtacaactgtgggcatttatgtaggacagctgtgcaactcaatgttgattctggctacaatggtctcgtgacgccctcgctatccgatgcactatctccatctacttgaaggagatatgagttctggactctgtccatgggtgaaatcttcaggaagatgccatgaaaggtgacctcatggtatttctgagagtgtctggttgccgaaagcgccctgttctatgacttgtttattaggagtggatggagcgtctcggttctatccctgaggggcgagtgcctgtctcgccggcacgatctctgtgaggggcctgcttgagcatatccagctggaggttgtctgaagtgtttggttaaaccaggttttccaccttccagtgtccctggttgcgcctgcctggggttcgcatggtgttgaagtagggtggaagaagaggcttgacccgggttttccccattccggcccggcctggaagcgctcgaagctttcctgtctgtggcagtgctttgttgctcaggccggggctctttttttggggtaccctgccgagctggcctttggt

SEQ ID NO: 574164 - DNA, 345 bp, Homo sapiens
  misc_feature (200)..(200): n is a, c, g, or t
  misc_feature (255)..(255): n is a, c, g, or t
  misc_feature (286)..(286): n is a, c, g, or t
aaaatctcctcctgcccataacctccccctacacctccaacatgcatcccacacacatacaagtttaatgcacagcagaacttgaaagaaatccccaagcgtcacaaaagagtgtaagtggtgagcccacatgggaatattagaagcgaatataagccttacaggtgagaggttagagtttttaatgctgagtgagatangctccaggccttgcctctgtagttacaaagcactatccaggttctgaaatagggncaagaaaaattctggctagactgggcttggnaagctacctacttctctgctgctcatttgggactacaaatgggaataatggtacacatg

SEQ ID NO: 574165 - DNA, 201 bp, Homo sapiens
  misc_feature (157)..(157): n is a, c, g, or t
ccgtggtactgcagtgcagcctttatctgtggtcaaggtccagagtcctaaagctaaaggacttggagtcccatgtttaagggaaggaaccatccagcatgggagaaagttgtaggccagaagataaatgctgtctagttctttccggcattattcntgcctgccttttaattctgggctgcactggggcagcctcccagg

SEQ ID NO: 574166 - DNA, 643 bp, Homo sapiens
  misc_feature (26)..(26): n is a, c, g, or t
caggctggtactgcccccgggtttantggatcgcgcagtgcgggggcggcgcagcgggcggaggctgcgccgtggttttctgggcagaatgtcacgatggacgagtggcgtgacgcccctgctccccgacaagcctggtctaccagatcttcctgagcctgggcccggcgacgtgctggcctgcggtgctggtgtgccgccaatggcaggccgtgtcgacgggacgagttcctgtggagggagcagttctacacgctactaccaggtggacccgcgacagtgccccgacacccagcggccatgtcctggtacgaggagtaacagcggctgtatgacacggtgccctgacgtggaggtgcagacagctgcagggaacacacagaccaggtcctgcaccatcagaaatctcccattccggataacagaatcgcgtcctgctccaaggacagcaatgatgacgatctggagcaacgaacctgacacattctacgcaatgatgcacaagacagaggacaatgcaggacactaacaacgtgggaggatacaaaccaagttctcacacagatacaaacaaaggaacaaatacgactaatggatggcctagagagagagaaccatggggcccaaaaaaaatcctcatcca

SEQ ID NO: 574167 - DNA, 129 bp, Homo sapiens
cgctcacgaggatcccaataggagcgatctgtggtataaaaaataacctgtagttctccagatactaagctgtatatgattatggtgggtgatttcagatatataagcagatgggcacacattatggag

SEQ ID NO: 574168 - DNA, 218 bp, Homo sapiens
gtttctgcaggttcgcctctagacggactccccggtctggcgtgcacttcgcggggcgcatggtgggactcgtaccactgtcggtacggtgtgctgtcgagtgggcacgatgcaattcttcaccagtgtcttggtacgaacccgctcgttattcgatgcattgtagacaacatcgatgatccttgtattacgcagtcaacactctgagccccaacgag

SEQ ID NO: 574169 - DNA, 455 bp, Homo sapiens
gagatggcttaaccattcacccactaaaggacataagagtggtttcagttttgtagccctaataaagctgctgtgaacattcatgtacaggtttttatgtgaacatacattttcattttctgggataaatgctcaaaagggcaacggtggggttgtatggtaaacacatatattttggtaagaaactaccctactctttttccagagtggctctactttttacatacagccactcatacaattcagacagcaatgtatgattgatccagtttcttcacatcctcaccagcattgggtattactactattttttatcttaaccattcacatagatgtgtgtaatgataccacatgtggttttaatttgcatttccaatggctaatgatgttgagtatcttttggtgtgctaatttgccatctatgtatcctcttcggtgaaatgtcttcatgtctt

SEQ ID NO: 574170 - DNA, 238 bp, Homo sapiens
gcagccgcctactactactaaattcgcggccggtcgacgtttaaagaatgctgtcatacaggcctatactaagtcaagcagctgactgacaatcagccccttctccctatctcctttactcaatatatataaagggctctagaactcagggcccttgttcactagaagcaaggagccccctgaccccttcttccaaatagacttttttgtctttgtctttaaaaaaaaaaagtcgacg

SEQ ID NO: 574171 - DNA, 123 bp, Homo sapiens
  misc_feature (6)..(6): n is a, c, g, or t
  misc_feature (69)..(69): n is a, c, g, or t
cagaangtatatcatcccatctgaaaaacactaattattgacatgtgcatctgtgcaataaacttaaantgattattaaatactcaaatatatctacattgtttatattattgaataaagtat

SEQ ID NO: 574172 - DNA, 522 bp, Homo sapiens
gtcagtcattacagtcagcccagacactgtgttgggggacaagaccaatccttcaccacaacagtgcaaagcagtattggacatgagttggaatgtgtgctgggcccacagtacttattcccccacggctgaggggagaccaccttctgatgataaacaaaccctagctaacactctgtattcctccagggagggggataaaacccacatgcacgaagaaaccttgaccccagtgtccaatgggatagggatgctagagttatagtaaaggggaaaccctatgtcagctgttaacagagttcacaggggtagggatcaaccctgtactccagctcccaaatgtggtcactttcccagcttcttcatccgttcatcaatgctggcaaagttcccctcaactgtgagcaggtttgcacgcatggttgtctgcacctgggtcaagaaggtggtatagtccttcaagggattaacaaacatctgctgggtgggatccaagtgtgtcaggagctgaacaaagattga

SEQ ID NO: 574173 - DNA, 565 bp, Homo sapiens
gcgttcgggtgtggcgagatggagacagcccccaagccgggcgaaggatgtcccgcccaagaaagataaacttcagtaccagcgagaaagaaagcgcggcgatcactgggaggacagagcaccgttccgaccgatcagccggaggcctctccagggcctccttcgctaacgagaagaaatcgggagctccgtcctcagagaccaaaaaatgcgttacatcttaaagaagtctcggatctctaagaagcctcaggtcccgagagaagaccccgagaatggaagaacccggagtccctagcgcggcttgtccggggcccaagatccattcccaggcccccgctccaccgtccctgtggaagtggtccagaagattctgtcgctattgacaaatctcgaaacgctaccacattctaaagccacaatactcgaagccgacgttgacggttggctgaagctgacggaagagggaacacgaagtatcaaagctgctcgttctgagctgcctgcttgctgaagaacctgggtttctggcagggggaagcgatggggacagacacagccacag

SEQ ID NO: 574174 - DNA, 191 bp, Homo sapiens
  misc_feature (176)..(176): n is a, c, g, or t
ctgccgccccccagagagagctctgcaccacaccaagagaccagagcccagagtacaggcactcaactccgcccagtctctccccgctgtgggggctgcactataacactcgactgtgctgcacatgggaagaacagaattgctcctgcacgcaactaatacaataaaactgtctngaagtgagcttggtt

SEQ ID NO: 574175 - DNA, 1655 bp, Homo sapiens
tataaataaataaatagataaataaaaggtaatcattagcattttttcagttctgttggtatttgatttctatctcaaagatgatatgaggaatcttattaaagggttattataaatgtatggttttatgtattttgaattattctgtaaccaggtatttgtagatgcatagtgtatgtctttttccattggtaaaaattgatctatactgtggaaagatgaaactttattacttttctacaagctttttttcccttcttctcattgccttcccacattttaaagtcatagatctttagcatagaaaagatatagcagtagatgagtttgttttttaaaaaaagttatagtctgcttggtttaaccaaaagtaatttaaaaattaataccacattaaaaagctatttcaaaagcaatatgaaaaggaggattattttttattttaacatattatttgggctgggtgtggtggctcatgcctgtaatcccagctgaggcgggcagatcacttgaggccagtagttcgagaccagcctggccaacatggcaaaaacctttctctactaaaaatacaaaaattagccaggcatggtggtgtacgccagtattcccagctacttgggaggctgaggcatgagaattggttgagcctgggaggcggaggttgcagtgagcccagatcgtgccactgcactccagcctgggtgacagagtgagattctgtctcaacaacaacaacaaaaaagtattgtttgttaaaatggtaccttaattcactaactactgaaccattagtatgttctctccaaagctccctgagtttttctgagtatcagatttacttgagtatcaagtggcctggctttagtttataaatttacattaatcagctttgttactttaattaaagtattttgttacattttccctcataaacatggtaaaataaaatagcctgacatactaacttagttagtaacatatttactaacatagttttgtaaaaaactatgttagttttggaggccacacactgatctttatatgagattctatggccatattgttttcctggtagttatggaacctatttcctaaagtaaaatgtatttttgatcagtgattgtgcttttgaattgagcaggttacaattacagatgtgtgcttacttcatacaggtctagaattaaacataatactgtttatttctacctgatatatcaggatcaatcagatgaaatatgtaaggctttcttctgctaagggatagctttagaaataaggttgtgataaaccgcaagaggagcaatacattttgaggatgtcatagaactcatgctcttttgtttatgtattttagaaataattaaaattggccgggcacagtggctcatgcctgtaatcccagcactttgggaggccgaggcaggcggatcactaggtcaggagatcgagaccatcctggctaacacggtgaaaccctgtctctactaaaaatataaaaaattagctgggcgtggtggcaggcacctatagtcccacctactcgggaggctgaggcaggagaatggcaagaacccgagaggcagagtttgcagtgagccgagattgagccactgcactccagcttgggcgacagagcaagactccatctc

SEQ ID NO: 574176 - DNA, 357 bp, Homo sapiens
ctgaggttgggcagtgtcacgctatatcccagaggtgaggcaggcggatcactgaggtcgggagttcgggatcagctgtacacatgagaaacctactgaaatacaagtagcggcatgtggtgctgctgtagtccagctgtcagagctggcacagagcaaatccagtcaaaaaaaaaagaagaaagaaagctgggctggtggttaggcatccccttccttgttggaactactggacgaccctcttagatgtgccttggtgctgtggagattgtgtagtgtctagctcttgtgagctgtgtgtttgtgtagtcttagctgtatctgagatgcgggttgagggctctagctcttggtgag

SEQ ID NO: 574177 - DNA, 668 bp, Homo sapiens
  misc_feature (156)..(156): n is a, c, g, or t
gctcaagaatgccttggaaaagcccagttctcagaagaaaaggagcaagagaacagtgagctccatgcaaacttaaacacttgcaggatgacaataatctgttaaaacagcaacttaaagatttccagaatcaccttaaccatgtggttgatggtntggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcagctccaagtgggaaagagatgaagcacaagttagagagagaaaactccaagaagaaatgtggttctggcaagggaaggaggaaaacttggggggaaaactgtgggggaccaacgaaggagttcaggcaggcctgtgagagagccctggaagccaagaatgaattcgataagaggcaacatgaaggcaagaaatcaggcaaattggagacatgaaattcactatttgccaggaaaatctaaaaagtatggcgggaaatccaaggggcttacagatctccaagttcaggaagctgatgacagagaagggagagaattctgggccaactccgagagttagagaaaaagaagaaacttgaagatgca

SEQ ID NO: 574178 - DNA, 273 bp, Homo sapiens
tggaatgaaagttactggagacaagatgagtaggacaggcagaaaagagagagatactgatgggtagaagcacagatgggtgagactagtgggcaacacctcaatttcttgacaccgaaagtttagaaatttactttgcctctttgtgagcaaatactgtgtgctcattgactccaaagacaatttttttttagcgtaaaatcaacacccagcacccacagggaagaaataattccacagagctaagtattccacaaagttgcagcgtggccg

SEQ ID NO: 574179 - DNA, 1425 bp, Homo sapiens
  misc_feature (1)..(1): n is a, c, g, or t
  misc_feature (116)..(116): n is a, c, g, or t
  misc_feature (752)..(752): n is a, c, g, or t
  misc_feature (1028)..(1028): n is a, c, g, or t
ntgagtggatgtgcggagggggttgtgtgggcgacgcgcccgcgctcgcagcaggatgacgagagtgcgtcactcgtgcgtagctcagctcgacacgccgtgaggcgaggtgtcgntccgcccatccaagactacgcgtgtgtgcgtgtccgtgtcagcgcgacacatggattccgcggtcgctgttacgtcgccgccggccggttgtgtcgcgggagcgaaacaggtctccgccgccccgcccgggttggtgggctggtgtagtatcgtcgtcggtgtctagacagcacgctcgcccgcgttggtgtctgtcacccggccgtggttagatggcagcatgtcttctggagaggggcgccctcctctctccgacgctggatggggggcgcgctccccccgtatgtgtgtgcgcgctgccgctagattttttgcggggggagaccaacagatggtgttcagcggaggttgtaggcgggacctatttgagctggtggccgttgccggccgaaagaatgtgcaccccacattggaggggggtttttttaaggaggtcgtcgtcgcacggcagttgggcaccaacccgacaccaaattgtgtcccccccgttataagttcctccttttgtggggcccaacattgggtccttgggggaaacacaatggaagcttatccgcgcccacgggtgtgaaccctgccagaacccttagggccccccggtgtcgttacccacggggcacaaggccccaggcgcntttggggacacacccccgcagaaccagggccttgcttttggcgcttttgggcttacacacgtagtgttgcaacatcgggttatagcccctggccgcttgtgaggaaagtgatattaaggctgaaaattgccacctgttgcactcggtttccacgcgtgaaaaggttctcgtgaatcactgtccccctccgtggggctccgtcccttcaaccactccacctcttgtgccccctctctccagggaggttgtcccgcgcgttccccgcgctccacgtgnccgccctgaggcccctccacgagcctcccccctcgtggctctttttctggaatggggaactcggccgcgggtcaccctaggcctccacccgctggaagcccacccgctgcacaatggcccacttcttctgaagaggcccaaccgccggtattttcctcgctggccctcgtgttaagtgctctttctgtataaagggaccagacacgaactgggtttttttcctctgtccggtgtttagagtaaatatgaactaacattttattttccccttatgaaagatagaaattatttttatgtgagtttcccagactttatcaccaaaatttttgtaaaatgtttctctggaaagttaactaccagaatgtaaatatgcttctcatcaaataacacaggttta

SEQ ID NO: 574180 - DNA, 192 bp, Homo sapiens
gtcgccttgctgcttcagacttgaggctggtctgcttccgactccatctgactgaacactgaagtcgcgttgtccttgaacaactggaccgcgcgcgccatcgcgcccacttcatcgccacggttgagcgacggcaccgagacatcgaggtcgccaccggcgagacccttcatcacgtcagtcatggctgcg

SEQ ID NO: 574181 - DNA, 206 bp, Homo sapiens
gttttttttgggggggggggggggggttcttttttccccggggcccctttttcccctttgggcctttttgggggccccctttaccccttttttttccaaaacggggggggggggggggggggttttccgggggttttttccccccccgggccggggcaaaattaaaaaaaaaattgagcggggcgggcgggcggaaacgggcagga

SEQ ID NO: 574182 - DNA, 1190 bp, Homo sapiens
  misc_feature (1190)..(1190): n is a, c, g, or t
attcaaccaattaggccctggaccgatacgcctgtaaccgctagacattactgcaggccactctacatcagtgcaccgtaagttggacagcgccgatcctatgcaatatcagagccattaacgcttccactcatagcacttagtcatcgttcgacaaattgctaatgtctagcatgaactatcctatgacaatcgctggtcggccttgaatccaagtcctacgtttttcacacgttctaggtaaaggcccttctagctctgtcaccgatgcaatctacattcttaacacatatatgtatgacactaggacacaacatgagataaagagacaagatgagtgtgtgcggcgcgagagccgcgagagacccaccggggatgagaaagagtattgttaccgatgacactttcgcgggagcgggtgcgcgcgcgaagcgcgagccactgcggatgagtgtcgaccagggaagggaaacagctcgcgagacgctcaaaaagatgcgtgagccgtaaactcccagggaagggagaagaccacaacgcgagggcagacacagaagagacaaccagacgacgggacgagagagaggaaatcaatcacacgactccacgaggaataaaaaaaaagcgcacgccgcggggggggagacaaaaaaccctcgtagagggcgatgtcaccatcagcgagaacacacgatatgtgccgagaaagcagggagggggaggagcacccaccaggaggagggcgggaccaacaaacacacggagggcgagcagtctgctcttatcaaccaccaacgacgagggaagagtcccccaaaaagaggaagagagcccgccgggaggtgcaccccaagaagatagaaagccggcccccccgggggggatgctggcgggtggtactcacacaaaacataagacaaaaaagacagagccgcccacgggagagtcgaaaaaaacacgcccggacggacgacgatggttcagtctggatggacaaagcacgaacaactatccacacgaaagagagcggacatccacaggaagaagagggacgacacacaaccaagcagggggggcagactctactcaacaaaccaacaaggcgaacagaagcacgccacagacagagcgcaaggacagcacacgataactcacaagatgaccggcgccgcccgcgaggagaggacgan

SEQ ID NO: 574183 - DNA, 203 bp, Homo sapiens
gcatagccaggttccagcagttggcactttttgcgcagctcggacagctcggtttcgctcaagtcgggagcgtggcacacccacacgtccatatcgctttgatcggcctgggccaggtgccaaggctgcccatcaggaacaagccgtggatcggcgtaggcgggttgccgtggcgcggtttataggagaacgaacgggtcagg

SEQ ID NO: 574184 - DNA, 492 bp, Homo sapiens
gcactagatcatggctgttcatacctcattcatactactgatcctatagaacgacatctagatagctaccaggtgtagggagctatatttagagaccgctcggcatatctatgtcgtaggttgaagtgtggacatgagtatccaatccattgagtcaacacccttgatggtaagagtgtgtagttttgtaagaagctgccaagctgttctccaaagtagctgtactatcttgtattctgaccagcagtgaatgagagtacttgtagctttacctccttgccagcattcggtgtggtattttcaattttgaccgtcgtgtagtggtaatctcatagttttaacttgcaactccctaatgatgtacaacgtgcagcatcttttcttttttcttttcctgaaatagagatggtgtctcactatgttacccgggctggtcttgaactcaagtgatccttctagcttacatgcccaaagtgctcgtattataggcgt

SEQ ID NO: 574185 - DNA, 110 bp, Homo sapiens
  misc_feature (79)..(79): n is a, c, g, or t
ctccacttctatgtcagtctatgtgtaacaatagattctgctgcagtatggccattagtacaggtaggggaaaagcggntctttggccctttcatttcacctctgcaagc

SEQ ID NO: 574186 - DNA, 124 bp, Homo sapiens
tggcgtctagatgaaccacgatggtccctggcacctacacaaccctcccagtggtgtcgtatctatcctggagggcaggttttctgcagcaagccccaaagacagagcttgtgagcaggtgtgg

SEQ ID NO: 574187 - DNA, 689 bp, Homo sapiens
gggcagtgggtactttgtggaaccgtgtagaagatggttaaggtcagttcgaagtagatattgatgaaggaacgtatgcggcccggcagtggtggctcacaccggtaatcccagcactttgggaggccaaggtgggtgggtcatcggaggtcaggagttcaagaccagccctggccaacatggtgaagccccatgctctagctgaagatacgaaaatttgctgagcgtggtggtgtgcacctgtggtcccagctactcgagaggccggggcatgagaatcgcgttgaacctgggaggtggaggttgcagtgagctgagatggcaccactgcactccggcctaggcaagcgagagcgaaaagctcgcaagtagcagaagcaagacaagacaaagcacctgtgctaggtcagtctggcagcgtaagatgaacagtcccgtaccaagcagcagagctcaccatctcgttatagcgttaagtgaaagaacatggggaaggggaaaggggaatggctgcttgttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgaggccagatctctctccctatatgctaaa

SEQ ID NO: 574188 - DNA, 433 bp, Homo sapiens
ttcctgaatgcagcctgctgaggtgtgttggtagcttgagcctgggaggtggaggctgtaatgagccgagatcgccccactgcacttcaacttggatgacagagtgagactcccgtcacacacacacacacacacacacacacacacacacacacaaaagaaaaagaaacatctttatgtctcagggagattttagaattcaaaatataccaaatataaataaattaaaaaaagaaatctgtgtgtgtggggccaggcgcggtgtctcacgcctgcaatcacagcactttgagaggccgagagacacgcgtatcacgaggtcaggagtttgagaccagtctgaccaacatggagaaaccgcgtctatactaaaaatacaaaaattagctgtgcctggtggctcgcgcttgtaatcccagctacccgggagcaa

SEQ ID NO: 574189 - DNA, 650 bp, Homo sapiens
gggaatttgccaagggagccaagttggaaaacaaaggagggtaggcgatttagagtttctgcaacctgtgttaccggggctcatgcgatggggaggcctgtctctcaagatttgggaactacgttgacttgctgccgctgcagggtaacgccctgccatacttgaagagacagcaagcaccatgttggcaaaaccggtctgaaaccaatcagctgaagcgatgcgcctccctgaggctgccaaagtgctgggattacaggcctgagctaccacacctggacaacatgattttctaataggccaaaggtgagaagagtaaaagtcaaggatggctagccacaaattttggcccaagagacacaaaaattgttttattaactgaaaaaggcaacagtacacaagagactggtttgaggcatgaacatgaggagcacagttttgcacttttaagttgacatattggatattcaacagagttgtcatgcaggtaaactggattggaatgacattcgaaagacaagttttcgctggatgatcttaagcgctgcaatcagcttataggcggtataatacattatgaattgaatccaaatgaaattgtaccctcgcgggtggtccagaaagttgaagcggtgggacttacccacgcg

SEQ ID NO: 574190 - DNA, 326 bp, Homo sapiens
  misc_feature (13)..(13): n is a, c, g, or t
cccctccctaagngacgatgacaatgatgtaatcctgggagcgaaatctcgtttgagagcactctgaggagcacatgcgcggcggattctcagactctggaatggaaccacaaactaatgcaaaccagtgctacccagaagcaccaacacgtgtgttctccattccaccaatcacagaccagtatctactccaaacatccagtaacgaaaactatggcatctccccaggaacagcaaggcaggcttcttactcacgatgaaccagcacgaataaacccagcaaaaagagaactgcatacttaaatttaggatagtcattcatgagg

SEQ ID NO: 574191 - DNA, 261 bp, Homo sapiens
gagtgtgcaccctcagcagagaaggagaccagagtgggttactcctctccacaagcaggtcatactgtcatctgcccgagtctggatgaatccagagttttagtgggctccagaggggaggaagtacaagctgactggtccatgggtggccatgggtgggccacgccaggtgtggtggctcacacctgtaatcccagtactttgggaggccgaggcaggtgggtcccgatgtcaggagttcgagaccatcctggctaacac

SEQ ID NO: 574192 - DNA, 131 bp, Homo sapiens
tatgtgcactggatctgtgggtgagggcatggaggagggtgcagtctccgaggcccgtgaggctatggctgccctggagaaggactatgcggaggtggtcatcgactcctatgaggctgtcggagagggag

SEQ ID NO: 574193 - DNA, 595 bp, Homo sapiens
  misc_feature (479)..(479): n is a, c, g, or t
  misc_feature (483)..(483): n is a, c, g, or t
  misc_feature (496)..(496): n is a, c, g, or t
  misc_feature (499)..(499): n is a, c, g, or t
  misc_feature (520)..(520): n is a, c, g, or t
  misc_feature (532)..(532): n is a, c, g, or t
gtccttgaatggacgccgtgccgggtcaaatgttagcctccaggccctgggttgtggaagtgctgacagaagtcatggctgatgtttgagcagatgagagcctaacgtgggcaagttgctcaaggtgctatcgacaggtacgaatccctgagaaccggggccaccctggagcgcgtatgtagagacgcaggccaaggaaaatgccgtatgatctggaagctcaaccgtggctgtcctgaagcatgtacctagttcgaaccctagcacttcttgcagacctccggtcaccggccagatccatgcgtgaaggccctcaccaaggttgccgcacacagacttcagcctggtgcgaagtgcatgatcgaccaggcacatcaagaagaacggccaatccgacagatttggtacctcggggacctgctggagacctgccatttccaggccttctggcaagccctggatgaaaacatggacctctngganggtataactggcnttngaagactctgtccgaaagttnatctgccatgtngtgggtatcacttaccagcacattgaccgactggctgctgggccgagatgctcggggatctgc

SEQ ID NO: 574194 - DNA, 371 bp, Homo sapiens
tttaaaccagaaaacagcatgagatcctttgtgcgagcatccacgtagaggctaatctaatgtgcagacctgaaccgtgttaggatgtaaatcagacaacagttaaaatgggccccttttactgtctctaattatccctcaaaaaagttgattaaaaattaatacctatgtgcatactgccctaccatttaaaaaataagaaaagtcggtggtgtatgcctgtaatcccagcactttgggaggccgaggcgggcagatcacgaggtcaggagatcgagactatcctggccaacacggtgaagcccctctctactaaaaatataaaaaattagccgtgcatggttgcgggcgcctgtggtcccagctactca

SEQ ID NO: 574195 - DNA, 646 bp, Homo sapiens
  misc_feature (301)..(301): n is a, c, g, or t
  misc_feature (416)..(416): n is a, c, g, or t
agcgggttccaccattagcgaggctcacacccggcgctccaagttcggggctggaggcgtccggcttcctccctcccggaggcgggacggccccgccccgggcccgggtcgtcccggggccctcccactcctatcctggctccctaggcggcatcccacggcgactgaagccggcggcccccagtctcccgcggctgctcccccaggcatggcacagggcctcgcctcactatggcagcagcacggacagcacgctcgacttcatgctcggcgccaaagctgatggtgagaccattctaanaggctccagtccattttccaggagcaggggatggcggagtcggtgcacacctggcaggaccatggctatttagcaacctacacaaacaagaacggcagctttgccaatttgagantttacccacatggattggtgttgctggacctcagagttatgatggtgatgcgcaaggcaaaagagagatcgacagtattttgaacaaagtagaggaaagaatgaaagaattgagtcaggacagtactgggcgggtgaaacgattacctcacatagtgcgaggaggagcatcggaagatactggccacgcgagggcgctggttgaatatgacatagatgaagtggcctatg

SEQ ID NO: 574196 - DNA, 980 bp, Homo sapiens
aacggtctaaggtaacgagggctgggtggcgtggctttccagagggcagtgtagtagctttatgctgaaaaggtgggcactagaggtctgtgtgccattgcccaggcagagtctctgcgcttacagaactcctaggaggtgcttgctgtggcggagtggcctgcctatggtgtgctgcgtgttcatccactggtatgcagtggggccaaaggctgcgaggttgtgcgtgtcctgagcgcaaacctccggaggacagaggggccataaactccagtgaaagttatgtagcgagtggcgcgtgataggaatccacagccggagacccctgcttagctatacctacggttgacactgcatgtgcagccacgctgattgcctcagacaagggtggtgcctgcggcgagtcaacggctgaagactcgatgctcgctcctggggaccccaacataggctcaaagaatttgggccctaatgaatgctcgctctgccacttagaagctcgaacgttgatgcacttggtggagacaccgccgaacagatggacgattgagcatggggccagcacaaccacgcactctgcaggaagcgacggagagagggtggggagagccacgacgcccgctcctgcacatgccgccagcacacgtcgctcacacagcataacagggtctccattgcgtcgagcgtgtagtactaggagtcatggccatgttgcatctctaaggagctttgttacagctttcgtgccagcggacgatggaagaaggaccagtgggcccctaccacgaacttgttcactaggttctcaaacctcaaccccgccggcgggcggggagactgggaggggggaggaaacccgggggaaaggggccgctccctggcaccccgattggctctaagcccctcttcctgcacgcggtggacatcggggggctccccaaggggggcggaaaaacaaaaccgggatgggtgtgggggag

SEQ ID NO: 574197 - DNA, 1053 bp, Homo sapiens
cagaggtgctgtcatccagccttcatggttccatttctagagcacaggtggagtagatgtagcatcattcttaagggccttaggatttttggaatggtaaatgagcactggcttcaacttcaagtcaccagctacattagcccctaacaagaaaatcagcctgtcctttgaaactttgaagccagacattgacttctcctctctagctatgaatgtcctaaatggcatcttcctccagtaggggctgtttcatctgcattggaaatctgttgctcagtgtagcctccttcatcagtgatcttagctgcatcttctggagaacttgctgcagcttctccatcagcacctgctgcttcaccttgcactttggtgttatgaagacagtgcctttccttaaacctcaagagccaacctcttaccttccaacttttcatcttttcctctgcagcttcctcacctctctcaggcttcatagacttaagtagaggtagggccctgctctgaattaggcttaggcgtagaagcatgttgtagctggtttgaccctcacgtccagatgactaaaagtttcaccatatcaaaaatccaggtggtatcacctagaagatcactcatgtgttcactggaaggtagcaactttacactgtgcaccacaaggagacttatcctttgcaatcgttgacttgggtggtaggactccaacagggcccaagtttcaggcctgaccttgggttttcgacatgccgttacttcagaaagggtgagtcacttggccaggtcgttgattacaggtgagaaaatgcagcgacacctcgcgtgtaaccaatgaaagcagacctaattcggacaaaagtaggggggaacaaacatgggaccaaatagcgacggaggggctacacggaaataacacaagctcagaacaggacgaaagaaagggacctgccggcgacgggaagaagcaggaaacaacaaagagcggtaagcaaagtccgagactacaagggcacacagcatacagggcacgaccacaaacacggcagaggtggaccaaca

SEQ ID NO: 574198 - DNA, 137 bp, Homo sapiens
tggcacattctcttgaggtccagtcaggcttctgaggagcgaggttggccagtgtcacctcctctgatgacgggctcgtggctggcggccaagaagcaggagctggaggagatactgcatgagatgggggccgcgcg

SEQ ID NO: 574199 - DNA, 120 bp, Homo sapiens
aactgaggcgacggtaccaggtctcgtgcagcccaacttccagcaggacaagtcctggggcgctggttcagcggggcctcgcttcaactcgagctggctccgggagaagaaggcggcgtc

SEQ ID NO: 574200 - DNA, 543 bp, Homo sapiens
  misc_feature (34)..(34): n is a, c, g, or t
  misc_feature (298)..(299): n is a, c, g, or t
  misc_feature (389)..(389): n is a, c, g, or t
  misc_feature (391)..(391): n is a, c, g, or t
  misc_feature (408)..(408): n is a, c, g, or t
  misc_feature (490)..(490): n is a, c, g, or t
  misc_feature (493)..(493): n is a, c, g, or t
  misc_feature (495)..(495): n is a, c, g, or t
  misc_feature (528)..(528): n is a, c, g, or t
gacgatgcctgccgtgcccgcctggggctcgggncggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcatgcctagcccnnagattccacaactccagcgaaacatgtacactatcatgaaccccatcggcagggcgccggcaggtaatttcccgctcggccctggcaggncncatggccgccatgagcncgatggagcctcaccacgtgaacggatccctgggctcgggcgacatggacgggttgccgaagagttcccccggcgccgtggncgncntgagcaacgccccgggcaccccgcggacgacgncgagatggcggccgc

SEQ ID NO: 574201 - DNA, 83 bp, Homo sapiens
ttttgtacttgccctgtggggcctccactgcttttttatgggagacacttttaatttaacagatgagaatattttgaaactca

SEQ ID NO: 574202 - DNA, 1067 bp, Homo sapiens
ggcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttcttcatcatagtcccaaaaaccaatactttacaagtggcttctttgaaaggcaccacatttacgtggacatgtcactggcttggcgagacgggcagtcacagattacctacatcccccacaccagcctcatgcctctcctgcctcatgcagcacaggctgcgcttcatccctcataccacacaccatggcaccactacatccacatccccaagaggcctgcactgagcatgcctggcaaatctctaacactatactgacgcgcgcccactctccacttcaaactctgctaccccacgacctgcccagccgcacatgagcagacaaagctcctggcaacgcctgcccctgctgcctcacagcaaccacccccagcccctcgcaccccaccgcagcgactactaccactccacctacagcgcccctcacctccagcctctcccaaccgctccaccgcgcgcgaaccctgacctcccccacactcgacgcaccacgccacgcctggaacacaccagaacccgcctcacccgcacccagcggtacccgcgccccgcacgccctgcaacgcctccatcgcaccctacccacacaccgcccaccccccgcacccacaaccacccccgcccccccaccaagctcaacccccagccccccccgcccccccccccgcacccccccggcaacccaataccaacgaaacaaacacggcaccccacacccgcaaccccccccgccaccccgcccccctcgcccccccccccccccccgaccccccaacccaccccacccaccctcaaacacacggccacacagcacccagccgccgacactcccaccccccccactctggcccccacaccgccactacccccacaccacgcccagcaccccccccggcccgcgcccaccacacc

SEQ ID NO: 574203 - DNA, 233 bp, Homo sapiens
gcagagagaactgatttatcaaaggcagagaagctggggagtcagtgtgttctgaagtggggacaggctggtgtgtgtggggaaaggcacacatggaggatgaagctgctgaggtaggccaagggtgagcttacgtgggccacgcttcattttctttttttttcgagacaaagtctcgctctgtccctttaggctgaagtgcagctgctcaatctcagttctctctccctgca

SEQ ID NO: 574204 - DNA, 118 bp, Homo sapiens
ggagttattgtaaggcagcggacatgtgcaggatatctagtgtggtggtgaagatgaaccacgtgacgaaatagaaaaagctacctatggtgcccctacttggccttgccatatgcaa

SEQ ID NO: 574205 - DNA, 104 bp, Homo sapiens
  misc_feature (20)..(20): n is a, c, g, or t
actctctgtgggccacacgntgcacttgcaccaccacacacacacacacacacacacacacacacagacagatccagcagcatccttggaacatcctgaagtca

SEQ ID NO: 574206 - DNA, 384 bp, Homo sapiens
tactgttctttattttactttgcaggacacccttggggcatttcttataggacaagtctagtggtaatgaattccctcagcttttgtttatttgggaatgtcattttctccatcacttttgaaggacagtttttccagatacaggattcttgtttgattttttttttttcttttaacattttaaatatgttggcccactgcctctggtctccaaaatttctgatgagaaatttgctgataatctcattaaggatcccttgtagctggatgcattggctcacacctgaaatccgagcactttggaaggccaaggcaggaggattgcttgagacctggagttcaagatcagcttgggcaacaaaggaagaccttatgtctttaatt

SEQ ID NO: 574207 - DNA, 757 bp, Homo sapiens
atatgtagtccaaaacaacaaaaaaagaaaaggtctaaatgtgactaagaacgaacagtttccacagcctttcacagctatggacaagtttgcttctggtagtttctttcttacctcctcttgggatatattttctttcttggcttcccattgggggttatcagggttctgcaccacggctgctcggtgtatgccacatttctgaatagatccctatgagggttagcaagcaaaccagggtgggtgtaccaagtgcggtaaccttaacccggatccaagacaaatggatttcatctggctatgcaaccatctggtgggcacaacatctggtggttgcctatggaaaactagaagttctggtggtttggaccacatcctttcagggcaccaagaatagtctcttacagtaaatcgaatctaagcgatgacagtagtcttccatcatagagtatgactgggggggtccttcaaaagggtctctggcaaatggtctacttcttggcttttctcctccttgaaagctgtgagtacctacgtacccccttacttggggggggtccataataccatggttgggactccgaaggaaatcggatccatgaacgtcccagctacatttgggcacgtgcattagcattcctccacgggtgaagccgtggatgtttcccatatacggaggtggtgactacaaccgtttatggaacgaggaagctcctgaggtaccataccaatgggcaacgaggatacagggacaatt

SEQ ID NO: 574208 - DNA, 394 bp, Homo sapiens
tcagccgttatgtgcgatcttaggactttatgctattacaagtcctaggcattaacggttcctcactaggggctattgccgagccatggatcgcaagcctgactacttacctagatttttgaggataattctatgagtcagttataactatctcaatcctaagagtgaaaaatggaagttctcaaaccattgcctaagtagcttggaaatgagcctatggctccgccgaaatggcctgacttgctctagcactcatgtggactatcgactgtactgcgaaacaccttgaatcacccaagtttacctgttagcaaagaatctacttcaaaagccaatgacgaattcatgatgttgctttccatccaggctttgtagggccgcagagagcttgaca

SEQ ID NO: 574209 - DNA, 449 bp, Homo sapiens
  misc_feature (443)..(443): n is a, c, g, or t
  misc_feature (445)..(445): n is a, c, g, or t
ataagtctgaaaactcactttttttcacactaactgcagaggaaacataggaaaaaaattgtatatattgcaagatgaaaggtatatttagctatacagaagagccttataaaagcaaagaaattgttataaaagtcatgagaaagttgctcttgacagaggaaagagcctgtggaagtacacacacaggagagacggggcctcttaggtgtcaccacattccatttcttatcctggatgggtttgggtgtttgtcttagaactgttggtaaatgatacaagtgcttttatgtacttttctgtatgtatatttcctaatatttttagagccttgtaacagagattaaatgtctgttagatgtttggaatttctgtcggaaatcttgaagaatttgattggagtatgttattagtaatacagataaaataatatttcctgcaanancaaa

SEQ ID NO: 574210 - DNA, 188 bp, Homo sapiens
ggataggcacatgagcggcagtgttaagagtgggctggaacttggacatctccagtttctccatgatggcctataaaacagaagggcgtgagagcctgttaccatgtcttcaaaacgatgtttcagtgtactaggaggtaccagagatcaccacaactacagattgtagggagagctagcagctgccc

SEQ ID NO: 574211 - DNA, 228 bp, Homo sapiens
aggatccgaaaaaacctcccttagatctcccctcctgaacctgaaactagtcatagatgagatgccattgttgtagtccaacgtctgtgtagaattgtgcaggcttgattatgggtgactgaataaagcaattagcatcgacagaatttctaactaagatattagatgcatttacttgcactgcatactagtctgtggttggtccaaactccatcaatgttatcttat

SEQ ID NO: 574212 - DNA, 1471 bp, Homo sapiens
  misc_feature (413)..(413): n is a, c, g, or t
ccctttattttttttttggtactgggtaacacctttttaataggtcaaagtaactggtacagttcattatatttctttccgtggagaaataattttatattcccccaacaaactaacaggggagggatattattttgttctcaaaaattaacagaaagtggatgtgggtgataacgtggcacgattcaaagagaaaaaccaaagatttccgtgtgtcttgtggcttctattcttctctccgtgggacaagaacgagaaatacagaggacaaggtgtttgagtatacacctccgagtgtggacgtgtgtaacaatagttccacacagtggctttgtaactctttgtcttttattaaattatattatctcacacacatgtggacacacacaggggagataatgggtctctgtggnaaacactttctctctctatacaaaggtgacaagtatatgtgagaagggggtgtccctctgtggtgctaaccacacacgactaatctctcgttgcttctcacaaaagaaaaagaaaatatatttcagtgtgcgcctatccaaacaaacacgtggggccacaaatttcactctcgtgtgtggtaaacaaaagagaagcagtgaagttcttcataaagagtgtgtgtgttctcgtcacgagacgtaagatttcgcgcgagacacacgagagtgggcttctcaccattaatttcccaccacgaaacagacgtctacacaccaggggccacgcgcttacaaacaccacacagacaacggggctctgctagggctatttctcccccctgcaaattaacacttcaacaggctcctctccacaaacacttactacggcttttaaaaatattccctttgggctaaaccgcgtggcgcacatcacgccattcattgtggccaaactcttggcaccagcggggtggatttacatcatgaccgaccacaatcgaacaaaaattttacccaggtcctgggcaactcatgttaccacttctccctaattgcggtgaagcaacccacagaaggaaacattttcttcaaggagccactcccgtgggggggacttctcccccgtggggacacacttctcctgtggcggccatatacacgtggacctactccccttcattttccccactgttaatggcagagactaacaggggtcacagccatgttatggcgcacacttctaaaacgacattgtatcaccccccccgttggggccatccatcccccccctttttagcaaacgcggtaatagcctgtgtaccgtgtgtccaacccactatgaacagtggtccctgtccacagtggacggtgctgataaaaacggcctacacgactttagtacatgttgcaacgctgtctttagcaaaaacaggcgcctatattaggggactcgcggccacgaaatttacgtgcacatctatcacgtagtgtgcacaaacaagcaccatcacacacgt

SEQ ID NO: 574213 - DNA, 283 bp, Homo sapiens
agtagcttcctgtattactcctactccttatgtgttgtgtattcactaggaggaatgccaaagagtctggcatcaacatattctctcacaaagtcactttactcaaattggggaccaatgtatagggagaggccagcaggggctctcactaaggtggacataataatccacctcccattactttgatatctgatcaaatgtatagacttggctttgttttttggtcctatgaggaaatctgatggacatcatcatccaatatgcggaaggcggtctttgcata

SEQ ID NO: 574214 - DNA, 95 bp, Homo sapiens
  misc_feature (4)..(4): n is a, c, g, or t
aaantgtctgtagtaggggacccagagtcccaggcccctggagttgttgtatggcaggggccttgtctctcactgcatttggtcagggggacatg

SEQ ID NO: 574215 - DNA, 336 bp, Homo sapiens
cctgtaatcccagcacctcgggaggccgaggcgggtggatcatgaggtcaggagatcgagaccatcctggctaacaaggtgaaaccccgtctctactaaaaatacaaaaaaaaattatccgggcgcggtggcgggcgcctgtagtcccagctactcgggaggctgaggcgagaggattgtttgagcaggagtttgaggctgcagtaagctgtgatcacgttactgcattctaacctgggagacagagtgagagcctgtctcttaaaaaattaaatttaatttaaaaataagagcatgggccaccacgcccacctagttcctcttttgataaggctg

SEQ ID NO: 574216 - DNA, 1032 bp, Homo sapiens
  misc_feature (944)..(944): n is a, c, g, or t
  misc_feature (954)..(954): n is a, c, g, or t
  misc_feature (995)..(995): n is a, c, g, or t
  misc_feature (1024)..(1024): n is a, c, g, or t
cattaggccagcacagtggctgacatctctaatcccagcattttgggaggtcgaggtgggtggatcacctgaggtcaggagttcgagaccagcctggccaacatggtgaaactccatctcttctaaaaatgcaaaaatttagccaggcatggtgctgggattacaggcacataacaccacacccagctaactcttgtatttttgtagaaatggggtttcgctatgttgctcagactggtctcaaacacctggcctcaagtgatcctcctgcctcagtctcccaaatgctgtgattacaggcacaagctactgcaccaggcctctgactacatttctattaatatggttaggttggaggttttagtatttttgtatctcatatttgtatcaatatgactggcttctttgtctgtagtgtgtggtaatattagttctgtaaactgtcagttgcaaaaaaaaaaataccttgaactatagtatatgttgataattagccataataatttcttagttaatttcttataattaaatttgtcaaagaggaaacttacagtttatatctgatgaaatctctaaaaagatgggtaaaacattgggaaatgtatgcatgtacttcactctggtttcatagggttagcaagtgtcttaaaaacatatataaagaagcacagagattgttaggagatatttatgctcccagttttaataattgggatactttgtataccacagaaagaaaaattactaaactcctctttttttagtcaaaattggaaaaaaagtcttaattgacagttactatgcctgtgctacccatagcaagtatttcagtggaaaatactttactaagtaagtaatttgaacacagcttaaaatccatagtatgttacaattgctagccttttcacaaagtttgcattgtcttaatgtagaagggatactgngatctaaganttcacaatttttaaaagtgggaacctaaatagggttttccnaattggccctggaagtttatttggtatcntaggtgtt

SEQ ID NO: 574217 - DNA, 847 bp, Homo sapiens
agcggcggggcatggtggcaggtacctgtaatccagctactcaggtggctgaggcaggagaatcgcttgaaccaggaagatggaggttgcagtgggccaagatcgcaccactgcattcaagcctgagtgacagcaagactctgcctcaaaaaaaaaaaaaaaaaaaagggttggatgatacgaagatgtagagcacctgaaactatggctgctgtgggagtgtaagtgggttatacctgcttggaaaaagtgtttgggatatcattcttattaaaatgggaaccatttcaccattgaccattaagagtctcagacgagtcccacgtccataggtccagcactcttgagacaactgtgcagataagtgctcctagagattcaagcaccaattaattgtctcacaacagcatttttcccttaaaacaaaaccgtggataacaaccttcaagtgccgtggtccataggggaccaaattaaatttattaggtgtagtccacacagaaagaattatttattacaggcaggtgaaacattaggtggacatagcttttatagaattaacgaattttaggacaaatagtttggaccaacagggttggccttggcgttgggggcctcacaccttattaatccgtagcgctttggagggcccagttgggaggcatgcttgaggaccagggagtttggagaccgagccttggggccaacgttgggacgaggacccgtgttgtctacaaagacaatttttacagagtcgcccggggcatggtgggcgaacatcgggggatccatttgaagcccaggaattaagagggctcactgagctatgaacgttgccattgaggcc

SEQ ID NO: 574218 - DNA, 625 bp, Homo sapiens
atcttacaaatgtgatttgcagttgctgcttgttttggttttaggagtctgaaatattttccaacttaatccatgtttagtatctattcaaagtttcctttgtccagaaaaaacctaccaacactaaaaaataataaaatattaaaatagaaggaaaaattattcccactgagttcccctgcaatgatagcaatatattatatttactggtaaaaatgaagttgaatttatgccacttcaaacatactaagagtaactgaaaggtttgcatttgtattctgagggggtgagaatgatccatcttctgcagatgagtcagcttccagggttggtagaggggctaagacaaatgattgttttcttgtgtagctcaaggaatctttgtacgtttttctgttgcagcaaattgcattgctaacattgatcttcatttgcttaaatggatgcattagttcttagaaggaaaggagaggtgctagttaatttttagagtaagagatgtagatgtactcttccaagcattgatttaatcagcttctcttcccaatggaactggaaatcaaccgaagtgaagacctgaatctccccatcccattaccttcttcgtacgaggcattcccttccc

SEQ ID NO: 574219 - DNA, 454 bp, Homo sapiens
aaatatatgagtatcactaatctctatgtcggtagacgctgctgaattatctctcgtattgagatgccctccatctactgtagaactagatagagacatacaagtcatacatggtgtcatcctctgacttaccacgccagaacaaatgagccaggatgatcatgccctgtcaaatatgaacaactccgttcctcgcagtggtgcagaagagccacatgttgacgggacggcaggagtcatgatggtcagtggttgagtgtgcagcggacttttctctgggggtaatgaggctctccaagattggggtatggaacaaagaacagtgagcaagcctatcttaatgtgatcctggcatcttgtgcttgacttactgggtgatattgggctacgactgaggactcatatcgacgtcctgagttcaagtgtggcgacagtatctaccacgggagggtta

SEQ ID NO: 574220 - DNA, 695 bp, Homo sapiens
agggcgcatcgaaaactatgcgtggatgagacctcggctatcgtggctacatctaccacccgctgtgttgccacgaggtgtaggacgtaatcatcaagtgccagctgcccaagctgcttcacggcgcagggcctccccgagctcaaccactcccaggtttatgccgtgaagacgttgtgctgcaaagaccagtgagcctgatccagggcccgccaggctacggggaaggacggtgacgtctgccagcgcagtcggtctaccaccgtgtgacccggcagaggcagaccggctccgtgttgcgtggttggtggtgcctccgatgacttagcatcgccggtggtgactcagtctacacggagaagagtccacctcagtactggggcctataagggtcggtgcgcctctgcgcctgagaagccgtgaggcccatcggaatccccgggtgttcattatctggccctgtcactaaccagagtcaggaaccatggtctgcttgcctgagactgctaacaagcatgcgagcgcgctgacgagacgagcactggggcagcatgtcgtcgtgccgaccgagaagcggttaccgtggtccttgtaatgcgcaaccgtgtgaggagcatgagcctgtttgattgcaagcgccgcaatgtcatcgtgggtgcacatggtgttgggcgtccgcgtgaagccgagggttg

SEQ ID NO: 574221 - DNA, 527 bp, Homo sapiens
  misc_feature (287)..(287): n is a, c, g, or t
acttcggagactgtccctacacaattagggacgcatccatccaacgattgcgctcacagtgcgtacgaccctagacacctagggaatccctcggcaaccgtgggtgtgcgctcgcgctaatagtcatatcactgtggcagcatcgtgacatcgctccagagttgtcctatggatacgtcgatgtacttgctcgtctctgaacacctacatctctatactgtgtagtcctcacatgtagacgcaaggcactgagcattgtaggcgctgacactgcgagcccactcctncgcagcgataggccgctcaggtagtccctacgtcctcacccactaagggtcacagagtatactattatatatacaagtctttgtaaatttggtgtgatcttggggtgtgggagtgggcaccaacgcccgtccctggggtccttttttttattttctgaaaatcactctcgggagctgccgtcctcgtctactgggggcatatgccccagccctgtaccacacctgcctgtgcctagagca

SEQ ID NO: 574222 - DNA, 113 bp, Homo sapiens
gcattgcgatccaaccatcaggcagccgattccgtgtctggatcacacggggtggaaggaaccgtggcgtcctgcgtgggccaatgggtgagacacataagtcctggacataa

SEQ ID NO: 574223 - DNA, 711 bp, Homo sapiens
tgaggtttctgctgttattctgaatgaagattcccttatatatgacttgatgctctgtctactggtacttagggatttttctcgtttgtctttgtgactattgtcagttcaaatataatgtgccttggaggtgacctttttggggatcttggagcgttcctggatctgaatgtccatatctctcgcaagacttgggaggttttgagctatatatttcattgtcttttgcgttttcttttatttttaatcttgctgtgatctccttagcagctataatttcattaaatatgttttatttttgaattttgtttttggagacagagtctcgcactgtcgcccgggctggagtgcaatgacgcagctctggggttattgacccctccgcctccggggtgcatgcgatactcgggcctcagcctcccaaatagcggggattacgggtgctcagcaccacacccaagctaatttcttcgtacttttagtaagagacggggttacgccatgtgggccacgactggtctggaagtcctaacctcatgtatcccacctgcctgtgggctcccaaagggctgggataacaggcgtgacgccacacatgcctggcccgtgttggttcacaacagttggctccgatgattcattgctatcactgctgcactttgagttgcgaagtcttgtgccctttgccctgtggactcgcactgcaacttc

SEQ ID NO: 574224 - DNA, 301 bp, Homo sapiens
  misc_feature (86)..(86): n is a, c, g, or t
  misc_feature (159)..(159): n is a, c, g, or t
gctggtttttgttttgtttgaaaaatgtttcataacgccacctttataaactttcagatttgccaagaataaccaattgctatttnccaatattcccagaactaaataacagtccttttttacccaagaaataactatattgtggcatttttccccttnttaagttaataaaaactcccccattcaacatactacttatcccttcagtaggccccccccccttgaattaagggtaaattgacaaatgtctgtttctttttatatggaaggggtaaagatataattaaaggtccttttgcta

SEQ ID NO: 574225 - DNA, 1395 bp, Homo sapiens
  misc_feature (1072)..(1072): n is a, c, g, or t
tctaattggtctgttaattcccacaaggtacccaggggtgtgggggcgccgagccaaggcccagacaggccatgtgggacctttcctctccgggggggtgtgcacgcgtggattttccgggttctgtgccccaccagcaggtttggcaggcaggccgtcagtgagtgtgccggtgtggaaaggctctccgaaggcgcgttgggcgagggggcctcggggcggggcccacaaccatgtgtgtgtggagcctagaaacaataggtgggcgcgaggctccattcctcttattaacccaggggggcctcctctcacaggggggcttccagaaagcgggttttacaccacgagacaggccggtgtcttatggtcagatagaggaggaacttgggggagaagtgtcccccacttgtgagtggggccaatttctcccccgagggatattgcccttgtgccccctttgtggggtcggcgaaatcttttaaatcccaagtttttccacacagagcggaggttagggcgaccggtcaggatcccccccggattccaaacgccgaagaaattcttagggccgtgaaaacacaatattatgtcgggcacaatgtttgtggaagcgtcttgttgtatacgaccccacggcgcgggggcgagaaaaccattcttgtgtgggaactctcttctaatgtccggggatataacacttccccgctgtggggggcaataccaccgtggcgtcttttccccgcgagaacacagctggtggggtctaccaacccacggggggagacaaaaagaggggcaccccgcaggtggaaaatcccgcccgggaaaaagaagacacccaaaggacatcactccaagaagggaggatataaactagccgaggggagaccgtcatgtgccacaagatggtctccccgagacacgcaacaagtcgtctgagagcagttgtggtctacagatctatcaaaaccatcgggcgagggggcatcaccttaggtgcagcctccttaccacgacagttggggcggaccagcgaggtcccccccgtcgtgttcttgtggtgatgtagctncaaccgagaagttgccacacaccaaccggaagaaaagggcccccgccccgagggatgtaaacgtctgttggcgacccaccacagggtgtgtataaaacaccaccagattgtgttttgcgccgcccccggctgaagagaaaaacgaggatcccacatcgatgagaggagggcggcaggcaacaacgacaaaccactcgctcggctgagtccacagtaggcggcagcgcgcccgccgaccacacaacaggcgcaggcccaccaagaaagtcaggacattccaccccgagagggaaacggacgcggccaccccatcgttgatggtc

SEQ ID NO: 574226 - DNA, 304 bp, Homo sapiens
ccacctacagaacattaagatgccagcaaccggcccggcgcggtggctcacacctataatcccagcactttgggaggccgaggtgggtggatcacgaggtcaggagatcgagaccatcctggctaacacggtcaaaccccatctctactaaaaatacaaagaattagccaggcgtggtagtgggtgcctgtagtcccagctactagggaggctgaggctggcctggaggttgcagtgagccaaggtcacgccacttcactccagcctgggcaacaagagtgaaactccgtctaaaacaaacaaa

SEQ ID NO: 574227 - DNA, 836 bp, Homo sapiens
ctgtgtcatcagccgccttggctgcttcggcttgtatttccaaggtcctagatgaggtggagcgccgggtgggatctccgctgcattggtctatcctttacatgagaagtctcatggagtcgcccttcccagccccaggaagaccatcaaagtgaagacattcctgccaggtgctggcaaatgaggtgttagagctgcaggcgagcccatggactcaaggctggagcacgtggacgtttgagtgcctttataccctgcctcagtgtgcgccagctcatccgaatctttgcactcactgacgtgctggagcgccgggtcatttttgtggcagataagctcagtaccctctccaggctgactcgacaacgcagggggggtggccattgatttctaccccccattcatcctggcagcacacaccattcaatttcctggtacatccccgggcacatcccattgattgacaatcagtcgtgactgagtggcaacaccgcatatcctgggcttgtgacatgctccgtaccaagggttaccacgtccacacaaagaactgggccgggacggctgccatactggaaagagaagggccgcgagaaagggtggaaatctggcgcaatcctgcaccacggaataccatgcccgcagccagagggggcacgaacggaacaggacacacgctagttggcaccctaagggaacaggttaacaaggggcacggctccagggaagcaaggggctctgggcagcagggaaacgcaatggcgcgctggaatctacccacacggactcctgaagcaggcgactccagaggcagtgaattgtaataaccacctcaa

SEQ ID NO: 574228 - DNA, 402 bp, Homo sapiens
  misc_feature (402)..(402): n is a, c, g, or t
ggcacgcgggataatactatatataacctcagaagagtttttctttgcaggagatttctgagcctcttacacacattagactatagcctataccccaacttggaaggcacatgtggccccaacacagcattacacccgctataataccctagaagtgccacttctaaacacattcgcattacttgcattaagagtgtcaatcacctgagctcaccataggctaataggaaacaaccggaacccaataattcaagccctggttattaccattttacacgggctctattttacccttctacacagcctcagaggactttgagtgttcctttacacaatttcgacaggatttaccggttaacaatttttgtgggcacaagctttcacggactctaaaaaaaaaan

SEQ ID NO: 574229 - DNA, 549 bp, Homo sapiens
gcttttgcaattatatagtattgtggttttcatgtttttctctttcttttagagatggggtcttaccatgttgcccaggctggtctaaaactcttgggctccagtgatcctcccaccttggcctcccaaagtgctggaattataggaatgagccaccatgcctggctgtcctgcctttttaaataagagcttatattcaaggtgacattagacacttaatgaatcgtgagattttagacagtggcagtgctgtgaaggaaataactctgacgtgtaatcttgcctccatccctgtcactgtgccgaaaaagatcactgctcactatctttctgttttttaaacttaactatgggtttttaagacttagaaaaaaggagagaggctagcagagggaaccattgctcagtgacagcggctgtcaggcacaacagcacaaatgatgctgtttttatattcccctttcctcccccttttctttctcactttggtgtttgaaagccccttccagacattgcatcacatcaccctgggcctgggcctggtggtgc

SEQ ID NO: 574230 - DNA, 388 bp, Homo sapiens
  misc_feature (243)..(243): n is a, c, g, or t
cagcttatcattatcttctttctttggagagggtacaaaggatagctgctcgtcacgatggtcctcagcttcccgagtagctgggactacaggcgcccgccaccacgcctggcaatttttttttttttttagtagagacggggtttcactgtgttagccagggtggtcttgatcttctgacttcatgatcctcccgcctcagcctcccaaaatgctgagattacaggcctgagccgccccggnctgaaaagtcttttttttaaaagtcaggggctcggtcacccaagcgggagtgcagtggtgtgatcacagctcacggcagcctcaaactcctggggctcaaatgatccctcagcttcagcctcctgaacagttgaggaccatcgtg

SEQ ID NO: 574231 - DNA, 288 bp, Homo sapiens
aatcacagccccctttcccggggccaggggccttggggccctgccctcccccccagggttgggtccccccggggccccccctgggggaataaaaaggggatggaatgggggaaaagggggggcagggggcccttatcctttttttgccctggggggggggccccccccctttggagggccgggggcaggggggggaaacccccgggggggggtttttttaaacggggttttttttaatttttattaaattttcgggttttccctaagggggcccattccccctttgga

SEQ ID NO: 574232 - DNA, 299 bp, Homo sapiens
  misc_feature (117)..(117): n is a, c, g, or t
aaaaccctttaaaaaccccgggggggggggcccttttttcccccccaaaaatggggccccggtggtgtttttccgggggggccccctttttcccgggggcattttgggccccccccnaaatggttttttccccccccccccccaaaaagggggtttttccgggggggccctcccccgggggtttgggggggggcggtttttcccccccaaaggggggttctaaaagggcccccgggggggggctttttttttggtttttcccccagggtttgggaaaaaaggcccttttagggtgggga

SEQ ID NO: 574233 - DNA, 1041 bp, Homo sapiens
gggtgttctaatatacaattctcggaatctcgcgtccctctgcttcacacaggtgccccctatgctaatttgttttctcttgcacatcaagtgtgatctccacatgctcgtacttctcgtttttcacgatccctctgttgagaatccatgacaatggcgtccttttagtagtattatagtattgggacgttcaaaactggtgacttaataattgtcctccgtggaaatgattttccgttatcacatacaatttcttgcttcactgagtttgtggtacgttcgctcgctggacagcagatattaggatctgtcgtcgaggtcattaattcagagctacttgtgccacgcaattctctttagatcacaataaatattattttgcagataactcctgtacatttcctgcgagtgacgctgggaaactcctctcacagtgttctcacggagggtcacaattgctcgaacagcgtattgtatgcaattgtcatccgtggaacctctcatcagtcacactggcattatcatttccaccgaaattgcgattatactctccatatgatcacccgtggcgcgtccctcatgattgcttcgtcataccatcctccctcccacattctcagcaatcaacgcgctcagtgcccccctttcccactgttgggaatctatgaaatgcggttgctcgaacttaatcattcgattctcgagcttagtctgtaagctcgctatcagttcgtcgttcgcaaaggcaaaatgtctcgcactatcgtacggcgtattgacccatcatatccgaaactacaggattgttccagaataataaagataatagatatacataatgctgggactttcattttagcacctctgagtggaactgtacgtatctccacaggaagtaaacaaactgcccttggtccttggagacaaaagatttaatattacaatccatgtggccttaaggctgaccagatcaaagtggtgtctaatccattctacatgtcaagtagtaaatgaagccagactgcctgtgactttatgaat

SEQ ID NO: 574234 - DNA, 676 bp, Homo sapiens
tgtgggcggcacggacgcccggtacatcaagcagacggagaagctggaaggggcagcgggctgaagcacgaggtacacagcgacagcaggctggccgtcacgatgtatctgcgcctgtgcttcgcggctgccgtgctagtctggcatgttcccaacaggtgctctcatcgtgttaacctgcgagcaccagcaacattctagaacgtgaccacgacaccctgaccgatgtgcaatcaaggtccttcacgcgaacctcacatcgggggcaccactaatacactccacgtacacaaaacctgccagcaaaccttagaagacatgccatgggcaacctggcaagcagcgaccgagcaaaagacaccggcacggcaagcagcaacagaatcaagagccatgcacacgcaccgcgacggagctactgacaacgcaggagcgcaccaccgccaagcaacaggaactaatcagaaccgagcaaggacaccgacagctataccaaaaaacaaacatggctcacgaccggcaccacggagtaagacctgaacgaaaacactcagaagacgatcgacaacgcaattacccgaggtgccacaacacagccgaacaaagactacaacgacacagccacacacccaagtaaaaaagagaaatagcgcaatataaacgaataacaaccgcg

SEQ ID NO: 574235 - DNA, 761 bp, Homo sapiens
agatgcacaccacccggctgagctgaagcctgggaccaaccaagtgtggacccccacgcccagctgggaacatggggacgacctccgggataccccgaatgagatttcagagatgaaccgggccatacagaggctcaggctgagatccaccacatccagaaccagcctgccacaattggaggcccccattccgaggctgaggagcctggggaactggcgctcaaggatgctcgtgcccaaccggaggagctggaaaccgccctgcagcggggccacaggatatggcacggcaactgcgtgagttacccggaactcatgagcgtgaaactggcctggacatcgagatcgcccacctaccgcaaactgcttgagggcgaggagaacccgttggctggagatggagtgggaaccctgaataatctctgtgatgagattccactggtggcagtatcatggcggtggcattgggctgaccctcgggggaaaccactgggcagcaaatgaccctgagcttctccagcagtgcgggtcctgggctcctgaaggcttattccatccggagccgcatccgccccgtcgcaaggagtgcccgcgactgagccgcctcccaaccactccactcctccagccaccacaccaccatcacaagaagatttccacccctgcctcccaagcctggttccaagacagatgagacagtttggaaagatgatgtcagaatagcttccaataaaagcagcctcattttgaggcctgagtga

SEQ ID NO: 574236 - DNA, 276 bp, Homo sapiens
gtcgcggccaggagcacgcatggtatagacttaaaaggttcatttgtgtgtgtgcacattgtgtgtctggtgtactcctgtgggactcccaggtagtaaataaaggtttctctttttttttttttttttttttttttttttttttttttttttttttttttttttttttactccctgggagacacttcattgggggggaagacaccacaacaaccgtagcagcaaccccacacacacaagagcacccccccgcgggggacaacaacacaaaaaaac

SEQ ID NO: 574237 - DNA, 245 bp, Homo sapiens
  misc_feature (22)..(22): n is a, c, g, or t
  misc_feature (26)..(26): n is a, c, g, or t
  misc_feature (36)..(36): n is a, c, g, or t
  misc_feature (40)..(40): n is a, c, g, or t
  misc_feature (64)..(64): n is a, c, g, or t
  misc_feature (68)..(68): n is a, c, g, or t
  misc_feature (93)..(93): n is a, c, g, or t
  misc_feature (98)..(98): n is a, c, g, or t
  misc_feature (103)..(103): n is a, c, g, or t
  misc_feature (106)..(106): n is a, c, g, or t
  misc_feature (111)..(111): n is a, c, g, or t
  misc_feature (149)..(149): n is a, c, g, or t
  misc_feature (155)..(155): n is a, c, g, or t
  misc_feature (211)..(211): n is a, c, g, or t
  misc_feature (226)..(226): n is a, c, g, or t
tccccaaactaatatatgttantaanacctctgtanaaanatgggggaggcctttggtactgangttnccctccccatgctatttgaaaaggngattntactnggncgttnctgtaaatcttgagataaactgtttggagatttaaccncctctntgatgggggaccaactctatggaaattgtaaatacgttttatttataaacctggcnctgtattcaataaanatttctgcagcctttcatc

SEQ ID NO: 574238 - DNA, 426 bp, Homo sapiens
  misc_feature (21)..(21): n is a, c, g, or t
  misc_feature (29)..(29): n is a, c, g, or t
  misc_feature (48)..(48): n is a, c, g, or t
  misc_feature (134)..(134): n is a, c, g, or t
  misc_feature (306)..(306): n is a, c, g, or t
  misc_feature (419)..(419): n is a, c, g, or t
aagtggtggggaaacatttcnaagccccnctcctacagcctattttgnaaatatataatgccaatgttattaaacctatagtcacctcctactctgcctattgaatataagacctcattcctttcctaggcccnggcatgattgatcacgccctgtagtcctcagcactttgggagacccgaggtgggagaatcacttgagccccaggagatcaagacccagcctcaacacagtgggaccttgtctcaacaaaaaatttttaaaaacttagctgtgcatggtggcacatgcttgtagtcccagttncctgggaggctgaggcaggaggatagcttgagactgagcagtcgaggctgcagtgagccgtgattatgcaactgcacttcagcctgggtaacagagtgagaccttggtctcanatatttt

SEQ ID NO: 574239 - DNA, 84 bp, Homo sapiens
agcgggagcggtgagggcggctttcaccctagctccactgcttttttagcgtcggaagggcagccctagtgggagagagaaaaa

SEQ ID NO: 574240 - DNA, 970 bp, Homo sapiens
catttctttacataacagacgaggtaacgaatcctcccttaccatcagaatcaactggcaccaggaaggttgaactgagcctacgagtacaccgacatacggcggacataatgttcaaatcctacatacttcccccattattcctagaaccaggcgactgggactccttgacgtagacaatcgagtagatactcccgattgaagcccccattcgtataataattacgtcacaagacgtcttgcactcatgagctgtccccacattaggcctaaaaacagatgcgatgcccggacgtctaaatcaagaccacttgcaccgctacactgaccgggggtatactacggatcaatgctctgaaatctgtggagcaaaccacaagtttgcatgcccatcgtcctagaattaattcccctaaaaatctttgaacatagggcccgtatttaccctaataggcaggccccctcgtaaccccgctctaagaaggccgaaaaaaaaacttgcacagagcagcgcaagcatagtgtacacacagagaacgcagctcagcagtagtaggacgtcccaagacagcgcggtaccaagcgaacgaccctgtgtgcaaccacaccatcatagggtagaacaggcagagcggtcccactgtgaacgcctcgcacaagtggaatcacaggaggggagagggacactccactccacacgggagaggaagacgcccagcaaagaaagtgcaatgaagacataacacacaagggtgtacccacccacggaaagcgacagggaaaaagtagaacaaacgcaaagggcaatacacacgatacgcgcacacccaatcgagtgggcacggaaggacgcagcaccgcggcaacacatacatcatcggagctcacgagagacggagagaggaaggccgaacacgctgcaacgacggagagctgaacgacaggcggccaacaacaaaaagggccgcga

SEQ ID NO: 574241 - DNA, 276 bp, Homo sapiens
aaaacccgggcccccccgttggtttccccccgggacccttttatttggggggaagggccttccctttttttcccaccccctttggaaggggagggggaaattttttgcccacccaagggataaatggtttgctttttcctttaaaagggaaatgtttttttaaaattaaaaaccttggttgggccgccaaataatttcccgtttgttttggtttttgaaggccccccccggggagggggaccccccccttaaatgggaaaaaatgaaaggtaacca

SEQ ID NO: 574242 - DNA, 307 bp, Homo sapiens
ggtcgacaaaatgtcatgaggccaggcacagtgactcaatgcctgtaattcgagcactttgggaggcctgggcgggaggatcacttgagtctaggagtttgagaccagcctgaggatcatagtgagaccttgtccctacaaaaatttaacaaaattagttgggcatagtgatgcatacctgtagtcccaggtactcaggaagctgaggtgggagtattgcttgagcccggaaggttgaggctgcagtgagttatgatcatgccactgcactctagcctgagtgacagactgaaacccgcatctcaca

SEQ ID NO: 574243 - DNA, 686 bp, Homo sapiens
gcaagagatcaagaccagcctggccaggcatggtgaaaccccgtctctactaaaaatacaaaaattagctgggtgtggcggcgcgtgcctgtaatcccagctacccaggaggctgaggcaggagaatccgctttgaacccgtgaggcagaggttgcagtgagccaagaccatgccacgtgcactttcagcctgggcgacagagggagactccgtctgaacaaacaaacaaacaaacaaggtcccggaatgctgtggggagactgatgttgagatactaggaagtcccagtgactttagcgaggccaaggtagcgtggatcatttgagcgctcgggagattccagaccaggtctggccaacatgggtgtaagagaccccgtcctcttattaagacattgagtaaaacacgttgaagactctgaagttgttgtgcgcgggcagaggcatgcccctcagttatattaccccccacagacgaaccatttaccacggcggcagcaaaaagggacaccaacaaaaaaaggggggggcccccaacaagggcaggatttcggagaaacagtttctcaaagttccctttggaacagaggcacaggggaaggttataaacgggcccacgcacttcaagaactgggggaaacacaccgactcctacttagcaattacgaaaaattactagcgcatgg

SEQ ID NO: 574244 - DNA, 395 bp, Homo sapiens
  misc_feature (92)..(92): n is a, c, g, or t
  misc_feature (99)..(99): n is a, c, g, or t
  misc_feature (277)..(277): n is a, c, g, or t
  misc_feature (281)..(281): n is a, c, g, or t
  misc_feature (285)..(285): n is a, c, g, or t
gtgatttataaccatttattagtgaaagtgtttttaagcacagtcagggtgtaaacagtgcagcattcctgcttccctccgtgggaacagcngtctccnttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgacttttttttncccntttncccccccccatttcatgtaaacagaattgccagggaccggttaccgtggatatgtttttctaaaaactcagtgtctgcacaatccattgatagaactggaggatgtgtct

SEQ ID NO: 574245 - DNA, 702 bp, Homo sapiens
gggaagcggcggcggaagcttccgtggagggcggctcgcaggtgaggaggcccgggaccgctatcctgatccgacgaagcctgcgccaagtcctggtgttccgcggccgctgacaccggtgtcccggctccactgcagaacagcccgcgctggggccccgtaacgtcgcgggtagggcgctctctggggctcgcccccggagtcttcctcccactggtagtccgcagcccgtgcatcccgtgtgcttgacccggtcctagtcagggagagcctgaggcttgtggggcgacagggacccggagttctgtgcgggtcacggtttccgtctcccgactcctggcggtctttctcggagccgggcacgggatttctgggaagcctcgagcggctccgttccgacggtgattgcccgcacgggagactccatggtcactcgttatggggacccccaaattctcttgaacaaccgtgttgggttaaccagggtacctagcagggaggagacctgttaaatccggaagaacaccctgaagagcggagattgtgggaagcagaggacatggagggaagggactccggacaagttcgaaagtataagaccgcggatccaatagacggcgtgctgcgttcgtgaataatccggggagtgagacggatatctttcccgcacatgcaccgaggcgaaagaaattttgaggatac

SEQ ID NO: 574246 - DNA, 389 bp, Homo sapiens
  misc_feature (29)..(29): n is a, c, g, or t
  misc_feature (48)..(48): n is a, c, g, or t
  misc_feature (111)..(111): n is a, c, g, or t
  misc_feature (389)..(389): n is a, c, g, or t
cgtggaggaaaaccccttattttaaaaanggatgaaaaaaataaattnccctaaatgcagattttttaaaattaatttatttttttgagacagaggctcgcctctgtcagnccaggctggagtgcaattgctgtgatctgctcactgcaacccttcaccctcctgagctcaagcaattcctcattccttagcctcctgagtagctgggattacaggtgtgcacccaccatgctcggctaattttttttatttttagtagagacaagattttgctgtttggccaggctggtctcgatctcctgtcctcaaatgatccacccacctgggcttctcaaagtgctgggattacaggcatgagccaccacacccagtcctaaatgcagaattan

SEQ ID NO: 574247 - DNA, 405 bp, Homo sapiens
tctgactggcgtggtaggtagagatgcttgtcactgtgaggtcataagcttgggatagcttgccgggtacctgcaagcgtttatccctcggcgattagtcaggtcttagcatcgccagacgtaccgctccaatcgatatcatgtcagctatcgtcgataacagccttcagatgctcagtcgatactttggacacgtgtacacactaggtctcaacgtttagtacgatctcttgtaaggcattcatatctcagtccagcgcctagaatccgctaggatggtggtggcagcagcatgtaactctttgagttcgcatgatcaggcaacttccagccttgaatagcatgatcccttgtcccagtagcactatggtcagcataaggaggctcggtcactaaagggcgttg

SEQ ID NO: 574248 - DNA, 118 bp, Homo sapiens
tggtgctctagcggatcttatacccgatccctcatcacggcgaatgagtacattcagattgatttggagactggcaggattactgatttcatcaagttcgacactggtaacctgtgta

SEQ ID NO: 574249 - DNA, 314 bp, Homo sapiens
cccccccgggggggggggccgggggggccccctcccccccgttattatcaaaagggttttccccgggggagaaaaaagggttttttcctttcaaaagaggggggcccccccgggggggcttttttagcggggttttttttccccccccacgggtttttggtgggggaaaaaagggggggggggggccccccgggcttttttttttttttttttccccggggggggcggataatttccctccccccccgggggcccccaaaaggggggggggaggggggccccttgggtttttttttttggcttttaaattttta

SEQ ID NO: 574250 - DNA, 319 bp, Homo sapiens
  misc_feature (256)..(256): n is a, c, g, or t
  misc_feature (279)..(279): n is a, c, g, or t
tcgcgcttgttgcccaggctggagtgcaatggcacgatctcagttcactgcaacctccgcctcccgggttcaagtgaattctcctgcctcagcctcccgagtagctgggaccataggcacgtgccaccacacccggctaactttttgtatttttagtttcaccgtgttagccaggatggtctcaatctcccgacctcgtgatctgcccacctcggcctcccaaagtgctgggattacaggcgtgagccactgcgcnccgccacattcagctcttatcanagaaataacccagacttagtcttgaatgatacgattatgc

SEQ ID NO: 574251 - DNA, 270 bp, Homo sapiens
caagaggatccgtttgaggccgagtttgagaacagcccaggcaacatagcgagactctgactctattgaaaaaaaaaaaaggtagctggatgcgggtggacaagcccgtggtaccagctatccaggaagctgaggtgggagggccacgggagcctaggagtccgaggctgtagtgacctatgactgtgccatcatactccaccctgggcaagagtgagatcctgtctcagggaagaaaaaacaatttgtcatagtacttgaggatactga

SEQ ID NO: 574252 - DNA, 339 bp, Homo sapiens
  misc_feature (6)..(6): n is a, c, g, or t
  misc_feature (60)..(60): n is a, c, g, or t
gagtanctctggagttagaaagaaaaccaggttcctgcaatgctgtagagcccagggaanaatatgttcttaaaaggagagagtaggagctgggtgcggtgtctcatgcctgtaatcccagcactttgggaggccgaggcaggtggatcacaaggtcaggagatcgagaccatcctggccaacatagtgaaaccccatctctactaaaatacaaaaaataagctgggtatggtggcatgcacctgtagtcccagctactcaggaggctgaggcaggggaataacttgaacccgggaggcagagattgcagtgagccgagattgcaccactgcactccag

SEQ ID NO: 574253 - DNA, 254 bp, Homo sapiens
  misc_feature (34)..(34): n is a, c, g, or t
  misc_feature (49)..(49): n is a, c, g, or t
  misc_feature (66)..(66): n is a, c, g, or t
  misc_feature (128)..(128): n is a, c, g, or t
  misc_feature (173)..(173): n is a, c, g, or t
  misc_feature (203)..(203): n is a, c, g, or t
gctcactgtaatccccttctcccaggttcaagcnattctaatgcctcancctcctgagtagctggnattataagcatgtgccaccacacctggctaatttttgtatttttaagtagagactgggtttnaccatgttggctgggctggtctcgaacgcctgacctccacctttnttggcctcccaaagtgctgggattaccgtnatgagccactgcacctagccttcatagagaggtttttgccatcaggccaca

SEQ ID NO: 574254 - DNA, 222 bp, Homo sapiens
  misc_feature (194)..(194): n is a, c, g, or t
aaagcggctcggaggcaagttggtgtcagatggacagagttgatcagtctgctgtaggctttgaataccaggcgaagactgagaagcatgcctcccagaaaagactactccagtggtttttggcggcaaagtatgggcgtgcaggccgacccgagtagaacaagagcgcgggtgggccttcgacttaccagggncaagaaccggagaaagcaccgagtcaca

SEQ ID NO: 574255 - DNA, 420 bp, Homo sapiens
tcttacgcactcccactctaaggcatgtgggtctcaacgggatcggagattgctgcacagatccttgatcaggagacctagagcgaacttgtttgaacattcatatgagagatgtgagggggactattacacttaaaggactgggatgtaccctggcgctgatgagagatccgtggtctcccatcatacccgtcatttccatcgggacctgtctctctcagtagcgtcctggaaacaatgtcgtgttctgttactcaatgataatcttcatggatgccagtgtaggcaagccaatctatagataaatgcacgagtgcatgatattctcgtcttgactgtagaccatctggtcgcgggagactgggtaggcaggacttttcgtatgcatggtcgtgaggcatggctcgccctgcactctgt

SEQ ID NO: 574256 - DNA, 954 bp, Homo sapiens
  misc_feature (279)..(279): n is a, c, g, or t
tcccgtgatagcatgctcaatggctactcatgcagcaattccccaggttcgcacaacgggatgtggacttggagctgccgtggtcttagtgagtgtagctagatgggtattctgctggtaggactgttgctgacagtagatttgccagcgtggttgcaagctggcatccgtgatatccatcgagagtgacgatttagggacgcagaacagaagttagcaggtcatgacaagacccaatcggagccgatggtaggataggaagtagcgtagtgagtccangtgccatggagcactccgtcgcagtatcatcgttttgatagaaggccatgtcgcttttgcgcgccgttgctgtcagttgaacaatgacaattcgcgaatatatgagcagtgtttgcccaagaccctgtcagcgagagtcgtgcgcgctcttgtacaagactttgcatgattgccacttgccaggagaatccagggagtgagaagacatagagccaccaagttccacgtgtgcctaggctggggaggagacagtgcccaccaagtgatggggcaatgctggttaatatcaacttcgtacatgaaccatagtcgcattcgaatttggaacgcttgcttagtgggcattacatggtggggcttggagtggggggctccattggctgtttgacaaagttgcatggtggttggacgcctgcccattgggagccctcttggtcttcgccttggcaggcgataggggggtggcaggcctttgggctccctaagcgaaagtaggggtgatccccagggtgtgatggtccggctccgaacaaggacgccgtggcgtcccaattctcgttccccaacgtccatggaaccatcaaggtcttccaacggggttatcaggttggggaccttcctaggaaggaggggggggttcaacggtggttcgccaaaaaaattacataaaagaaa

SEQ ID NO: 574257 - DNA, 347 bp, Homo sapiens
aataaaatctgggggattttctaaggtggcaattatgttgtttgcaaataaggacaattttatttcttccttcctaatctggatatcttttatttatttttcttttcttattgctccctttcttttttaaatttttttattttattatgaatataccttaagttttaaggtacatgtgcccaacgtgcaagtttggtacataagtatacatgtgatgttgaataagaatggggagcatggtcattgccttattcccaacattacaaggaaaagcgtcaatctcttatcattaaaatatggtgccagctgtggtgattttacaaatgccccttatcgggttgaggctt

SEQ ID NO: 574258 - DNA, 1060 bp, Homo sapiens
  misc_feature (238)..(239): n is a, c, g, or t
cggccgcccttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactttttttttnngccatttggtaatcgtttaaaaattagtagacaacgtgcttaagtggtgtggggttttttcacaattttaaacattaggtgattttataaccgtgttgtgcaagtttaaagggttggtcatgtgtttctttaaaaaaaaattacaataagtgccccatattccctatgtgcattaaaggtgcttctctcatattaaataaggtttgacacatccgtgacatacaccctttaagcctttgaaaaaaaacacaaaaacaaaaagtgggaacaaaaaaccctgtgtatttggcgcgacacatatatacctttccctggattaggagagctgtgtacatgggcagcgaaacctgtgtacgcctgactatggacacctataagaaactcgcttaccctcccaaaaaacgcggatctctgggaaaaggatctagaatccctgtcgcgcaaaagccaacaagacaaagagcttaaaaaaaaaccagaagagcaaactctgccacacattaacaagaacgaggtccaccgaaaaacaaaacgaacaacaaaggggcggagcaaccaagagaacaccccaggggcgcccagatattaccgacaccccgagcatctgtcgcacaaaaggtggcccaataaacaacacccaaataaagcgaggggatcgacgcgccgataaaaaaaccaccatgggaaaactggcgactgggactcttgtcaagaacgacacaaggggagcgacaaacggaacacagacaaaagaaaacacaggcaaaaacaaagcacagaggacaagcacagcaggaaagaggaccaaacaatagcgacaa

SEQ ID NO: 574259 - DNA, 332 bp, Homo sapiens
ctggttaggctgcagtgcattccagcctgtgctactagagtgaatctgtctccaataaaaacaaaaaacaaaacaaataaaaaaaacaggctgggcacagtggctcatgcctgtaaacccagagctttggaaggccaaggcgggtggatcgcttgaggccaggagttcaagatcagcctagccaaaatggtgaaaccccctctctactacaaatacaaaaattagctgggtgtggtggcatgcacctgtagtcccagctactcgggaggctgaggcaggagaattgcttgaatctgggagatggaggttgcagggagccgagattgcgccac

SEQ ID NO: 574260 - DNA, 375 bp, Homo sapiens
  misc_feature (238)..(239): n is a, c, g, or t
cggccgcccttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactttttttttnngccattttattaccttctcacataatttcacatctgcttaaggttgggttttatatcatattctacattagtgattttttttttcgtaggtcgtcaatgtcttgtcattgttcattctataataaatcatttctgc

SEQ ID NO: 574261 - DNA, 202 bp, Homo sapiens
atctagcaggatccttgagctcaatgtgatcctctgcttcgaataatcttcctatggcagggcctggtggctcatgcctgtaatcccagcactttgggaggcaaggcaggtggatcacaaggtcaggagttcaagaccaccctggccaaccctggttgaaaaacccctatctctactaaacgggatacaaaatattagctat

SEQ ID NO: 574262 - DNA, 102 bp, Homo sapiens
agtagagagggaatgtggtgcttgacacccttagtttactgccttcaacacaatggacagtgagagggaaaaaaacactagacaccagcaggtgcagccagt

SEQ ID NO: 574263 - DNA, 1040 bp, Homo sapiens
  misc_feature (1029)..(1029): n is a, c, g, or t
gttctagatcgcgaacggccgccctttttttttttatgtgcatatgcggcttatatttcgggtaagggatacccggaaaccgtaagatgataatagctaatgacagaaggtaaaacatgaggcatcagtttctctaaccacgtcctacaaaaatgtgtaagataggttattgggtcagtaacagtggtttactttggatattggtctcatttagtacatagtgtcatattaattaatgtggtagaattacggctaagtagggtgatccgtgcattttcaggttaagcgggtagggtggaaaagtccagaatttcctcattggaggaaacagagctccttgaggaacactccactaagcgagaagcaggggacttctgtgcgagtctctcctcgatgtttacaccacgtgtggtcaccaagagaagtcgagaaacaaacgtactgtagcgttgcacgagaggggaaatctcagacgtgagtctcactggtggggggtgcacacagtgttcattattcccgagtggtgtgaagtggaacgagtcccgtggggcgcgcgtggcgatcaaaatctcgccccccttcatagagaagtttttggggcggggatatcacatctcccgtatagggacagtgaaaatttctcaaggcactgtgaccgagcgaaaacatctcgtggagggggggccatacaagaaataatgtcttccaagtggccaagagttttgtcccgaaaacaacgcccgatattaaaaagcggatatgtttgtgggcgcttatttcaagtgttctaaagacagccaccaaaaacacttatatttgagatttttagagagcagacctgtgatcttacaaaaaagggggaactgacgcaggtggttaataagaattgtggggctacaacacggcctctcccgatgaaaaacggcttatttacaggatggggtcgcaccagatgtgtttcccccctcttgtgtgaaaccccgaggggctctcggaaattcccctcagaggggggtctatctccatacnacttttcccca

SEQ ID NO: 574264 - DNA, 226 bp, Homo sapiens
ttggtgctcatcccccgggatcggcatggctgctcggtccagtgcgacaggcaggggcacggcggaatgtgtgcaggcaggagaagagccacgttctgcttctgggttgtgaggcttccggtcacagtgtctgggcggtccccaggtttctcaagccactggcccgggtggcacctggcccgctcctactcccttgcaggagagggcttgcgttcaggaaaccttc

SEQ ID NO: 574265 - DNA, 772 bp, Homo sapiens
cctgaagaaatgaaaggaaaacaaacagaaacacagacccccaacaaaaacaaaaaaacaccaaaaaaaacaacaaaaacaaacaaataaaaacacacagagagccacgaaggaaggtggcggaggggagagggagacagagacggccgcggcaacgcaacgcgagggacagcgccgggggcggccacgagcggcaggcaagccaacacgcacaactggcacacaggacagcacggaagagccgcacgaccgacaggaaaccgaaagcagacggccggacggcgccacgagcggccgccgagcgcaacacaacacagacgaacacacgaagcagacagccaggatcggacgcccgcgcagacggcgcgacgcgccaaggagcagacaaccgcaaaccgcgaacgcagccaccgaaggcagcccacgacggcacggccagagcaacagacgacacacgggccacggacacaacacgagcagccaaccaagcagcacagcgccaggccacacacccacacccacccctccgcgaagagcgccaccacgcgagaccgagcaccgacgaactcgcgaccaacggagacacgtaaacgacgcaacgacacaccacaagaacgagtcagcaaccaacggacaaaacaacaaaccaacaacagccgacagccaaccagcgccaacaccacagcaacaccggccgatgcgagacagcatgacaaacgaacgcgcgcacagcgaccaaccaagccacagcacgaccagcacatacacgcca

SEQ ID NO: 574266 - DNA, 205 bp, Homo sapiens
gtgtggtccgatacgaattgctactccgcctccaaagtgctgggattacaggtgtgggcgctacacctgtaatcccagcactttgggagggcaaggcaggcggatcacctgaggtcaggagtttgagaccagcctcaccaacatggaaaaaccccatctctactgaaaaaatacaaaattaaccaggtgtgatggcacattcctg

SEQ ID NO: 574267 - DNA, 349 bp, Homo sapiens
gagctgacctagaggatcccgctcccacaagaaggttattttaagaaaagaaactgagaggagcttctgtctgagttaggtcagagaccactctcttacagactaagaggttttcttcttttggtttgcttggaatgagatagagtccacactctcacctgggatggagtgccatggcgagaacttggctcactgcaaactccgcctccccagttcacgccaatctactggctcagcctccaaatagctgggattacaggcacacaccaccacaccaggctaaattttagtattttcagtaggcattgggtttcactattgttggacagacctggtctcgaaactcctg

SEQ ID NO: 574268 - DNA, 176 bp, Homo sapiens
cgttgttgcactactcatagacattagttcctgaaacaatagtttgcatgcgtacggcattcgctaccatagaaatctgggttttattgcggtcagcccctgcattcattatgtatgggtcctggtgttggccatcgccattattccacaaagattgcaaacataaacctgggcaa

SEQ ID NO: 574269 - DNA, 144 bp, Homo sapiens
cacgagggttcccaacacattggatcacgacatttgggcatacattcgaggcagaatctccctccgtcagtgatgccacccccatgcttatcctcatatcccacaggcactcaccactccaggaacaacgatagcaggccatca

SEQ ID NO: 574270 - DNA, 342 bp, Homo sapiens
cactttacacctggtgtccactggcttgctacgtcttcttcctcttctgggctggacactggcctgtggctggggttactgttccctattgaaacagcacagcacctgggtcagcctggaccctactcgccctgcataactactgtgaatgcccaaccgattccttcactccagtgtgtggggcagatggcatcacctacctgtctgactgctttgctggctgcaacagcacgaatactcacgggctgtgcgtgcctcaccaacgtacatgctgagaacgacaacgaggatcctaagaaaatactccactcaaccacacaacacgtgtgtcactcggggcat

SEQ ID NO: 574271 - DNA, 258 bp, Homo sapiens
gaagcagctgtggttcccatcaaactacgtggaagacgatggcaaccccgtgccctggagccggagagggagcacttggacgagaacagccccctagggactttcttcggggggttttggatgttccgccttttcagattgccatccgtctgagggcaagaacaaccggcttttgtcttctcatcagcatggcgtcggtggccactggtccttgatgttgctgccgacttacaggaggagctgcaggactgggtaaaa

SEQ ID NO: 574272 - DNA, 708 bp, Homo sapiens
cacggttacctttttcaactcatttttatcgaacggaacccatcgggacaaatagggctatctatcaggccaccgcccacttcacatagcaaacaattcagaccactaccacatgtaaatcgtcatcaaacgaaaatactttctcaaatcatcttacttaatacagtttctaacgccaccactcactaaccactcacttcccactaccacatttttcacactattcccattatactgcgatcagtagacttaacacttcctaccttccgaaacacttaatccagtcacaacgccaattgcctgcattcgtccaactacagatccgcccatttacaatacactcccccaaccctacataactcttaattcgctatcagcatacattctctcgacctacgctgcttccactcaatccctactcatcaacctaattcccactgcgccctgtataaaagacattaacccaaggtgattaaaagaccttgaaatccatgacgcagggagaattgggtcatttaaggctagttaacgcatttactaaacgcagacgataatggaagattaattggcagtagtaagatgaaacaattttgagaacatagaaacttggacagtgaatactggatactccagatctgcgaagctaaacgatcgcgcacctcagagaaacttcacaggttatatcatacttttttgtcacaatacttc

SEQ ID NO: 574273 - DNA, 411 bp, Homo sapiens
tgaacacccatcgaatagaaataatggacctcacaggaagaaacagtatggataccatacacaggcttccagaggccaggcccagtaattcaccatgagacagaagcctacaggtggcggtgcttggacggggcggggattatggatacattacggatacttcacttcttctataagcatatgtaaaaggagtgctacggaaagtggaaggcacagcttccggggagtcatgaactcttccactaatctcatccggtgaactccttgctgcggggcctgggggctacggcgggatcaaggcgtggaagaacctctaaggagtgcctatctggagctcaccgggtgagctatggctcggcgaggtgtaatccttcctggatctggctcagagctggtcggccgtcctcagag

SEQ ID NO: 574274 - DNA, 827 bp, Homo sapiens
ggagacaggtcgtgttcgctgtgcagtgccggtgttgcagggagtgagggcagctggagtgcgttctgccgaagcttgtggttgcacgcccatcgtcttaggggctaccttccgtgaccagtgtccgaagtctctgaagaagttggtggaggagagccgggagaagaaccagcccgaggtggacatgagtgacgcggggcatctccgaacgatgctggatgtcgaacgggcgtcttgaccttatcccatatctagggacaactggtccgtcagccataacaagctaacaatggtgccagcgaacatcgcagaactgaagaatttggaggtgctcagagcttttttaagtaaccaaatcgaggagctgcccacacaatgatcagtagcgcttcagaaagtcaaacgaccgtgaaccttggcatgaacaggctgaacactgttgccacgaggctacggctccctgccagctcttgaggttctggacttgacgtacaagaactggagcgaaaattctcttcctggaaaattcttcgtaccgtgaccgaccctgcgtgcgactctatctgaaagttgacaacgatttcgggacatcctggccggcagatcattgggggaacgctcaccaacagttgcagatactcagggcttgggggattacgacctggtctcgttgcctaagaatccggggagcttaccaagttaaggagctccaccttcagggaagcgctacacccgttttggcccccaaattaggaacttgggcttaaccggccagagccgtattcacagcgaaaacaccctggtggcccccttgggacacctccctg

SEQ ID NO: 574275 - DNA, 231 bp, Homo sapiens
tgaaccgggtacaggaggatccctagagtgagcaggctcagtctaaacgatattcggcggtcagcacggctgctcacgtgtcgacggaacttgtacagggccggcatgcaccgcagtgggtgaatagacgtcgaccaggctccagctaaccgatattcggcggtcacgcacggtgctcatgtgtcgacggaactagtacagggaggcatgcacccgcagtggtgaacacac

SEQ ID NO: 574276 - DNA, 3613 bp, Homo sapiens
  misc_feature (2)..(2): n is a, c, g, or t
  misc_feature (8)..(8): n is a, c, g, or t
  misc_feature (3611)..(3611): n is a, c, g, or t
tngggcgngaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttctttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataanaa

SEQ ID NO: 574277 - DNA, 3239 bp, Homo sapiens
  misc_feature (2)..(2): n is a, c, g, or t
  misc_feature (8)..(8): n is a, c, g, or t
  misc_feature (3237)..(3237): n is a, c, g, or t
tngggcgngaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttctttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataanaa

SEQ ID NO: 574278 - DNA, 158 bp, Homo sapiens
  misc_feature (52)..(52): n is a, c, g, or t
  misc_feature (149)..(149): n is a, c, g, or t
aggtgttctacagagaactcttctattccattcccgcagctccacttgatgncatgaaacatgggcttcagctgtgcccaacaactcctaccgggagccacttcagccgactctccgacggtccgctgcctgatgggaaccaaaagatnggggctgca

SEQ ID NO: 574279 - DNA, 2958 bp, Homo sapiens
  misc_feature (2)..(2): n is a, c, g, or t
  misc_feature (8)..(8): n is a, c, g, or t
  misc_feature (2956)..(2956): n is a, c, g, or t
tngggcgngaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttctttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataanaa

SEQ ID NO: 574280 - DNA, 167 bp, Homo sapiens
tttcagactcgcattcgctgctcttcatgtaatgtgggtcaggtactcctcagcactcgcatgtcgctgcctcttcatgtgaaatgtggcgtcgggtatctctccagcactcgcatgtcgcctgctcttcatgtgaaatggtggcgtctggtgaacccccccgcact

SEQ ID NO: 574281 - DNA, 1006 bp, Homo sapiens
  misc_feature (131)..(131): n is a, c, g, or t
tcccttcagtgccaccacccccggaaggccttccctgacccagccaggaacaaacaagggaccaagtgtgcacacattgtgcttgaaagccgtctctcctgtgtgtgccttcccccgccccatctccccgngtcttcggtgtggtgttttgccaggcttcaggcagaggcgcctgtgttcccgtgcttcttttctgaccgggaaattaaatgtgccccgtgaaggaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaacaaaaaaaaaaaaaaaaaaaaaaaaacaccaacaaaaaaaaaacagagagtcacaaaacaaatataaaaaatataaaatatcataaagcaaaataataagaacagaaaactgaaacctacacagtaacatcaccaaagagacacaacaccgaacacaacaaaagaaccatataatataaaataatgacacaaacacactatagagtataaaaacacaactacaccacaacacaaataatacatatcatactaaaacaaacatataatagtatcatataacatgtcacaccacagtgagaaatcgaagaaggaaatccagaacacacgtgtcagtgtctgataactaagataaagagagaagaagaaagaagaaaaaagagaaagaaagggaaaaaagaagaaagagagaaagagaaagaagaggggggagggaaaaaaggaataaaggaaatgagaaagtgatcgaggataaggaggggtagcgaaatgcagaagaaggtacatagcgacagagacaaggaagagatgaagactaagctagtctttagaggttatagaacgagcgagtaagatagagaagaaggagatgatagaggaggagagaggggatagatagagaaagagatgatgatagaggtgatacgagaggatgaggagtgtagagggggggtgtgaaagttagggg

SEQ ID NO: 574282 - DNA, 703 bp, Homo sapiens
  misc_feature (136)..(136): n is a, c, g, or t
  misc_feature (247)..(248): n is a, c, g, or t
  misc_feature (250)..(250): n is a, c, g, or t
  misc_feature (282)..(282): n is a, c, g, or t
  misc_feature (378)..(378): n is a, c, g, or t
  misc_feature (480)..(480): n is a, c, g, or t
  misc_feature (501)..(501): n is a, c, g, or t
  misc_feature (625)..(625): n is a, c, g, or t
  misc_feature (639)..(639): n is a, c, g, or t
  misc_feature (643)..(643): n is a, c, g, or t
  misc_feature (651)..(651): n is a, c, g, or t
  misc_feature (668)..(668): n is a, c, g, or t
tgacccagaggattacggatgagggtggaatggtctgggcagaggtcagtccgaaacttcagccctggagtgagctggagctggggcttatcttgctctctttccttatttaacttaatcttgtctttattagttntatagagatagggtctcactatgttgcccaggctggtcttgaactcctgggctcgggaaatcctttcacctcagcctcacaaagtgctgtgattacaggtatgagccactnnanccagctctttcctccttttaaaaacaagaaanctggccaggcacggtggctcatgcctataatctcaataccttgggaagctgaggcaggctgatcacttgaggccaggagttcgagaccagcctggncaacatggtgaaaccctgtctctactaaaaattcaaaaattagctgggcatagaggcacatgcctgtagtcacagctgctcaggaagctgaggcggaagaancgcttgaatccaggaggtggngattgcagtgagccgagatcgtgccactgcgctccagcctgggcaacagagcaagactccatttcaaaaacaaacaaacaaacaaaacaacaaacaaagcgaaattttagggacagatggattnttctctggaatatngacncaaccagncacatatggattgcttngaacagcaggtcagtctgcagtgggaccaatctga

SEQ ID NO: 574283 - DNA, 3107 bp, Homo sapiens
  misc_feature (2)..(2): n is a, c, g, or t
  misc_feature (8)..(8): n is a, c, g, or t
  misc_feature (3105)..(3105): n is a, c, g, or t
tngggcgngaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctccagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttctttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataanaa

SEQ ID NO: 574284 - DNA, 888 bp, Homo sapiens
  misc_feature (748)..(748): n is a, c, g, or t
atattcgatcaccgaaatgagagttcttaagtgctaattgacaaacgcgttagcaattcagttagggagtcatctcccttgatgtgtctctctttcctgtcaatgtttcatagacctaatttgcataactcaatgcgggatctaacaattgcccagctgaaaatgttagacagttttaagataacttgtgaagatagtttattttgatgccttgccagtctggggagtatgcctttttatgtagtgttgggtgttttctcttaatgtgctgtgttaataatactttctgaaagaaagaggagagttacccaaaaacttgaatctgaaatgtcttacattaagaatatcttgaatgttgtgtatatattttaaaaagcacttgtggcaaaagtagttggtacatttatttcctaatttatacatgattttcggtgtccaagtatatttgaagtgattaagtaaccagaatgttttaatctaatgtgctgtccatgttatgtagcttgttatggggaaagtgatgccagctgttcctttgcattattctatctgctggtcatatgaaatgttgagcaaagtgtggcaagctgaattgttgtgaggtgggcgtgaggtgcggtcctcatctgactacgtctattggagggccgtgaagagccaggcaagactgaaaattggcgctcgttctctgctgatgttcctgtcttcagcaatcgcgtttttgcacctgtgggccgttcccatgtgnggctccctctggcttcaagcgccttcccttcggttggcggtgttccagacgccctttaaattgcccccccttgtggttggggccccccccggtgggggcccctcagacaccttgggggcctctgtttgggccccccattt

SEQ ID NO: 574285 - DNA, 331 bp, Homo sapiens
ctgagaaagaccttgacgaaaagaagaaagaacctgcaattacatcggggaacagccctgaggcaagagaagaaaggtacttcacagtatagacatatatttatattgaaagtcatagttttacttcctgcatcaattcccctgtctaatgttcccctatttacactccttttttgttttctaatcaaatggaagtagtaaatgtatgtagccatgtattctaatttattttttttttcagattccttgaacatttgagaggtagaggacattgaataaataagaagttatttatatcgtactcaacatgtttaattgaatgggattgctg

SEQ ID NO: 574286 - DNA, 2781 bp, Homo sapiens
  misc_feature (2779)..(2779): n is a, c, g, or t
agaacattagcagcaataagaatttaagtgtaatataaatagcagacttggtttataaattaaatttcttttgtagcatgagttttcactcctttcttcccctctcatttaaaaaatcagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttctttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataanaa

SEQ ID NO: 574287 - DNA, 1598 bp, Homo sapiens
  misc_feature (760)..(760): n is a, c, g, or t
  misc_feature (1246)..(1246): n is a, c, g, or t
ttcgtgtttgtcggtctcgtgtggtgcgacgtcggtgtgctgtttgtgtgttcgtcgatgttctgttgtcgtctggtggttggtgtttctgtttcgtggttgtgtctgctggtgtgtcgtggtgtgttttggttggtgtgttggttggtgtgttgtgtgtgtgtgtgtgctgtggcgtctgttgtgcgtgtcttggggcgggtgcggggggggttggtggagaggatagtttttgtgccccccctttctccgtggaagcccctcccccccggtggttgtgcccccgctgatagagcccgcggggctctatccccctccgcgggtttttttggttctcttggcccgcgggggggggtgataacctgtttttcccccccagcagccctcgttgtgtgccccccttgtggctcctcttcttgttgggggccccccccctattgtagagcacgcacgggtgctgcccccacagagacccgcgcgcgctggggttggtccccggttccctgcggatttcttcctccgcggggctgtttttgtgtcgtcaccccacgacggtggtctcccccgcgtgttttatgggcgctttcttctggggagcccccccgcgctttttttgggcgcccagcacgccagtgggcgcccagggtgttcctcatgtgggggtcccgctctccgttgtcgctgccgcagccccctcgtgtctcccgcgcagttggggcgcgcgcacggacaagtgggggttttcaccgggtgcccctcntcgtgtgtctgccacaggagtgtcgcgaggagtgttttctcttataaaaggggggggagaacaccccccacgtgttctcttttgggaacacatatcggcgtgttgtccccacagagagtgccgccccccccaagataggggcgcttttataataatgagtttctcgcggcgcccccactcatatgtcgcacaagggcgcacattgagtgtggcgcacacttttctctcagaagggtgtttttcacaggcgcgcttctttttagaagcccccccagagagaggtgtttatagtccccccacagagtgtccgcacacacagagaggtgtctacacccccgcgcacagagtgtgtgtgtgtgtggacgttttgcgcgcgcactcatatgtgcgcgcccccccccacacactcttgtgggaacacgcgtggtgttttgttgcgcccccgtgttttttcctcacacagagagggtgtatacacggtgtgtntttctcgcgcgcgcacacataggcgccacagtgcgccacactagtgctcacactggcgcacacagtgccacacagagtgtgcctctctcctccacaggcgccccgcgcgttctccgccccacaggtttatttgttcacagcttcacaggggtgtgcccacaccgtgttcccgcgcgccctcatcacaaagaggtttctcagagagtgagaagaagttttttctccacacacagagggagcacacaaagagggttggtgggcacgcccccccacccccccccctcgggggtcccttttccttgggggtggggtttttttttttttttttttccccattacccctgggccggga

SEQ ID NO: 574288 - DNA, 257 bp, Homo sapiens
gccaccgaggtacctgtgtcctgggagagcttcaacaatggctgactgcttcatcctgtgacctggtgcaacaacactccaccatgtggtgttggttccaacatgcacatcggtatgaaacgactgaatgtgccacacatgtgtgtccaagtggcataccggtgacaactgagctgtgagtggccttggccctgagttgcacgtgtactgagtgagggcacttgagccctgatggcgatgctccagtgtgcttgggc

SEQ ID NO: 574289 - DNA, 3553 bp, Homo sapiens
  misc_feature (2)..(2): n is a, c, g, or t
  misc_feature (8)..(8): n is a, c, g, or t
  misc_feature (3551)..(3551): n is a, c, g, or t
tngggcgngaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttctttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataanaa

SEQ ID NO: 574290 - DNA, 890 bp, Homo sapiens
  misc_feature (161)..(161): n is a, c, g, or t
caatttaagctgctttcgatttcagctaaccaaggatcacaggtgccctctacacataacactgaccagacccataacattaccatcaccaatcttcagtgcacatcctcatccaccatggtcaacaatggaaccagcttccattgtgtcaactccgcatnacaacacattctctttcagggaccatttttcatcaaacgtccacctgtcctccatcagtccctcatccttttctccagcatttcccatttcgttttttaccatcccaacccagccatcacatcatcaacacacacttgtcagcctcagccaatcacaagcctccacattttcggggctttattggtttctatagtcttcacaccacacatggccaaggtgcacagcacattggggcatgtctgtgtcttcatagggcctcatcttggcgcccccttttcagtcaagaacaaccagcactcaacacaggtcaaaaggcacacacggcatcccatcagggcacccagcccatcccattgcaaccaaatcttcctggcaatacttctcaaaccaaacaagcagcaaccatcctttggcaaaaccccagttcctaggtcactttgacacaccttacttgaaacattgatccgcctggaaacgtgactccctggggctggcttttctataacatcaaagtcagactacacgccacagacctggttctccaacaccgttgaccaaggtggacgtccgttaaccgcgtggcacggcactccatcagtggccccttgttggcagtttgtcaccttggaaacttctggcatccttgactccagggacaccattgcttcaccaagtctcggtaaacgccaggtggattataaaaatgggccgtttattccctactgatt

SEQ ID NO: 574291 - DNA, 1674 bp, Homo sapiens
cggggggcgcgtctaaggtcaggtggcggtagcgtgagactagagggtttgtgcctctaaccgtatagggtgggagggggccgagacagagcagtagtactaagtgttgagttgttctttctagctatggaggtgcggggctctcttgacttagtatgagagagatagtgccagcctgttcttctcttctcgttcggtcgtcccactgcttagttgagtgactcgacggcttaatctactaagttatccatctgctgccaacttactgatggtatcggtggtcggccgcaagcaatcacttttgttgtctgtgtgtggtgggtacgagacagcaaacgaggtgctacggacaaaagtcacgcccagctgtttgtttcagcctctgcccactttggtgtggttcacgaccgtcgttgtctcttctattctgggtggggtggtgcgagactgatgttgtgtgtggcgatgaggagtgatgtgtttgttggcgcgtgctggtggtggctgcgtcggaggggtgttttgtgtgtcttctctcagcgaggggagtgacttcttttgtgtatcggctgcgccgctccacaaaaggttggtgttctagctccactacccctgtacggttggttggttgtacggttgagggtcgccccctccctcgtggtgagttttgtggttcttgttgtgggtggcgagccgcttgttcttgtcgttctctcctgcttcatccttagagggtgggtcggcgatgtatgagtaattgttgtgtctaccactcttctggtcagtatcatctttgtgcgtgctcgtctacattgttgttgtcgtcccacgaactcgtctgttcgtctagaaaacaacgacggtttctgctgtattggtggtctctcgctgaacacaccagggggttctccacacaccgcggcggagtttgtcactactctcgccgctgcgtgattgcgctgctgtgcgccgcctgtgcgccctccttgtgatatgagacatatattgtgaccaacagcgcgtgttttctctgatcactctctgggtgtctcccacaactgtgtctctctccgattggaggaccccggtgtgtgagttcatctcttttgggtgcgcccgctgagggcctccgcgcgtggttgttatgagcagcctgtgttgtctatatagagagatgggtcgcgaatataagagatatattgtctctctctctctctttctaagggcgccgcttttctgtcgagagaaattctcggggcgccgactatgtgagagagagagcccgcggtgagagttctcctctctcgagatctcccgcgcgttctgcgagtgcgtcttgccgctctctctttttgtggggggtctctactatatttgtgtcgtcacagcgggcttccgcgctttttttgttcccctctgtgcgcgcgccacacgcgccccgtctactgagagggggcgcccctcttgttatgtgctgtcgctgtggaggctatactgggctggcgggaggggggcgcccacccctcttttgttttttttttgcgtcgtggcacgttcttatacgtgtatattatcgattctttaaaaatcacgtaactttttataatgggaaaccaacttgagcccaaaattctgtcacagaaatttgggacccctttaaaaagtttaatgaga

SEQ ID NO: 574292 - DNA, 307 bp, Homo sapiens
ggcatcgagctcggtaccgattacgctcctagacggcagcctcccaagtagctgcacataggcacgttaacacacctggctaattttggtaaaattttttgtagcgatggagtctcactattgttgcccaggctggtcttgaactcctggacccaagcagtcctcctgccttggtttcccaaagtgctgtgattagaggcatgagccaccctgcctggccttatttttttttaggagaaatgtcttgctctgttgcccaggctggaatgttgtggcatgatcacagcttactgcagccttaaactcc

SEQ ID NO: 574293 - DNA, 83 bp, Homo sapiens
gttctgatggcagaatgcggtggtggtgggggtcttttgtactgttggattaataaaatgattttaaaatcccaaaaaaaaaa

SEQ ID NO: 574294 - DNA, 377 bp, Homo sapiens
  misc_feature (182)..(182): n is a, c, g, or t
  misc_feature (188)..(188): n is a, c, g, or t
ttttttttccccctcccccccagcaaggggcctggggaaacttgagcaaatgtttcattttggccgggccagtgggtaaaacccaggcctccaatgccttgtgcctttgggttccccacagcttttccaagaagggagaggggcctcccccagccggggttttcctgttccctcctccctgntgcaantgcaggcattttaaggggcaacgtgggggaagggcccgggaggcatgggattttaattgtttcttcccccctcccccggggcaaaaaaccagcccgccctcttcaggggttttttggatttttggggagggccaaagaaatctttttcccgtttcaaattatgttccccaaaaaaaaatggccttttta

SEQ ID NO: 574295 - DNA, 588 bp, Homo sapiens
  misc_feature (157)..(157): n is a, c, g, or t
gcgataccacggccaggcagctatatgtatcgttagtagagacagtgtttcagctctagtcggccaggctggtcacaacactccttacctcaggagatttgactagactcggtttcaacagtgctgggattacaggtctgagtccactgcacacggnccgtccctacaaatcttatccttcataccttataagctttccttctgtcctgtgtcatgggcagagattcttctgtccttcaatatgtgtatagttcaatgacgcagactcattctgtcatgtcgccttatcttgtgcttatctttgagggtcagagacagcgtttggtctgcctttgccatccttgcctagtctcctgattaaataggtataagaggctgataggtagccaaggttgttgtcacagattaagtccaaaagggaggtagaggtcatagatgcagcccatcactgctgagtagtctgccctttcaaacaagaggtgagtcacctttttgcttagatcttatcactggtctcatactctcgggatgccagttaacaaagacctaggctcactttttagcaggttcaagttcagcagagacaga

SEQ ID NO: 574296 - DNA, 873 bp, Homo sapiens
cgaggccgcggtccccggggtcctgtatatgtccctgatgaaaaacatgacccggtgaaagctggtgggagtcagtgaggccccgtgcgatgagtgatttgctgatgaatgtgaatgcaggctcgtgaacgcctgccatgctgcatgcgtatttggtggatcttgatgtgccatgctgtcttgctgcctgccatttgctggtggatgtgcttgtccatcatgatgcatgtgtcttggctgctgcctggttggcttggacctggccccatggatgcccatgtcacctgtggctgtcatttggctcatggctgctggggccctcgtgcaacctttcctcccagccccgggtcctactcgctgagctggctgggctagctggcaagctaggagtgaaatgaattggatagagggatggcatagaagcgaatcgcagtatgtgttagatagaaggaatagataaataagacagaggacaaaatatatgatatagaaatataatttacattcaaaagtaagtcagctaaggatgggcaagagtgagagtcgatcgtaggctagactgcaccgctttgagttcacacctaaaccatccacgcaatcacctcactcaaagcgtgccaaacaaaggatgaaaaagagcggatcttcttcctttatctctcccttcatatccttcacaatgcctgacgactccttactgctgattttggagtccaagtggacttgaatgatgctggcagggccacctgcatgactgctgatgacgggcgtgacgaacacagctataaacaccctcctttattcatcaactcggacaactcacgacgcatactcgtaagaagtatctgctacgggtaatcgcgacattttacg

SEQ ID NO: 574297 - DNA, 287 bp, Homo sapiens
  misc_feature (49)..(49): n is a, c, g, or t
  misc_feature (87)..(87): n is a, c, g, or t
  misc_feature (95)..(95): n is a, c, g, or t
  misc_feature (97)..(99): n is a, c, g, or t
  misc_feature (102)..(104): n is a, c, g, or t
  misc_feature (204)..(204): n is a, c, g, or t
  misc_feature (241)..(241): n is a, c, g, or t
  misc_feature (270)..(270): n is a, c, g, or t
  misc_feature (272)..(272): n is a, c, g, or t
  misc_feature (276)..(276): n is a, c, g, or t
caatgcacccctgtatacctggtcctggcagtagacaatctgttccatntggaagtggagacggatcagcttctcaccttctctctntttggggngnnntgnnntttcttcaattttggacttggcggttctgtggaggttaaaaaactcttcaaaattttttatcgaaacatctgtgaaagcaagccggaccatatccgtcanggtgtgacatatccacagccagctcttccagtccttngtttgcatgtcaccgcgtcccaatccatnancccnggagaaccaca

SEQ ID NO: 574298 - DNA, 269 bp, Homo sapiens
  misc_feature (49)..(49): n is a, c, g, or t
  misc_feature (87)..(87): n is a, c, g, or t
  misc_feature (95)..(95): n is a, c, g, or t
  misc_feature (97)..(99): n is a, c, g, or t
  misc_feature (102)..(104): n is a, c, g, or t
  misc_feature (204)..(204): n is a, c, g, or t
caatgcacccctgtatacctggtcctggcagtagacaatctgttccatntggaagtggagacggatcagcttctcaccttctctctntttggggngnnntgnnntttcttcaattttggacttggcggttctgtggaggttaaaaaactcttcaaaattttttatcgaaacatctgtgaaagcaagccggaccatatccgtcanggtgagaagctgatccgcctccacttccagatggaacagattgtctactgccaggaccaggtggg

SEQ ID NO: 574299 - DNA, 123 bp, Homo sapiens
ttcggcgggctgggcgtgatggcggtcgcgtcgcgcctggcggtggcgcgggtggtccagccggacgggggcgcggcgagcgggaggagggggcggcaggggttcgcggtggtagggctcccc

SEQ ID NO: 574300 - DNA, 705 bp, Homo sapiens
  misc_feature (475)..(475): n is a, c, g, or t
ttgaggcactccaattctttatggaaaattaaaagtccttcaattaaagaaccggggaaagggttttggaacagacccagtgtttcctcattaaaggtccctatagaaaccattgcgccgtgataaaaaaacgggcgtccaaagaaacttgcacgttggggttcaaaataatcaattcctgggggaaaacaccccagtatttctactcactcaaaggggcatatgcagcagcggtatcctgtctcggccccgttatcagccctaggtcctgcaaaaggggtgagatggttgccattcacattcagcagagtgacaatcctgcttctagcatttgggtagtccctaaatcaatagacaccactaaggtcatcatcgatgagcttgactcttcagtggcgcacacgcagcgagcttcaaccttaaatagtcagtgcagaaaacttactttcccctcgtctagacacgtgtaaggttnctggcgcccccgttttggagaccacatcccatgtttatcccaggaagagacaaggtccccagatcctgtgtattgcgagcgattggccaaaatgcctagtctcccctcgtcatgtgtacagtggtgaatccccttctagcataggtgcctcagcttcttcgacccgtttattcaataactggccccttcggtggaagacattaaagcgcgggtgagtgtgaaaaaaaaaa

SEQ ID NO: 574301 - DNA, 1073 bp, Homo sapiens
taacatgaatggacctggcaccgacagggtgttcagtatctgctcgaataatcgctctatcggtttaccaagccccggccccgaactaaggactcgaatgtgaccgggacagaggcacctcatcaggggcagtgccagtgagacaggcggagaaagtcatcccttcccgcaggccttggaattgaaaatgttagagcacaccatttatctagcaagccatgtagcatagagtaccgagtactcggactccagacgacccaggacgtatcacattgtaggcccctgtatggggatgtcagagagcgtccatgggaggcacgaaaagcctggacccgagcagaagaacagagtcgcaccgagggagctattaacgcgcgcgccttaagcacaggaggctgcacgaaccttataacctgccgaccgtcgtgattaacccccagttgcgatttccacccccttgcccccgcgaacacttctagtgttatccacgcgatcgaagaagttgggaaggatgcggtgtaggtactcatggaccctaggcatgagatgatatccttagctcaccgcctgtgcaattcgcagggctgctgctggaacatgggggaaatgggtacgaggcattatgccgtaactggtttgcttactgtcggcataggctgctgatgtgcttccccttatgcaaagttagtctttgctttccccagacctgcagtccccggtatcccctacaacgatatatgcctctaatacatggggcggaacagaattcactattcaagtgttcctgcccccgttaggccatgagtggatgcgtcagaggacctgggtgcccagtaggccgcatgggatccgggggaaaggggcaaagggtacagggtgtgttgagcacctacgaacattctcttgaaggattggtgcattcctcccttcggttgttccacacaagtcaatgtagcatactttacggcaggtggtaggaaggaccagttacacaattgggatttaaggtagaagagaccatccaccctgcaggagattaggcgaggccgtgcgcaacaaaaccacccaggaaa

SEQ ID NO: 574302 - DNA, 852 bp, Homo sapiens
tacaggtagctatttcctgatgaccaaatctctcaacgaagtcatgtaattaatacactatttttagcactcatcagtattctccaatgtgaccttctcattggagtacacagaaggaacgcaaagaagagcatctggacttctaagctctggattaacagcctctctaccaggccgaagcaagagacccggcggcacgagatccccggcatcagacctgggtgggtgataacctcaaagaatggctctggttctatggacagaaaacccacttgatttggcttctgagttagcagtcagaagaccctctaagtacaatagaagtgctcttaacgggactctgcctgtgtgaatcccaggccccggagtctccatctctctcggtaagccacctgcccaagaacagttggaggctgtactcatggtggttctcagcgctcagggtacctccttggagttgtgcacccgtcccaaactcctccatgcaagttctggattcctcttatcagtaccacaatccaggtacacgtactacacattacacaccaggcaacatacgggtgggcaaccgaccagcactaccctggtacacactcacgttggcatccttggggaacaaggtgctaaaaggttgagttggcaataaacgttgggtttcaaataaggtgttgcaggacacattcttcctaacgactttgggggaaaccttatacaactcaagcaaaaattccgcgacgcttagatatagctccatagaattgataacagggaactcatgccacctttatagaacctctaactgtaaacaagtgcccaaattccggctaccggcggggtacattactgcacaaa

SEQ ID NO: 574303 - DNA, 254 bp, Homo sapiens
ttgaatgtttgaatatcaccgaatgtgcatgccacgctttgtgtgtattggagaccttcctccgagctgtgaatcatgccgcaggtacccaataaccaattccgtttcgggggcttgcgggaaatatcgcaggcggcagcagttgtcatataaggtataggtccaggccaggatgcttgccaggagccaggagggcctcatctgcagcaggagccggcacttgggattctggcatatgtcaagcccagctgcgg

SEQ ID NO: 574304 - DNA, 332 bp, Homo sapiens
catgtcttgaggccaggagttcacgccaagcctgggcaacacagtgtgaccccatctctacaaagaaaaacgaaaaaaaaaagagtgaacaggcgcacatatccaaaatacagggcagtaagtatgaccacacaaattcaagaaaattttccctgtgacgttctgggatgggaacgtgcctgagctcagtagatataaaacacatttcccacattgcagacacatccattgtagaaatttcagaaacattgggggcagaaaacaatctatacaagcttccaggcgaggcaaaaaccagatttcataaacggccatggaagtacataggcagc

SEQ ID NO: 574305 - DNA, 171 bp, Homo sapiens
gtcgacctgagaacacgcagcaaactccggggaaagtctgcttctcctcaaacagaccacatctcctatccttttccttatacacttccttccatccatgcatcatcaatcccgtgtgcacacacggcagacctctctcccataaaagatggttgaagtcaccatgttaag

SEQ ID NO: 574306 - DNA, 123 bp, Homo sapiens
tatcagaaaaaaatttcaaatttgatgtgaaagacataaatacccagctacacgggaggacataggtctctcctgttacgctgggtatttatgtctttcctccaatttgaaattttctgatat

SEQ ID NO: 574307 - DNA, 897 bp, Homo sapiens
agcgggtcataaggctgtggcagccatggcgtgctatttcgatgaaccacgagtgcccagccatcggaccctgacaggagacgctaaccaacatgctgctggagctcgtgaggtcacttgtcaataggatggactttgaagacttgggtgtcggtagtagattgggacctatcacctgtctccaccagctgtcatgactgtggttgagaacctccccaggacagtgatcagaggctctcaggctgagctcaagtgccccgtgtgtctccttggaacttatgaggagagatgcgagacgtgcctagttgatgatgtccttgtcctatcaccttttccattctccatgctgcattgctgcctctggtcggtaagcaaccgcgatcaaatttcctgtccacttgctgcctgctattaggctgcccctagctcgaatgagcgactacgttattcgagggaagcggcatgacggactagtaatggctcagaaaatcaagctaggctaggcgaacacctgaacttggaggatagcctccaatgtgagccggtgtactaccgtgaggtgacggttgggggtgaggtgcgtggcccctcttgcgtcattaccttattagcccgttggggctcgctcagtttaatacggtgttcttgtatccgcgaacagcaagataaaaattaagttcgcgtccccacgcgggatgcgaatcgacggcggcatacggggcgcgaagacaaccttgccagcagaggggagcgcgcccctgtgtccaccttccttttgaggttgcccctttctggagggaggtaaagttacacgagctttggtgccggataacctgagggccataagcttggtccctgggttgtgaattgtggtaacccgggccataaattccacta

SEQ ID NO: 574308 - DNA, 1091 bp, Homo sapiens
  misc_feature (409)..(409): n is a, c, g, or t
gcaaacgagtatggcctagagtagtagtaacgctacagctagtccctagcgctgaaactacctcggccctgacaattgatattactaccactgagcatgactgaccagaaaccgcgtatgtggaatcagcacacgcagccacagcctaattattcaggcatcatccccctactataaaaaaacaatacttcaaacgaataactcatcatttcacgtctcgtttcccactacaacactatttgccctccgaacaccacactagcaatccccctcctacatagacaataactgacatgcgcatactcctctcgacaaaatcgatgagcaagatgcgcaaactgactcactttgataccaggtagaacacacatatctccgaagaagagtgtctaacctcatctatatctantctctctatcctctatcctatcactcatatccattcaacagccacagacacatacatctgtatgatgctatctgcctggcagaaaccgagaggtatatcctctcagacttttggactaagtcagtgctacttacagattgaatcgctagaccaagcactagaagagggatcgtgatcgactggctattatcatgtcctaatacatgattaccaatagtaagaacgcctttccacttgttcatcgcgcctaactgtacagctcataaaaagcaatatgctcagaataccatgggtactacacaatgatcgattgccgaaaagctatctacagtcctgatccattgaccctctatgcactggctaacgacgctcgtttggatggtaaaggtgctcttgacggggagtcgaatttatgattgctgaaagccatgtaagaaaggccggtcggttgatacaaaagtccttgcgggatagtcataaactagcggtgtagggaactagagcgtcaaatgttttggaccctgtagaaggcatagctagcgtcctgaaaaacggggggtcataaaaggcccaggtaaaaagcaaacgcaaggatttcaaacacttgcgggaaaagtttgaaccccaaacggggataaagccacaaatattgtgcacaaggacgtactaggtacacactgtg

SEQ ID NO: 574309 - DNA, 340 bp, Homo sapiens
  misc_feature (66)..(66): n is a, c, g, or t
  misc_feature (333)..(333): n is a, c, g, or t
tatccatgcacgacagagcacagattcttgtagagacgggagtggtgggtagtgccagtgcggatnatacagcatgacggtgtcacagacaggcgagtagaggacaggagagctggcagctcttacaagagaaagagaaagactgttatctgggcttggaggcaggatggtaactgcaaagcagggagaaggcggtcgggctggacgtactcctctgtcatgatccaggagaagtttgggccccttcttctgctgtgatggcgatacttgatactcggctggtggggcaagaagatccaagactcgatctgcaggagtggcagacacgtgaanagcagct

SEQ ID NO: 574310 - DNA, 515 bp, Homo sapiens
taaaagtggtccaggagaatgttttttagaccagcagaattgtgccttttattctcccctcttaaagaaaaggaatttggactttcttatggcaggccgtttctaaataatgtcttcttttggggggtcttccatggaacacgcataagtttggggccctagtttgattattatgtttattcccatttttaataaattgaaaagggaggttcaaaaatatggaattaaattgatggggctatctttgtttttttaaaaagtaaggcccagtcattcagttttaggtaaaaaatgtcctttcttaaaatgttaaaactcatgaaaattgggatttgatgcctccccctttgattggtacccccaggggttgtaaaacttggttgctgaattgagttgtttttatgttaagggtcaaaatgaaagggtagggaaagtccaggtggtggggacaaatgcattaaaaattttgttagtgttcccatttaaaaaaaatggaataaaccggggttaagcca

SEQ ID NO: 574311 - DNA, 425 bp, Homo sapiens
gaacaagtggacccgactggcgcttgtgcattccagcgtgctttcctttagaagtgatgagctctgcaggggacattgtctggcatcatgcatagcacgccttgttatggatgggacggtaggtatcaaagatatatgtgtcggggcaattaacagcgtcttcgttctgtatgtagccttgtatgtaaacaagtggggcgtgatgtgcccccggtagcttggggtcattcccatgggaaggaggctaacatgactcgtctgtgcacgaaggcattgtgaaaatcactccccaggttgtgtaggtcatactcttggagattccgatgcaagtggaatagacggtggcaatgactaaagctccgtcaaaaatgataggtatcaaaaaaaaacaaccaagagcacaaaaactcgagactagttctctc

SEQ ID NO: 574312 - DNA, 227 bp, Homo sapiens
ggcctttactcgggtctctgggctgaacgcccagctcatttttgtgcttctagaatagacacggtttcaccatgttggccaggctggtctccaactcctggctcaagtgatctgcctgcctggcctcccaaagtgctgggattacaggtgtgagccactgcaccctgcctcagtacctccattctttccacacaccctcctcacgtgctccttcctgacttctgggc

SEQ ID NO: 574313 - DNA, 288 bp, Homo sapiens
caattccattccagcgtagccagatctttcggttatgtcggacgggtagtaggtggtaggtgcctctacacgggttaatcagggggtgctagaaggttctagaaaacagagagggtgaactatatgtaaaaccagtaaattatcctcagtcctatttctcttggtagatggaaagccccagtatgcattctttccctttgggtggggaggatataaaaattagtccataagtggtggggggtgtgtaacaaatgaggtggctataacccttacgctggaatggaatgg

SEQ ID NO: 574314 - DNA, 4998 bp, Homo sapiens
aacctttgccagccttgtgggagggggctagggtacttggcttgctttgctatgtgtgtgaagttgccttcattactgcccttctcttgctgcctcctgggcagggcctgcctcctctggctcagtgtgagattgaaatccaggccctactcacatgaatttggaccctgagtccagagtttagagaggggagggagagagaagagcaccagaaaggtagatgagagacccttattttggctgtgtggaggctctaggcagctgatcgctttgaagtgtcacttgatgcttatgggcctgctgaggccttacatcctgggggagaggggaacagtgatggtgagtgggtacagactaggaggacgtgtcaagactgcttccagccctaggacagtgtattcaagagttgagtgctgagggtctgtggcgtatgcccagcccttagtttctggcccacgtgaagcaggggggcactaggacccagaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagtgggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgaaaaaaaaaaaggatcg

SEQ ID NO: 574315 - DNA, 756 bp, Homo sapiens
  misc_feature (142)..(142): n is a, c, g, or t
  misc_feature (284)..(284): n is a, c, g, or t
  misc_feature (289)..(289): n is a, c, g, or t
  misc_feature (324)..(325): n is a, c, g, or t
  misc_feature (381)..(381): n is a, c, g, or t
  misc_feature (398)..(398): n is a, c, g, or t
  misc_feature (419)..(420): n is a, c, g, or t
  misc_feature (471)..(471): n is a, c, g, or t
  misc_feature (473)..(473): n is a, c, g, or t
  misc_feature (510)..(510): n is a, c, g, or t
  misc_feature (558)..(558): n is a, c, g, or t
tgggacaatctacaaacacttttattagcaaaaggagtaagtgcagcaggggaaaaagaggggctcctccttcccctcaaaggctatcatctgccccttcccaaggggcaggccagcagggaacaagaggaccccagggttngcaagcaggctgtggaattcagacaaaagtgatccggtgtccgggaagcattgaccgtgccagacattgtgagcctcctcattattcactccaagagccgccgtggaacgtgggcggggtgtgaagccacgagatacacagngctgntcgtgcctcagagaaaccggacacttcggcccccnngagaccagttcacggacgggggcaaatatcacatctgcgtggtctcgtgagctccnagagtgtctgccccttngtctcctagaagagagtcctnngacatctccattagccgtgagggcttcattcacttcttctttctccaccanantccaccattctcagacgtgccagagcagtggaaaggngcaggatagccagcagggtccgggcagaagtatagggggcatccttanatagcccaagcctctcgcctaatctccacgtatgctgctgagatgtactcggcagagactcgtggcccatgggctgttctcacgggaacatggatttgtacgcataagaaagtcatgtcaagaggtcaccgtggaggggtcgccggtggctggcgcctaggtatgggtcgcccctggttgcctgtggccgctgtatcg

SEQ ID NO: 574316 - DNA, 445 bp, Homo sapiens
aacctctcagagagccatcaaagctcagaaacaaggtcgcacatcctgagtccactcgagcaggctttggacgaataaactgggccaatgcccttttttgttgtacccaaattttgtcctgcttgttcttgtctctgttgttcctggataccatcagctgcttgatgaaaatcaagtacaatgtgagctctgggggggggggggggccttttttcccagccttctagagctggtcctttttgaacatttttctctgcttcttcaaacagtgcaggtagatggggtaccacaccatttccaatgaatgcagtgacatttggattaattattccactgggtaagagatgaaaatcatattccacagaatccacaacaactgtatggccagcattatttcctccctggcagcggcacacgatgtcggcgtcctgcgccagcaggtcca

SEQ ID NO: 574317 - DNA, 5040 bp, Homo sapiens
aacctttgccagccttgtgggagggggctagggtacttggcttgctttgctatgtgtgtgaagttgccttcattactgcccttctcttgctgcctcctgggcagggcctgcctcctctggctcagtgtgagattgaaatccaggccctactcacatgaatttggaccctgagtccagagtttagagaggggagggagagagaagagcaccagaaaggtagatgagagacccttattttggctgtgtggaggctctaggcagctgatcgctttgaagtgtcacttgatgcttatgggcctgctgaggccttacatcctgggggagaggggaacagtgatggtgagtgggtacagactaggaggacgtgtcaagactgcttccagccctaggacagtgtattcaagagttgagtgctgagggtctgtggcgtatgcccagcccttagtttctggcccacgtgaagcaggggggcactaggacccagaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagtgggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgtgctcaagcctcgtctcattttgcaagtgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgaaaaaaaaaaaggatcg

SEQ ID NO: 574318 - DNA, 2303 bp, Homo sapiens
aacctttgccagccttgtgggagggggctagggtacttggcttgctttgctatgtgtgtgaagttgccttcattactgcccttctcttgctgcctcctgggcagggcctgcctcctctggctcagtgtgagattgaaatccaggccctactcacatgaatttggaccctgagtccagagtttagagaggggagggagagagaagagcaccagaaaggtagatgagagacccttattttggctgtgtggaggctctaggcagctgatcgctttgaagtgtcacttgatgcttatgggcctgctgaggccttacatcctgggggagaggggaacagtgatggtgagtgggtacagactaggaggacgtgtcaagactgcttccagccctaggacagtgtattcaagagttgagtgctgagggtctgtggcgtatgcccagcccttagtttctggcccacgtgaagcaggggggcactaggacccagaggctagcacggttcctgacaagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagtgggtagaggccgggtgagcaacatggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaaccgccgggatgctgaggaatggttccacgccaagagtgcagagctgaacaggaggtgtctacaacactgccatgattcagaccacagcaccacgatcgcc

SEQ ID NO: 574319 - DNA, 176 bp, Homo sapiens
cccctttttttttaaaaaaaaaaattttgccggggggggggggggggccctggaatttccaccttttgggggggggaaaggggaaaaatcggttaaaccgggggggcaagggttcaaggaagttaaattgggcccttggcctttaggggggggggaaagggggggttttttcccca

SEQ ID NO: 574320 - DNA, 510 bp, Homo sapiens
  misc_feature (270)..(270): n is a, c, g, or t
taaattgctattaaaatttagagtgtactccgggatatgctgggtcacgcctgtactcctggcactttgggaggccaaggcgggcaaatcatttgaggtcaggagttcaagaccagcctggccaacatggctgaaccccatctctactaaaaatacaaaaattagctgggcatggtggtgggcacctgtaatctcagctactcaggaggctgaggcaggagaatagcttgaacctgccactgcactccagcctgggtgacaaaagcaagnttctgtctcaaaaaaaaaaaaaaaaaaaaattacagtgtaaattagctgggcatgtggtggtacatgcctgtaatcctgtagtcccaggtactcgggaggctgaggcatgaggatctcttgaacccaggaggaggttgcagtgaattgagattacgctactgcactccagcctgggcagcagagccagaccctgtctcaaaaataaataagcagagccagactctgtctcaaaaataata

SEQ ID NO: 574321 - DNA, 358 bp, Homo sapiens
ggcacaaggcgatctctgctcactgcaacctctgcctcccatgttcaagcgattctcctgcctcaacttgccgagtagctgggattacggtcacccaccaccacgcccggctaatgcctgcattcatagttgagactgggtctcaccatgtaggccaggctggtctccaactgctacccttaatgatccgccctcctcagccttccaaagttctgcgattacaggcgtgagccactgcgccccacctataatgactttaatgctacaaattaggcagaggattggctatttttcctctgggaaagataggacgtctccatttctgttttgccgtggcagtattcatgataccatgatt

SEQ ID NO: 574322 - DNA, 234 bp, Homo sapiens
cgctgactctagagcataaaaggacgcccacgcaagacggtatttatttgatatatagctgcatgcaaggaagcaaaaactgatcttcccatgagcagcagattcgagtgttacatgtcggggtccagagcggatagaggctgtgcgcagttgctctcctggaggctgctccctggttacttggtgacgtgcatagctctctctggggggctgcagctcgtcttgcggggactg

SEQ ID NO: 574323 - DNA, 877 bp, Homo sapiens
agttgttcctcatcctgcctccttggctcgccgcatgcctgcctccgcgcgcgcgcctcctccgccgccgcggactccgcgcagtctttatcgccagagtccctgaatctctcgcttcctttttatagtcccctgcatcggatcaccgtgtgtgtgcccctaaccattgtcaggacgctagcctgtatcatccccatgctccgaatctcaccaccattggacttaagtggatgcatagactggaagttgtggtagaggcagtaactggatggagtagcgcccctgctaccgggaagtgctaagtgcggcaaaagtggggctgccccgtggtctgattctattgatggctacgcaccgagacgaaggagggagaggaacggttggtggcatggagactgaccggatgggacggaaaagaaccaccatggtcgacttgcgttgaggggcccgcaggccttggcacgtttgacccgaactagactggaccctcttgaccttcagctctgcggggcacagcggtgcctcgtcttgcacagactgtatgaggagtggacgagtggtccgatttccccacgatatgcttgcaagagcctgacccgacgggtatggatcctccgatcaggcaagcattgatcgtgtgaccccggttaacacgtatagagatatcacaaagaaaggcctgcccgttggaccctattttcacactcgttccaagttcccctggcctcaaggaaatcgttaaaatcggttgggtcaccctttctggtgctttgaggtgggccccggcccgttccccccggtgggggccagttgcccccccccgcaaaatttaaaatggcggggcttccaggccatcccaaccctataccctgttgag

SEQ ID NO: 574324 - DNA, 89 bp, Homo sapiens
aagaagctgccgttgttctgggtactacagcagaagggtatgcggaagcgagcaccccagtctgagatggctcctgccggtatgagccc

SEQ ID NO: 574325 - DNA, 1333 bp, Homo sapiens
  misc_feature (1333)..(1333): n is a, c, g, or t
tgtagacatgataagaagaaacatgttgtatgttcttgagagggatgctttaaccgaaccctcttcctccccgtcattgtactgtaactgtggacgagacagaaataattggggatatgtggaatttttaagcaacagttaaatggaaaagcatagacatattattgtagacatgataaaagaaactatttgtatgttcttatgactcgtaaggtttgataaaatgtacctttgcatgtggtgacagttgtgtgttgcattggctaggtttctcccgtgtgttgttatactaaaaatggaattgataaaccatttttttactaaaaaaaaaaaaaaaaggtagaaaaaaaaggagaaagagagaaaaataaaaaggttgacgaaggagcgcgaagaaagacgaggaatgatgcggaaacttaaacccaaggcttgataaataaacaagactgataaaatacattcaactacgtatctagaaccggaaacccagccaagacaggcaggaatgccacagacagacagtagagaaagcaggaggccggggtagacatggcaaaacacgcgctcgtccgcggaacatcacagagcactgatgaaaaacaaggagaccacagagaaccatggaacaagaagacacacaaatcaccagataggacacagagactcaactacacactcataaaccgtccggtatgatctcacaaggtgcgccatgacttattacaaagcgtattaccacatatgtaccaaatgaatcccattattaactcgatgcgatctacacctgggtacaagcagggacaccgcgtgcaactggcactgtccacggaacataagtgagggtatcacgcccaagcaaacaacaggaagaccatagaacacacaaaataaaacgtggcatatacaacgtggggcagcagtaatacccagaagagaaaagaggacaccaacgcaaaacgacaacaaacagaacagaaaagatagaagaacacacggagaaacacacagagggcgacgcaaactacagaataaagaaacagagacaagaaaccatccccaccaccaagaagtgtgagggcaacacaccacaacgcaagaaacccccagatcacaacgacacaagacgtaagagaccgccctcacagcggaggaagcccaacaaaggcggagagacaacgagacgcccccgaactaagccgttaataaccgaggggagcggaagccaacgagcagcgaacacgcactgccacacaccacgaagccgccgatagagcaccacaaaactgcgagacataggcacagacaacaagggcgacagagtaagtatgan

SEQ ID NO: 574326 - DNA, 103 bp, Homo sapiens
ctacccttttttctaagtgtttgtttttagttttgattttggaaagatgttaagcatttatttttagtattcattcccctaatttcaacataaaaaaaaaaaa

SEQ ID NO: 574327 - DNA, 998 bp, Homo sapiens
gcgtacacacgacttgagtcttctgtcacatggacggacgagctgatacgtcgttcggcagcagaggtactattgacaataaacccacgagacaccatggcaaccggagtcgagtataattggagttactctctttccctcaaccaaggcaggaatttcagccaatactgcagcagcccttcaagctggcaatggcaaataggctggtctgaaacctgctgataggcttctcaagtatccattggcagaaggtggccgaggctcactgacaaatatcattcatggctagctggggctactggaaaaatgattcttctcttatgatgattaattctttcatggatttcctatgtaattagaggtactgtctttcccccagttgtacttaccctatcttttctttaattaacattcgattccatgagcttcttatgtgcaaaactaagattcttctttagcagagcagaagcagaagagtacaactctatggtatagctagcaatattccctatgccatcggtctcaaatcaaagagtcatcatacgtaggcaacatacatgttacgtggtcacttgggcctgagtgtgcatcccagtaattctttacttgatatcgattaattccataccttggattaaaacatgctagtccacaataagaacgctcagttaccaagggcttacaagcctaactaccttataagggtctctagttctctgattaggcattggacgcaatgggcctctgcaacatttctgacctaatcaccctcattttacagctaatctcacttgggtggtgtaagccctttgggaagggccgcaatacctatattcccgggaacacctctagagtcccacgagtatctcccaaattataacaatacccacaatgggtgagcaacgaccccatttgcgcaatcaaacatgtgaaaaattaccaaagtgacatcaccgtgcatagctgacactgtgtggcgtgcattgtgatccactatc

SEQ ID NO: 574328 - DNA, 571 bp, Homo sapiens
agtatgccgtctctgatcatacagcccacgttcaagggtgtcagaccacgcaggaacaactgccttggtccttcacccttagcagcaagtcccgcttttctggggaaggggcaagtaccccaaccccttctctccgtgtctctaccccttctctgcttttccggggacagggcaagtaccccaaccccttctctccgtgtctctactccttctctgcttttctggggacagggcaagtaccccaaccccttctctccttgtctctaccccttctctgcttttctggggcaggggcaagtacccctcaaccccttctccttcacccttagcggtaagtcccgcttttctagggggcaggggcaagtaccccccaaccccttctccttcacccttagtggcaagtcctgctttcctggggcaggggcaagtaccccttaaccccttctccttcacccttagcagcaagccccacttttctagggggcaagaaaccccaaaccccttccctccgtgtctttacgctctcttttctctgggtttgcttccttcactatgggcaaccttccatcct

SEQ ID NO: 574329 - DNA, 980 bp, Homo sapiens
gctctcgccaggcgtcctcgatgaagtgatatcgtgctttaaagcctgcgtggaaatccctgacgcaccgacgtgatgcccatggaagacatgcgtggacctgggcaagttgtctccgagactactgtcgcgttaagatcatcgcgaagctgattgtgagtgatggatgccggaaacatgttgtcatctgtggggaagtccagaccatactgtgggcatccaacgccaagatgcaaggagatcctgcatgtcccttcgcgtgcgtaaggtcggtgtggtgctgtatgggcaaagaatgaccgatgatgtgcaaggtcgtactcccgagggcagcctggtaagaacaatgccaggctctggaagtaatgtttggtgccattcgatattgcgggggcaaatagtgggctattcgctgtacaccaagggagtgtccgtctactgatcatcgagggactatgtcggcttgggccaaatggggtcgccagctgatggcctgtgctggtgccagttgcccgactgtgaatgtccccttgtgccaggccagaacaattggtctcggggcccgagaaggacctccttttatccatggctttaggtatcaacactaaaggtctccatggggcacccttgataatgcctgagtgatcgtgcatgcttgagtcacgattgcgcgagcacagggggacgccagcgatggcacgcttgatgaaagtgtcaatattgccgcctttttccttggaggtggcattcagcaggtggtcggctagtggggggatcttagacctgaagtgtttggatccagagggaatctggtttgcgtcctgggggtccgaagtgcccgtgtggttggactcgggtgccagtgttagcccactatataagcggcaagagacggcggctggggggtgccacctccgaggagggtcggggaccccgggggccggggccagctgctcgccataaaaaggcggggagtgttc

SEQ ID NO: 574330 - DNA, 270 bp, Homo sapiens
  misc_feature (24)..(24): n is a, c, g, or t
  misc_feature (34)..(34): n is a, c, g, or t
ccgcggtatgtcttacggagacanagatcccctncaccctcacatgcaaaaaagaaattaatttcacttttcctcagcttcattatcttcttaattgtctttcttgccccctcagtagcaaggactgtctgtggatttctaggcagcctttctaggctgctaggttccagaaggagagtgggtttcatgctactatgtaaccactttgatattaagagtacaagaatgatactccatcccactcagctaccctcgtaagacataccgcgg

SEQ ID NO: 574331 - DNA, 122 bp, Homo sapiens
tgggcgtgtagtgctgtccagaggaaggcgtgaggtatgccccaacctacacccctcgtcactgactgctttcaactgtacaagaccagtaagtatctcacgtctggtcgagtggtacattc

SEQ ID NO: 574332 - DNA, 305 bp, Homo sapiens
aaaactttgtgtctagctcagggattgtaaacgcaccaatcatcgccctgtcaaaacagaccactcggctctctgtagaatggaccaatcagcaggatgtgggtgtggccagataacagaataaaagcaggctgcctgcaccagcaggggtaacccgctcgggtacttttctgtacgggtgtctatccacgctgtggaagctctgttctgtagtctttttgccaggtgaagctctgctactgtctcagtctatgggatccacactgccgttattagctatatgctctctctggtgaatgtctggg

SEQ ID NO: 574333 - DNA, 1300 bp, Homo sapiens
ggagctggtgcatggaatcgggagactgactgcctatgaatttgctcaacacttcaccacagcacagctggttctctgggcatcatcacaatccagccatggactggcaggcaacaccagctgcccaacatgcgaagggcactgggtgccaaggttccatacactttgtggtagcactgcgagccaaccgcagcaagcatcatttcaccagctcctgccaacagcacaggtgcaaggccagcacacattggcagcatgttcagtcatttatcagacaaacatcaatgcgtggtgtcagtctcatcacatccagcattatgtttagctcaccaccacagcatccatcgcagcattcgcaacacagcacattaatatgcacacgcttcacatagtcacattgccaccaatatatcatcggcacatcaccacacaggcccatcttcttcacatgcaacatgcacgcaagcacatcaacccatgagcccatcatttgtcaacatgctaggctatcgagacagcctgggacaccatgctcctacgagatcacccatatacgtatcacatggacttcacttgtataccacagcaagagtttagcaagcatagattagagcattatcaataaaacactattgcaccagcatgcaactaggatgaccattacacacacatcacactggcgaggtcccaaaaaccacaacattgtcctcgtagctccctcaaatttacagtacacacacacctgggcttccatacacacacaataccaaagttaacaagattaaggagacaccacactactcggacaccttgacggcaagcttggtcaacacagcgccttgaatggccaatggggacattccttgaacgtgcaaacagcacacgcactgcatatctgagattcccacgtcatcatactagccattttatttcacacaacacattggggaaccaggaatccttttcatgaaagcgattatccctggggacagcttcacaaccgcgaacacaaacacacggataaaagatatgacgcagactattgagaacacttaaactgcacaacgcggcaccacaggaagcgtcaaatagacgcggaaacacggggataacacacggacacggcagagaggccgagacaaaccgagacccgaaacatacgcgggagacacacacaggacgcgaacacaaaccacaacacgcgccaaccacgagcaggagcatgcgacaccaatccaccacccgagaacagaaaccgagcacactaacagacaaacctatcaacgaagcggcaacagac

SEQ ID NO: 574334 - DNA, 181 bp, Homo sapiens
gacgctcctcctctcagcactgtggggtatgttgtgttggggtgtttatggcaagtcactttaccttgcggatggtgggatcctgatgtctttcatccatttgtagtcaaagctggtaaagcttatcttactcctggttccctaccagtatttctaaacatgccgctgatccgattactga

SEQ ID NO: 574335 - DNA, 422 bp, Homo sapiens
  misc_feature (133)..(133): n is a, c, g, or t
gtgtatatcctgtctctccactagcactgtgaaccctcgaagccaggtgtatatcctgtctctccactagcactgtgaacccctcgaagccaggtgtatatctgtctctccactagcactgtgaacccttcangccaggtgcacatcctgtctctccactagcactgtgaacccctcgaagccaggtgcacatcctgtctctccacgtgttctttatgtctgtcacagcactgggaaaattaagaaactcaaaacatgcttgctgagaaaaggaggtccagaaaggcagggggacttgtcccaggtcaacagagagaagctcacaacaaggccacacagagaagacagccaggccctccctatgtcctctgcctccccctgtgccagtcctaccactacgcgcccagggcccaacctccaag

SEQ ID NO: 574336 - DNA, 121 bp, Homo sapiens
agaccgtgtggttggcgctgagaagtcgagatgcagcgtcagctatgtgatgtactacgagctgtcctacggcttgcggcatctgagatgcatcacgcaggtctgagactcgtcagaaggc

SEQ ID NO: 574337 - DNA, 926 bp, Homo sapiens
agctgccaaatcttgaggctgttggcgactcgcgtcgagtgggacgtcccggaaggtaggtagttgtgtgtaccgggttctgaggccatacattatatgttgacattttccacctcatagggcacagggatgcgaggattataccagagggtgggaggaggtacttcgcagggtggtgttgagaaagacttatagctggcatgatacacatatgagggcacggtgtgtgtcctagaaatataggcatgctgagtggggagacttggtgtgttacagtaacagatgattaagtagtgttggttgtaataaaacagagcaagatcaagatgtacagacatgatgtgagaaattaccacagatacaaacctaatgcgacttgaatgtgtaagccatggaagcccgcaaatgtaaccatggaaaactgaagtgagattggtgggaaacgtgaatgactttggtccgtgttatcttaggaaggtagattatctttggattcagagaaacgtgttgggacagaaggtacttaattgtaaagtaaggtggggtggttcgagaagcttggaggtcatgtctgtaatttctgttaattgattttagagaggctagggatgcaaagtgtttaagttaagaaagccttatttaactttgtggaactcgaaccagaaatgcatttgtcttagaaagtggagaatattggtgtgaggtaaagcatgtaaattgttcctctggcaaattgttcaggaattgaagtggatattaggaaaaccagtttgtaattagtctctttcttaaagaacgtaatgtaccttgggcatcagttttggctaagtttgtgggcaattaatggtggggaacacaaagttgtaaagggcaaaggtaagggaatgaaggaagtgtgtaaaaaagaaaggggggatatgaaatga

SEQ ID NO: 574338 - DNA, 717 bp, Homo sapiens
actttgacgcacgccggttttcagagtaattggccagggtctagcagacgcctgaaccgagagcgtgatactaggccatgacccagtgactgcgatagtatcgtactctcttaacagaacacacttatagctccctaaagcccatgacgccggcgggaccggcggctcagtagcccttgccggagtagtctgacaaccaggccagtcaggtatacgacgcctcacattcgatctgacgctcatcacactgctcagaccagacagactccttgtcctactcatatgagccgaagctatgacaggcagcagcttactacggcaaccagacgtccacacggtcatcgcgtactctttaatcagacatatagaccccgtcggatcagtgcttttcctacatgccataagtacagtcaccgcagcagccattcacctgctcagcagacggactgacctacatcacgactatacacgctagccaacccatgctacgagcggactaacagtcgaatcatcatcaatcaagtgcattagacccatacttcgcatataggattgtgacgacgtctagtacgtagccttcaccacgcagtacgcctcaccattaacctactgccagaacaccttaggctatgacccacgtctcaccggccagatcatgactcgactacttaccggaccctgcctactatgtaccgggcctattgccctccgtttccg

SEQ ID NO: 574339 - DNA, 1001 bp, Homo sapiens
tccaggctaaaactgatcgtaccaacaattatatgactacccacggacatgacgtttgcaaaaaatacataatttgaatcaggacaagcacccacagcctaattattagctatcatccctctacaatattttggaatcagatcaagaacaactatggagctgttgccggaactgtggctccgagctcgctctaatgagcacgcccctgcgtatggtactaagtactctgactgctgacccctcgacaatcatggggtaagcacaatgccaatttagtgcagtgaagcactatcaggcgaaaagaactctaccgtctgtatactgaatctcacctacaagtctacctgtgaagtgtatgaacattgcacagtcgaacagaactgaatgcgatgatttctatgatcttcttgcgaaaccacagcttgatacccggccttggctatcagtcacccgatgaggcgaagcagtcagaacgcctgaaggcgaggcagcatacattccctatgtctacaacgctagtaggtgtccctgtccgcctactcaatcgccagcatgatttaggactctgggacaggcctaggctcagctagaacattctactactcagtctcactgaccaagaatatcaaagtcctgagcggaacaagttaatatgactagcttacacaatggctttgatagtaaagatagctctttacggactccacttatgagttcctaaaaggcatgtagaagccccatcggggggaatacgtattgccgaggtactctgtaaaactaggcggtatgggtaatagcgcgcaatttgtcgaagcctggagaaaaattagtgagcttcgtggaaatcccaagagggaaatataaaggggctgcgggacaagacaaagggcgggaactaaccgcaagccggagaaatctcaaccgggacgggggatgtaacacagggaaccacaatcgagcgcaaggcggcaacccggaaacaattagagcgggcccgagaa

SEQ ID NO: 574340 - DNA, 165 bp, Homo sapiens
cccggggagtccacagagacacatcgtgaatgtcatccagccagtgctcccagcggacagtaactaaccatagcgtctactgcatccaccaagggataccctgagacatgctgaccaaggtgacaggccctatgcgcgcgggccccacaatgatccgatgtgaat

SEQ ID NO: 574341 - DNA, 1003 bp, Homo sapiens
ggttcgggctgcgtgggaagccacgaggggcttctacccacatctgctgcttgctgctggtcacacagctgcacaagctggccgcagacctgtgctcccccgacatgcccaacctttgggttctgtcccacgagggccacacatagccatgccagctgtgctgtggaggcttgaatgtgctgtcaccggggatggagtgccgcaatggtgtgtcacgtgcctggagcaggcaggaggctgcactgaggctggttgggagcccaccccaacactggagggcgtgctgactgactgaacaggtgcatatggtggcacatgccagaccaacaactgcggatgcctcttcgcagacttgctcactccggacttcgcaagcagagaacgacccgcagtgtatcactggctatagctaacttcacaggatgtacgcaaagacaggtcccatacctgtcaagtgttcactgtgttcaagtgaaggtcaatcctgtgacacgatatcctcatcctggaatgtgaagaaccctcgaaaaccgaatggtgcggatggatttgtgccatggtgggcctgtggtacacacatttggcctgaaataggcacgtatgtcgtctggcaagagtacaatcacgctgacttgcggtggaatcctgtcgggcacagtgtgcgacatgtgacgcgatggcttttggtttctagggctgttgaaggactgcaggcacccgtgatgaggaccgagtcggctgtcggagtctgatcgtcgatacttgtactgaattatcattgcgtaatggacaatttacaatacccagacaaggccacaatcttgaacataacatgagcacttgagcatcccatgacatgatctgatcattagtatggtcctgtacacagcgaggacggtgacagcgacctgaaccgtgacgtcaatgcgttaatcaaccgacgtactaagcgaagcaaataatggcgcaggatacggacatacttgccaagaaggttcagcgc

SEQ ID NO: 574342 - DNA, 120 bp, Homo sapiens
cacgagagaggcaggtaatgctcaagtgctgaaaagacactgatcagagatagtacaaccggcaccttgctaaatattaacttattttagtaatcaatatcccattaatggctaagacaa

SEQ ID NO: 574343 - DNA, 555 bp, Homo sapiens
aacaggtaaaaaaaaaaaattttattaaaactgggaaagaaaaaaacctcccaaaattaaaaaaaaaattttaccccggccaaaagggccaaattccggggaacaaaaaaaagggggcgcttcccgaaaaaaaaaaaaaaaggcggccaaaaaatgggagcggggggaaaaaaagaaaaaaggggtttccggggaaaaaatggggccccccaacaaaagggagaggcattttaatttttggcccccgggaaaaacccaaaaacccgccagaattttccacccgagaaacccggttaaacctcccccggggggagcgggtaaaaaacactaacccatatttttgggataaccacacaccctttgaaaaaaaaagaaaacctcccttgcgtttataaaggggcacccaaaaaagatcgcgacaaaaaaaacaaaagagtttcctggggaaaaaaggtgccgctccaaaaaaggcccacaaaaaaaaatcgctggggcaaaaaagagatacccccgcggcccccaaataaaacgggcctcaccacaatacagcgggcg

SEQ ID NO: 574344 - DNA, 331 bp, Homo sapiens
ctcaagtgatctcgtactttgatttatatacttgttagttatgatgaaaaaaaagaaaaaagaaataatggcgagttcttccaatgctaaagaatatgtcactatgatacaagtagcagttagccttataattaactgtaaacactgtctgtgggtataaagttttacctagagcattggatattaacagaccattaagcccaactttcaaaaatatgaaccctatggggacttgacaacttgaagtcaggatcttgtatgccttgaggcgaggtcaacatcatgtcatgacaatcacaacgcgtggctgattgcgcccaaaattctaggg

SEQ ID NO: 574345 - DNA, 348 bp, Homo sapiens
ctttggaggaagctgggcaggccagacctgtgccatcccaggacttggttccagtctctctctgcccctcagggagggtgctaggccactgctcattcatacaacctcaggtgtctgcaaccaggttctttctctgtgcatgtcacattagaatatggcgggttttgctaaggacaccatcaacagcttacaaaggaggaatccttatttgctgactagtaataatgtgagggggaggaggtcaaaggctgtacaacagttcctatcagactcttcactttgtttaagagttggtagccaaggtctctgagctcagtcaccattcacatagacactttgcatccagag

SEQ ID NO: 574346 - DNA, 283 bp, Homo sapiens
catggcatacgtacgtctacatctgtctgcgattgacaaggtacgtctacttgctgatctagccatggaaaggtaggcctactctgtatgtgatggaaatgtaggccttctctgtctgggatggaaaggtagggctactctgtctgggattgacaggtagggctactctgtctgggatggaaaggtaggtctactctgtctgggatggaaaggtaggtctactctgtctgggatggaaaggtagggctactctgtctgggatggacaggtaggtctactctgt

SEQ ID NO: 574347 - DNA, 142 bp, Homo sapiens
tttctttttggggggttttttcctttttgggtggccattatggctgggggttttccctttttggccccgtttcccctgctttttggtttccggttttcccctttttaatttggccctgttttttggggtttctgccccccca

SEQ ID NO: 574348 - DNA, 232 bp, Homo sapiens
aaaaaaaaatctaaagccaaattagaaaataactcccactttccaaagtgatttttagttaatgtatcatgcagcttttgagagtctttacactgggaagtttgtagaattttaaaataagtttatgaatggtgaataatatgcatgatttaagattgccattatgtaatctgggttattatgctgatggatcaccatctcttgtaattgtgttaggtttggttattttgtc

SEQ ID NO: 574349 - DNA, 328 bp, Homo sapiens
cgctgctggggcttggtgagctcaccagcactgaactttctttcatgaattcccactgatcacaaaccccacaccaccatctcactgacaccatgttcaaccatgtcttttacttaacaaattccaggaactggtcttaggaaatccaagtatcaaaccaaggttgtggagtattccacctcaggaaggaatgctgaacaactgatttacagacttgttgccccagctagaccaccaggtagcccattactcaaggtaaccattacaaccaaatagtgctaacctgcataccctacccctcacatgctttgccaagccccagctgcgg

SEQ ID NO: 574350 - DNA, 462 bp, Homo sapiens
  misc_feature (82)..(82): n is a, c, g, or t
gcacggttcgcccggctgatttagaagaaccaaatgagtgccgggaagaaggaggagctcccgaagagctttaacatcctgnctcccttccaaaaaaagggggccgagaaaaaggagctgtaaaaaggctgtctgttattttcccgggtttggtgggggtagggaggggaaagttaccccgctggctgtgagtcccttttggaatataagggggtagtgggaaaagtggtactaccccccgattttgagccctgagtatgcctggcccttgatgctaacatgccccagcttgggatgtctctaagtggttttggggaaagctggagcccttactcagggggctggtgaaatgccccccccaaaggaatgagtgctataaaaaggagagaggagtgtccccccccggtttttgcccaatgtaattttccttccattaaagtttccgtgttttggttaagtgga

SEQ ID NO: 574351 - DNA, 244 bp, Homo sapiens
tggatcgatgactccccggaataacctcactaaagactctcataccatacttggtgaggatacttcgctcaacctcttcttccctaggtcaaagccactatcatctgatgtgttagggatgggttctggatggaagaaataaatcagctcccaatgggagcccacggaactaagtagggtcccaagaaaaaaaacgggagctatttcacagagctgagcttctgccaaatttcattcctccaac

SEQ ID NO: 574352 - DNA, 841 bp, Homo sapiens
  misc_feature (30)..(30): n is a, c, g, or t
  misc_feature (69)..(69): n is a, c, g, or t
  misc_feature (78)..(78): n is a, c, g, or t
  misc_feature (108)..(108): n is a, c, g, or t
  misc_feature (123)..(123): n is a, c, g, or t
  misc_feature (149)..(149): n is a, c, g, or t
  misc_feature (183)..(183): n is a, c, g, or t
  misc_feature (226)..(226): n is a, c, g, or t
  misc_feature (236)..(236): n is a, c, g, or t
  misc_feature (309)..(309): n is a, c, g, or t
  misc_feature (547)..(547): n is a, c, g, or t
  misc_feature (609)..(609): n is a, c, g, or t
  misc_feature (633)..(633): n is a, c, g, or t
  misc_feature (648)..(648): n is a, c, g, or t
  misc_feature (688)..(688): n is a, c, g, or t
  misc_feature (697)..(697): n is a, c, g, or t
  misc_feature (728)..(728): n is a, c, g, or t
  misc_feature (757)..(757): n is a, c, g, or t
ctggcacccccccgggcaccatgccccacnctttgcctccgtaaccagccactcctcccggcactgtgnctatgtgcnagaacacactttggtcccaaacccccaccntcctcccagtgtctnaccccagcattctgcgggcaacctcncctggggcatcacagcaccccacacgccctgtgncacaagcccctggccacaggtgtaattctgggggccttgggcnacacacaggnggcagacagggctcacaaggagtcactcacagggtccacacatgcacactgagagaatttctagggaagtcantcttacattggcacattctgaaggtccatcacacataagaatcatcctaacaaaagtaagcttattgaacacctctatgtgccaggctctgtgttgggtactttgatcaatgcccctgtttcagtctcatctgtactcacggcagccctgtggagtacggtgtactggcccagcttacagatgcagaaagcgagacgttctgcatcagataaagtcacgtggctctttagtaacacgnacaaggctcctcgcaaggaactcgtggcagaagagggcagcagttggcagtagctgccgatntctgccccagctccaccattcctncctgtggctgtgccntgctcgtggtttcagtgccgtggtccatgtgctgccttangagctcganctggtgtgcttggcggcccaggctgtgagtnctctccctgctgcggcgccccacccgatncctctcccagaagcggtgggatgggccccatgaactgcacaacatgctgaggggccatgtgctgccttgataagaacagcttta

SEQ ID NO: 574353 - DNA, 889 bp, Homo sapiens
  misc_feature (121)..(122): n is a, c, g, or t
  misc_feature (124)..(124): n is a, c, g, or t
  misc_feature (175)..(175): n is a, c, g, or t
  misc_feature (207)..(207): n is a, c, g, or t
  misc_feature (430)..(430): n is a, c, g, or t
  misc_feature (433)..(433): n is a, c, g, or t
  misc_feature (455)..(455): n is a, c, g, or t
  misc_feature (486)..(487): n is a, c, g, or t
  misc_feature (499)..(499): n is a, c, g, or t
  misc_feature (507)..(507): n is a, c, g, or t
  misc_feature (509)..(509): n is a, c, g, or t
  misc_feature (514)..(514): n is a, c, g, or t
  misc_feature (518)..(518): n is a, c, g, or t
  misc_feature (528)..(528): n is a, c, g, or t
ctctgtgctagtttttctttttctgttattagcctcatcccaggatataaagctttgtgaagtacaattaacttaatgtacttgaatgaatagaacttgctacttttgtttttttttttgnnancaacagagtttggctctcattgcccaggctggagtgcgggtggtgctattncagttcaccacgaacctctgcctcctgggttncaagcgattctcctgccttagcctcccgaatggctggaattacaggcacgcaccaccatgcctgactaatttggtatttttagtagacatggggtttctccatgtgggctcaggctggtctcaaactcccaccttcgaggtgatccgcccacctcggcctcctgaggtgctgagattacaggcgtgagccattgttgccagcttgctaattttcacagaagtnganggcaattcttcacttgtaaccngtgccagtgcacagaacctttatatattttnngaagccagtacngtgctcgncntatancaangctgcttcanggatgagacctttttctaaaagcatgtaatgtgagaagccggctgctaatatcttccctctttagtgattaacaatggttggtgcagggccgggggctccaggctgtgatctagcattgggaggcgagccaggaggataactggagcctacaagtttgaggcagctgcccagaatagcagactggtctctccgagaggtaaaaatacccagtggggaggggcctggaacccagcatctgggccaggaaggaccctactggagaagagcccgagaaccgcaagcgggcaccctgggagggcctttcgaacacaatttttttttcggggcccccagaggggcccacccataaaaagctcgaga

SEQ ID NO: 574354 - DNA, 205 bp, Homo sapiens
aaaggcacatatatccacacatgcacacacagcacacacacaaacgcacacgcacacacaaacgcacacgcacacacgcacacacagcacacacacgagcacacagcacacaaacgcacagcacacgcacacacatgcacacacagcacacacactagcacacagcacgcacacaaagacacagtacacatggaatgcacacaca

SEQ ID NO: 574355 - DNA, 291 bp, Homo sapiens
  misc_feature (19)..(19): n is a, c, g, or t
  misc_feature (32)..(32): n is a, c, g, or t
  misc_feature (198)..(198): n is a, c, g, or t
  misc_feature (236)..(236): n is a, c, g, or t
  misc_feature (259)..(259): n is a, c, g, or t
ggcacagtgagcaggtctngatttcccaggtngtgtcaagacagatgggtaggccaggcacagtggctcacacctataatcccagcactttggaaggccaaggcaggcagatcagttgaagccaagagctcgagaccagcctggccagcatagcgataaccccgtctctactaaaactacaaaaattagccaggcatngtggtgcatgcctacagtcctagctacttgggaggctnaggcaccagaattgcttgaactngggaggcagagtgagccaagatcgtgctacta

SEQ ID NO: 574356 - DNA, 109 bp, Homo sapiens
tttgttgtgttgagctccgcttactgaactccgcttactgacgcttactgatgctccgcttactgatgctccgcttactgagcccgcttactgatgctccgcttactga

SEQ ID NO: 574357 - DNA, 243 bp, Homo sapiens
tcataattaacaaacaaaaagttaatatttctaatttctatgtaattactagaatatacttagaactatctccttatttaatacattctcacatggggttggcaataagcatagtcaaagttactttgatctagtcagtgaacatagaaggttctaactatctaataagtcattaagagcaaaattatttaacggttactacaagcaattcttcagctgatattaaccccccagggataataa

SEQ ID NO: 574358 - DNA, 142 bp, Homo sapiens
ggatgcctatatcccagcgcttttgggaggcaaggtgagaggatgcttaagcccagaaacgtgagaccagcctgggcaacgtagtgagacgctgtctctgtattacaaaattttttaaaaaacggtttgtaggtccttaagt

SEQ ID NO: 574359 - DNA, 296 bp, Homo sapiens
tgctgtgtgattagagtcttttagagaggggctgcaaagaagaaggtcgtccacatattgaagatgactgggagacaggtttaaggaagtgaggtttcgggctagagcttgtccaaagaaatgagggctatccctgaagccctgatggaggacagtccatgtgagttgttgtgactggagggtgtcagggtcagtccaggtgaaagcaaataggtttggggaatcagggtgtagggaaatggtaaagaaggcatccttcaggtcaattgcagtggcgaggctaggatgggtaccga

SEQ ID NO: 574360 - DNA, 366 bp, Homo sapiens
cgcttgttcaggaaaatggaagggaagtgaaaataaacgtgtattcaagtaaaataaacattcgcttctgacaggatcacaaacatttatcacagtttcatacatttctacgagggaaggaaaggcagcagagaagaaaaaaaaaatgctctttcagcctaagagacctgcatttgaaggcagggtccaccactcatggctgtgtgtaactggctagttaattggtctaagtttacatttccctatactataaaattgagataataggccgggcgcagtggcttacgcctgtaatcccagcattttgggaggccgaggcaggaggatcatgaggtcaggagttcgagatcagactgaccaaagctt

SEQ ID NO: 574361 - DNA, 1156 bp, Homo sapiens
ggcttggaccagagctggacatatgcgcgcatacgcgatgtagggatcataattacgagtcggacaccctcttgcactcgtctcaagtcctagcggccttctggagtctcccgtcactcaggacatcatctgcgacgtggggatgcctgtaatgcaccgaaccgtccgctacaactgcacgagtgatatacctcaacaggaagatcctgctcactcagacccaagatggccatggccaactgaaggcaactaccgcgagctgcgctggcttcaccccgctggctcgaggagctcgcgcaccacagaggcagtacttactgcctcggactgatacaggacctgacaaagcagcgaaaccgctacccttcggcagatgcggtgctggctgacatgggacacctgcatcgcgaagtgagatctgtgaggagctctggaacacccacagcccgcacatcgaccatggcgcctggactggcgctggcagatcatcaccaacgcctcgggcaagccacccacgtgctgcgcacacagcccaccaccaagcggctggatctcgtgacccactggtcaccagcaagaacggagggatacactctggctggccacccgcaacgcggttgcgcacgggcgcaccgcctgtactacggacggctcgtgccatgactccgccatgaaccggaaccgcctcggctcaacggatcccagaccactctggcatgaccgtgccacccccacacacacggcccacacaccgccacacacggccaccacaccgccaagagcacaaatacaaaccacaagcatcattcaaacccatgacccaacaccggacaacacacggcacagccccacccccgccacgcaccaacacggctccaacagaagcgtatctccaaaagaacaaaagcaagaaccacgaacacggcaccaaacggaccgccacacccggcaccaaacgggacagtgccaccacaacccggacacactcaagaccgacgcactacccgcacgacacgcacacagccttacagacgaggacgcacccacgacaaccacacgcaccaaacacaccaacatcgcccagcacacccataaccacacacgcccacagcccgcgaccacccccacacgcaagaacacaccaacggcccaaccc

SEQ ID NO: 574362 - DNA, 741 bp, Homo sapiens
gatgggcagggtagaggaaagggagacacgacgatgatccatctctgaagctgtcacggtgcttagtgcccgaggacagagacgaccacaaagccggtacgtgcgcaagctggatcacgaccggagctgcgaggcctccgagtcgtaatgcaggcgcgcttggtaaactctcctgcagcggagcgcacaggccgagtctggcatgctgacgactgtccgtctctggagctgggaggtgcgatgcaggatgtatgagggcaccgtgtcgtcaggacgtgcagtcacgcgtctcggatggtcgtgcagatgctcaatctaggctactgtcgggagctcttgggtgacttggatggagactcacggagtcatggaacgttgtatctctgggggaacgtgtctaggctacgagcgagagtattgtcgcagttgtgaagcaggggtgtcaatgtctggtgggtgggggaagaatgggtggtgcttggccaatggtgtgatgaagttcctaggcaggatcggctacaggttcctactgcatcgcgaggctctgtgcaactcagggcttacgaatgggtggacgggcagacacagtaacgtcccatagttcccaggctggggactggcttggccgttgtgggaaggctgggggcggattctcgttacttcgtgatgtgtgggagtcttgtcggccgcaagcggaacttccctgcgcctgccgcggacccgtgcagggtgagtgggatg

SEQ ID NO: 574363 - DNA, 211 bp, Homo sapiens
  misc_feature (50)..(50): n is a, c, g, or t
  misc_feature (86)..(86): n is a, c, g, or t
  misc_feature (103)..(103): n is a, c, g, or t
  misc_feature (119)..(119): n is a, c, g, or t
  misc_feature (182)..(183): n is a, c, g, or t
gagttgcctgagcaggtgtttggttggctcagattgccggcgcccctggnagcattggtggacacctcatcctgggaggaccaagncttcttcagccgctctnggctgcagcggtaccnattgggataataggaatccatttccaagatggcttccttggccttctggggaatagtggcatnntggttctctaggatgagcctcttgatgt

SEQ ID NO: 574364 - DNA, 129 bp, Homo sapiens
attgtcattccgaggatctaccatttgaaggagaatagggcatctcgaaagagacttgctatggggtacaaattcttccatcatcttctttagagggtgagcataatccacaagtcatctggccagaga

SEQ ID NO: 574365 - DNA, 124 bp, Homo sapiens
gagacgtagctggtaggcaagcgcagcacacggcccgggccggctttgccgcacagtggtgggagggccggggcggcgccggctgcaggtgtgggtgtggcaaggttcctggaaaaggggctgg

SEQ ID NO: 574366 - DNA, 125 bp, Homo sapiens
ctaaacatcatcaagagcaagtgatcccactgcacatcaacatggctttaaactccacacacgtttctccttctgctcgatattgaggatttcgtgcccagactccagttccaactgtaggctcc

SEQ ID NO: 574367 - DNA, 435 bp, Homo sapiens
aggccctggtctcactcttcccctcttcctggaagccttcctgctgccaccccgcgtccctccatactgtgtgccgtgcgcgcgttcgcctgcgctgggcaatctggtacaagtggtgctgggggccctggtctgttggccctgcaccgactttcccatgagttcaagagggtgtctggcttgctgcagtgaccacagaggaggcccattgcatgagttattcccaaatgaatgaatgaatgagtgagtgaatggatgcattcctctcattttacagatgagtaacccgaagcccctagaggagtggtcacctgcctgagggcacttctgtcccaccagcatcagaccaggtgtgtgcaggccgaaccgagtccccggcaccatgtttgggaagaggaagaagcgggtggagatctccgcgccgtcgcctacgca

SEQ ID NO: 574368 - DNA, 681 bp, Homo sapiens
  misc_feature (177)..(177): n is a, c, g, or t
  misc_feature (182)..(182): n is a, c, g, or t
  misc_feature (450)..(451): n is a, c, g, or t
  misc_feature (484)..(485): n is a, c, g, or t
  misc_feature (511)..(512): n is a, c, g, or t
  misc_feature (559)..(559): n is a, c, g, or t
  misc_feature (574)..(574): n is a, c, g, or t
  misc_feature (576)..(576): n is a, c, g, or t
  misc_feature (586)..(586): n is a, c, g, or t
  misc_feature (592)..(592): n is a, c, g, or t
  misc_feature (595)..(595): n is a, c, g, or t
  misc_feature (597)..(598): n is a, c, g, or t
  misc_feature (617)..(617): n is a, c, g, or t
  misc_feature (626)..(626): n is a, c, g, or t
tatgtagtgctcagcactccgtgggggcttcagactggagaagagaaaactgcccttccctttcaaggacatcctccaagggccagaatgctcagttccgtaaaattaactctccactgcctacttttttttttttttttaagacagtctcactcggggccccaggtgggagcgcanggggngtgatctgggctcactggcaacctccgcctcccggggttcaagcaattctcttacctcagccttccaagtagctggggattacagggcatgcgccacctcacccagctaattttggtatttttagtagagacgggatttcgctatctgggccaggcgggtctcaaactcctggacctctagtggatccattggcctcggcctcccaaagtggctagttattacaggtcatggagccaccatggcctgggcctggctggcctatttaanntagcaagcagttacatgttaaaagaaaagaccnngggcctgggggacgctgccaagggcnncctaatctggacacttctttcatggtgggaccaggggatctggaacnggtggtttcttccanancttttgggangctggngtncnntggggggtaagctaaatanggggccccnaaatataccccttatataaccctggtaaccggtgaatatcatctggacataaggg

SEQ ID NO: 574369 - DNA, 165 bp, Homo sapiens
tggcgtggtggtaaaacctgtaatcccagttactcggcaggctgaagaagagagtagcttgaactctggaggtggcggttgcagtgagccaagacagtgccagtgcactccagctctcggtgacgagcgcaaggctcctgtctcaactcattaaaacaaaagaaa

SEQ ID NO: 574370 - DNA, 155 bp, Homo sapiens
agaggatccgagattaggcaagcgggtagatcagtaaacattcctttttattttaaaatacttcacaaagatggtatatgttcatgatgtacagttatgtttggatgtatatatatacattctggtaagggttaccacagtcaaattaacacatg

SEQ ID NO: 574371 - DNA, 430 bp, Homo sapiens
gcactccagaaaaaaaggtgggcacacacagaccacggcgagaaagggagcaaaaccccacacgctaccccgaaagggggggtgccccgccgcgagctaggagcaacaaccacaccaccgaccagggtttgccgagtctacaaaccagcccacacctccctcgcgcaccccgcgcgcgtgtgcagccacgcgcgagggctcctccccccgtatgcacgcgcgagcgggtgctcggaaagactcctccatcataggcgaatgtggggcgaaaccaccggcaactaggcgtggacctctcccgccgccacagacaggcaagaaaggagcaggcccccgccgccgccgggccacgtcgagagacgagcgtgcgcccccgcccccgccggcgggtttcaacgaagaaagaaatatccccgtctcaccaagacga

SEQ ID NO: 574372 - DNA, 596 bp, Homo sapiens
gtgaacggatgggcccccccgagcgcgctgggccccgcggtcaaggtttaacaaactcctcagtgtcatagtgtgtcccccggtgtgtcagccagggatggctcccatgccaggcacagcagtgcagctgcagaagctcaacaaccagtatttcaaccatcatccctacccccacaagcactacatgccggatttgcaccctgctgcaggccatcagatgaacgggacaaaccgagcacttccgagattgcaaccccaagcacagcggcggcagcagcaccccctggcggctcgtggcggcagcagcatccccggcggctctggcagcagctcgggcggcggcgcgggcagcagcaacatgcggcggcggcagcggcagcggaacatgcccgcatccgtggcccaggtccccgttgcaatgcttgcgccaattgtcatagacactgatttcatcgacgaggaacgtcttatgtccttggtgatagaacatgggttgggaccgcatcaaaggagctgcccgaacatctggctgggggcaaaacgagtagggaatctcatggaccggacttcgtgttgcaaacagcaagcccagcaga

SEQ ID NO: 574373 - DNA, 507 bp, Homo sapiens
  misc_feature (25)..(25): n is a, c, g, or t
  misc_feature (47)..(47): n is a, c, g, or t
tggctatcccaggagtgttttagcntgagttttcatagatggaacancctgaagaacagaagttgtttggtctggaagaaagcaagcttggtgaaagatgggcaggggagagacggaaatgctgatctcagagaaactagagttgctgtgtgacactggaaagcaggtcaaggaccaatggacccattcagattaataaggaagatttctctaacagctactcaaagaaaaaattctgtgtgtgttgagggaagggtgggtagcaaggctccttggaggtggtcagtacccaattacaaaaagcattcaagtaagcacagactagcaaacacttagctgggatctatcaaaagggttccttttgtaagctgtggcctagaagacttttattttagagtcttattttagagacagggtcttgctatattgtccaggagatggaggttgtcgtgagctaggatctgccactgcactctagcctgggtgacagtaagacccttgtctcaa

SEQ ID NO: 574374 - DNA, 866 bp, Homo sapiens
  misc_feature (533)..(533): n is a, c, g, or t
  misc_feature (535)..(535): n is a, c, g, or t
  misc_feature (632)..(632): n is a, c, g, or t
  misc_feature (659)..(659): n is a, c, g, or t
  misc_feature (671)..(672): n is a, c, g, or t
  misc_feature (677)..(677): n is a, c, g, or t
  misc_feature (732)..(732): n is a, c, g, or t
  misc_feature (739)..(739): n is a, c, g, or t
  misc_feature (744)..(744): n is a, c, g, or t
  misc_feature (843)..(843): n is a, c, g, or t
  misc_feature (846)..(846): n is a, c, g, or t
  misc_feature (854)..(854): n is a, c, g, or t
ctgggaaagcgtttctgcgtcagcttccttttagaggagatgatggcacactatttgatgacgacttttattggaggaaagaaaacaagggctggagcagtttatatacaaggtcgctggtcgtcctctggcacagacacgcaacgttgtcttcacatgtttttactggatgaatataagtagataaaagctatactccatgtaaaatatgacatgcctgaattttggcaaggatgggggaaaaacgtgactattaatgattgataatgcaccagtgaagaagttctaatcttttagcatgctgcacagaaactggtataacatgccttcagtatactaacatctcatatgctcagttatgtctagttttggcagttgacaagaagttaatttgctttagtaaaaatccctcattccagcctttctatataaatagctctttcttgctgtcttgaatgtggtgcacactatagcctcacaaacctgttattccagtgtaatctgcagtgtcgtaactaaagttactggcttgntnttatttgcacagtttttgcgtcttgtttgcttcttgcatctgattaactagaatatttctctttccccccttttaatttgtgatgtcacttggaccncatttatgtgtaggagcactacaccanttggtttccaannactgncacacataagatacatacttgtgtgcagaaagtatcttcctccaggcttgtaatncccttcncatgnaagattaatgagggaaatctttatattctgtataaaaacaaaatcaaatttatatactaaaatcatttgtctaaaatttaagttgttttcaaataaaanttnaaatgcanttctgatatgaa

SEQ ID NO: 574375 - DNA, 419 bp, Homo sapiens
  misc_feature (419)..(419): n is a, c, g, or t
tgaatgaacacacctgtgatctatgccttgtcttgtaattgtggattaatgtgactgttaatcactccctcaaagggagagataagttggacctttttccttgctgtgccatattcagcatttgattttcatgggccccaccatttatgtgtagaatttgagacggttgtcacctttctctgaggacagagcttgcagtctgcacatcagctgctgctggagattcaaagcccagctgtgggtccgagagggaagctgactgcgctggctgaagaatgaagaccactggactctgcgctaatctgtatggggtatgcttatcaagaacgcttctgaacaatggagactttgatgcgagccatttggtccatgtgcttatctatttattagagactttctttcccttgcctgaggacccn

SEQ ID NO: 574376 - DNA, 599 bp, Homo sapiens
  misc_feature (41)..(41): n is a, c, g, or t
  misc_feature (102)..(102): n is a, c, g, or t
  misc_feature (365)..(365): n is a, c, g, or t
  misc_feature (392)..(392): n is a, c, g, or t
  misc_feature (404)..(405): n is a, c, g, or t
  misc_feature (410)..(410): n is a, c, g, or t
  misc_feature (465)..(465): n is a, c, g, or t
  misc_feature (472)..(472): n is a, c, g, or t
  misc_feature (477)..(477): n is a, c, g, or t
  misc_feature (576)..(576): n is a, c, g, or t
  misc_feature (579)..(579): n is a, c, g, or t
  misc_feature (587)..(587): n is a, c, g, or t
ctcatccgcaccaatgaagaagtgtaactaactaggcattngcgcagacactggcataggcatgccctggggtacaactaacactcaacctgctcccctttngttccggctggtctgggcagtggacaaggacattcgttggctttagtgaaactccctcgctccagcctctctaagtagctcttcccgctgtgtccgtgtgcacactgtagccccacagccccgtagaacctgcaagtgtcctggactaaagctgccgacttgctctcaatttgcacagtttttgcgtcttgtttgcttcttgcatctgattaactagaatatttctctttccccccttttaatttgtgatgtcacttggaccncatttatgtgtaggagcactacaccanttggtttccaannactgncacacataagatacatacttgtgtgcagaaagtatcttcctccaggcttgtaatncccttcncatgnaagattaatgagggaaatctttatattctgtataaaaacaaaatcaaatttatatactaaaatcatttgtctaaaatttaagttgttttcaaataaaanttnaaatgcanttctgatatgaa

SEQ ID NO: 574377 - DNA, 446 bp, Homo sapiens
  misc_feature (13)..(13): n is a, c, g, or t
  misc_feature (88)..(88): n is a, c, g, or t
ttctgccctaaanactccgtgggagaccccaggaggttcacatttgtggaaaacgattccgtgtgtcctacagcctatgtggtcacantgcctaggtgtctcgtttacctgagacagacagcccagtcccaggggggaaacacagtaaacaaagagttactgttggccgggtgcggtaactcacgcccgtaatcccagcacgttgggaggccgaggcaggtggatcataaggacaggagttcgagactagcctggccaacatggtgaaaccccgtctctacaaaaaaatacaaaaattagccgggggttggtgccggcgcctgtaatcccagctactcgggaggctgaggcaggagaatcgcttgaaactggcagtggaggtcgccgtgagccaagatggcgccactgcactccagcctatgtgacaagaccaaaactgtttcaaa

SEQ ID NO: 574378 - DNA, 146 bp, Homo sapiens
gtgggtgatctagaggatcgcgtatgtatgttcacgttcccccaaaattcacaggaaatcttactatcaatggatgatatttggagacgggactttgggaggtcgttgggtcaggtgaggtcatgagggtggaggacagattgagt

SEQ ID NO: 574379 - DNA, 242 bp, Homo sapiens
  misc_feature (112)..(112): n is a, c, g, or t
ccccaaagtggcaagccaacattccatccaattcatgtgcaagcaatcgttccggcatgcatgcacccaagcaggctcattccaagcatctctggccagtggcaggcaagtnctctttcaagcaacacatcagtttcaacaccacattagttcaaaaccattttccggtcttcatttccatttgctgtacacagttgcatcatctggctggtcccttttacatacatgccagcagtgcagca

SEQ ID NO: 574380 - DNA, 388 bp, Homo sapiens
aattttcaaatgacatttagttcatctgtattcagtattaaggtttcttcttcacttagctgagctctataaacacctgtcagtggcactatgagatacagcctttagaatattgctgtttcattcacacagtggactgtagggaggagaaagccagtgccagggagggctccttagttattgagacctcaccttcccacctctgttgtgtgctcttgggagctctaggtaggggtctcactcaagtaaggctgtgagaggtatctgggtgatggatgtgcttcaggaatgcatttcacagcagatgtttttccagacttgctgttagggtgcagtttcctccttcagggagggtttagtggctcaggaaattaataaagtcagacag

SEQ ID NO: 574381 - DNA, 889 bp, Homo sapiens
ggccactgtggtgccgggtgtttgttctgtgtgggcgctcactggaggctgttcctcgcgggcggctgttggtgaacattctcgtcttccccgcccggttctgttgtggttaacccctgcctcgggacaggccggttgtgttccaccctcgcctgttgttggggtggtgcgtttttttgtccttttggggtcattgcttcccccccccgctcgggtcgggcactccgacgcttccatggcgcgccgcggcgcgccgcccccgcagttgtggtggtgtgcacccacgatgggcgctgcccccccccccaccctccttcctgccacactcatttctctgtgtgtgtgagctgaccgtcgtttgcggtcggtccatcctctcttctcttctcgcacccccctgcttctgtcgccccgctccctctccctcaccacctcgctccgcccgtgtcttcgcactcacctcccccctccctccgtccgcgactctctctttgttgtgtgtgtgtatatagaggcaccccgtcctctcttcggggcgcccctcctatgcatacacaccggcgcgtgccacccccctccctcatccgtgggggctctgtctgttgcctcccccccgccctctctctctctgttgtcgtgcgctcgcctcctctcactgcagctccgagcgccttcttcttcgcgtctgcatcctgctgcgcccccacctcctcctcgcttgttgtgcccccgcctggtcgtcgtcgtttcttttcttgggtgtggcgcccgcctgtcggttgtggggggagacctcgtgccgccccactcaaaaaccccccccccccgtattttccctcctccccccccccccaacactcccaaaaaatataacaaaaaaatgagggga

SEQ ID NO: 574382 - DNA, 782 bp, Homo sapiens
agatcctgagaggagctacaggatgaattctagaaacagcgcacttcaggaatcatgttgcaggtgttgtgcatggatccaacacagtcggctgaaactgacaactcaagacaagtggaccagccagcaggacccagatcatccaactcggctgatcctgagacgggaccaaactgctgccgaagacgacgacctgtctctggtcactccggaggctaaccagcctacgcatggctgaagttcgaggaaacaacaagcccctgctctagctcacacactgaaagctgaactagtctatgcacggcccaacagcttgaggactcatcaacggcaagtaaatgtagttaagacatcttacaactagctagtcctcccttgtacactattcaactgcgctctacctactagtcacttgtacacatgtgctacaaccacatcctctacccaacctaaggaccctcttctgtccttactagatatgaaatatactgtacaatgtactcacagtcgtgacgcccacttaacacactgccctagacagaaaccaaccgcagacgaccgggccgtccccccaaccggcaacccaataccataccctaggcccacgcaacacacccgcataccaccaagcgaccccccacacaccagcaaaacgcctacacactgcagactacacgagcaccacaccccaaacaccaccgcaaagccgcagcgaagcgcacctcaagcacacacaagcaccccaaggcacaaggcccagccaccacacgaggacagcaaag

SEQ ID NO: 574383 - DNA, 203 bp, Homo sapiens
tgagtacatggtataatatattatcacaggatatatattacagtataactgttggatacattttcttgtccataggtcaacttcaattaagttgttaagtgttcatttaacagcttgtcttaatatatttatacttcctatttaaaacgaaaatagtacctgtgtcattgtactgatctgaaattacacactaaagcctcgtt

SEQ ID NO: 574384 - DNA, 260 bp, Homo sapiens
  misc_feature (2)..(2): n is a, c, g, or t
angagtgctcatcagcttcgaggaggagcgggccatgtgtcttcaagatttacacgctctgttgaacaccagagctgggcagggaggacacgctccactgaccacctagagctgggccagggactcaacaatggggacagaagtcccccagtgcctgacagggcttggagtggaggttcaggagcaaggtgcttctggtcctccagcccctgtactcggccattgcctgtgatcactgcggtatgcgaccctaatttgtg

SEQ ID NO: 574385 - DNA, 230 bp, Homo sapiens
ataagtacttattctagtctttattctctcagacgacacccgcctgtttgcctgacagcagagatgccggccattattcatcattcttaaagagaagaaatttcaacccagatttcatatccagccaatctaagcttcatacgtgaaggagaaataaaatcctttacaggcaagcaaatgctgagagattttgtcaccaccaggcctgctttacaagagctcctgaagga

SEQ ID NO: 574386 - DNA, 371 bp, Homo sapiens
agagtcacacgctaaaatctgtaagaggataggtgacaacgaaaatcaaccatcatgacgaaaccaatggaaagtaggaagaccgccagaaaacagacaatgttccatcgtgcgcacgagttgcggcggcgagcagaggactaccacaaatgccaaatccccccttctgcaaaagaggctcttatgcaaactgggtctgagtgccgacagcgaatcatcgtcattcttcaggattgccctactgggtcctacctcacagctgaaactttaaaaaacaggatgggccaccagccacctcctccaactcaacaacattctataactgataactccctgagcctcaagacacctcccgagtgtctgctcactcc

SEQ ID NO: 574387 - DNA, 102 bp, Homo sapiens
tcccatttagagtgccacggatccctttcccttgacttcttaaacagagtttagagtgggatcctgcagtgcgcatgaccccaggccaagccccagctgcgg

SEQ ID NO: 574388 - DNA, 308 bp, Homo sapiens
atcaaccatggaggatgctagcagcgaagctaccagttctgagatacgcagctcgtccccaagctgtgcgccgtggtagaacacccatggccccgtggagcctgacaagagacaatatccgacaggagaccctacaccctagacccagaggcttcacctgggatgctttggacctgggcgatcgtggtgtgctaaaagaactgtacaccctcctgaatgagaactatgtagaagatgatgacaacatgttccgatttgattattccccggagtatatatagtgggctctccggccacccggctgaatc

SEQ ID NO: 574389 - DNA, 462 bp, Homo sapiens
gagctgaagttgctaccggcagtcagccgcagccacagctctggttcttcctcatcgtcctcctcggaggccaaggaccgggactcgggccgtgagcagggtcctagccgcgagcctcaccccacttaacataatctgcggggaggaggagccccaggggtgctagtctggactgctgggactcggggccctggggcttaagagggaccccggctgcaactgaaatatgaagattatgggtttttttttttttttttttttccccccccttttttttgggccccccccaaaaagggagggggcctttttcccccccccctccctgcttgtccccaagtcctcacctcaaactccctccaagtcccatgtatataggtcctgatgccttcccaaccccgcccctcaccctgttgccaccttgtttcatttgtaaaaggaaatacagaaaccccccccagaaaa

SEQ ID NO: 574390 - DNA, 310 bp, Homo sapiens
gcgtccagatcaatgatctcctgtctcagcctcctgagtagtggtggatacaggtgtgcgccaccaactcctgacaaattttttatttttagtagagattgggtttcatcatgttggtcaggctggtgtcgaactcctgaccttgtgatttgcccgcctcagactcccaaagtgctaggattacaggcatgagccaccgcgcccggccgggctagacactcttttaagcaccttacatgaatgagttcactgaatgcttacagcactgccatgatacaggtcctgtgattattcctaagtcgtatccaaa

SEQ ID NO: 574391 - DNA, 344 bp, Homo sapiens
tcgctcttctacattatatacaaactggctgccagcattgatagataactcctaggccagacgtgtttcttgtccttggagctcctataccagtaacttggctgggatgttttcagagttgggcccgagatacagagtttcgccagatagaagaaatcacagatatactttagatagcatccactagtgcatccttggattagggtcaatccagatagtgagccactgctccactctgggtggctgagtctcaagtcacggcatgtgcgagctgggttctttctagagccttcaggagtaagaagggtctcaatctggttgttgagagacttcagagtagcatc

SEQ ID NO: 574392 - DNA, 462 bp, Homo sapiens
gaatagtgtcataaaaggatatcatcatcatcctcacttgattcaaaggcaacccctttcgataattgaatctgggacatgatttggctggatgatgttctggaccacctttgatcctgctttgaagtggtagggaaaaatgtcttcttccacatctgattcatctacctcaatcacctctgaataattcctagtagtgacatttcgggaaggctgctggtcttgtagatttaaaggccatctataatagacattatttctagatgctgacccaacagtctttgagttcctgctacgggtagaagtctccagaccagtgtctgctcttcctctttgagaccctcctctcgatgctgaattctgccctcttccagctcttcgaactcttcctcgggctcttcctttgttggtagctgcttagatgctatcatcagagtcattaaccctatgttctgctaaatc

SEQ ID NO: 574393 - DNA, 447 bp, Homo sapiens
gtatacagaaccaagtgtatgctaaccagatgcatcgctcgcttcagatccatggcgctctcctaccacgctatatgtgataaagataattgggctgagtacaaagagaagttacctgagatccaagaatgcggaaatgtatctgacaaaaaacatcaaactcattagcaaaacataggactcagaacgttcctgtacaagtacagactaaagtctcacggactacggcttccttggactcatatgacttgtcaagattgccacagttccgatctcaacagtgtggggtgaaacaagaagactgtctcttcagcctttttcctataatcatggatgattaggtcttattcaaaaggaccgcacatattagtactcttaagagcatcttccaagactccagcagtgagcatttagagagtgtgttgtcttccagagtcatgaatgatt

SEQ ID NO: 574394 - DNA, 137 bp, Homo sapiens
cgggtctgatctagaggatcccgaagcgcacgagtggggtgtccgtcgcttccagattgctacagatacaagtgccttgtgttcaaggtatagccaatagacactcagctacaggtaagcaggtttcttgacatcat

SEQ ID NO: 574395 - DNA, 381 bp, Homo sapiens
ggagaagccacatgcagtcgtgtgtcacttggggtggtgtgcatgctcacttgtgcgcgattgtcccttagtggttgatcacctccagaggaaggtcctataccagacaaacaccaccatttccccccctacttacgccccatgctataagaacagatcaggggctgggcaggtgtggctcacgcccagcactttgggaggccccggcaggtgagatcatttgcaggtcaggcagttcaagacctagcctggccaacatggcaaacaccttgtctctacatcaagacattttaaaaaattagccaggtgtggtggcaggtgcctgtactctcagctactggggaggctgaggcaggagaatcacttgcctctgggaggcag

SEQ ID NO: 574396 - DNA, 102 bp, Homo sapiens
atatccactttaccatgagttaaaagcacggcctggtgatcaggcgcccccgtctaggatcagtaatccctgtctagtgagcgtaatcgtggtacgcgagct

SEQ ID NO: 574397 - DNA, 129 bp, Homo sapiens
tgaaggcaattagcattgagagatcccttaatagcccattccttgagcatgccagtaatgtgcagtttatattcattgatgtgattactatatcccaggtattcttggtagtgactcttgtagagaagg

SEQ ID NO: 574398 - DNA, 394 bp, Homo sapiens
gatcccggataatatcaaggtgaaggtgatgggatgtgctgagagtcatcagtgggatgtgcaaagagggagtcatagatgtctgagcagagagaaggacctcgctggcatctacagtgaagggagggacctcgctggcatctacagtgaatggagggacctcgctggcatctatagtgaagggaagggtcacgctggcatctacagtaaagggagggacctagctggcatctacagtgacgggagggacctcgctcacatctacagtaaagggaggggccacactggcatctacagtaaagggaggggccccactggcatcaacagtgaagggaagaaccaccctggcatcaacagtgatggcggatgggcgaccagtgcagcggtgtctgga

SEQ ID NO: 574399 - DNA, 461 bp, Homo sapiens
gactctggctggcgacgtccacatcgtgagaggagacttcgatgagaatctgaattacccagaacaaaaggttgtgactgtgggccagttcaagatcggtctgatccacggacaccaagttattccgtggggagacatggctagcttagccctgctgcagaggcagtttgatgtggacattcttatctcaggacacacacacaaatttgaagcatttgagcatgaaaataaattctacattaacccaggttctgccactggggcctataatgccttggaaacaaacattattccatcgtttgtgctgatggacatccaggcttctactgtggtcacttacgtctatcaactaattggagatgacgtcaaagtagaacgaattgagtataaaaagtcgtaaagccaggctggtctccaccacttattttgtcctcatttcattgtttaaatcaaataattaa

SEQ ID NO: 574400 - DNA, 84 bp, Homo sapiens
cagctcctaggtatttgtctgactactatccccatgttagaaattcacacaacaacaacactggtcgaatcggccgcgaattta

SEQ ID NO: 574401 - DNA, 1348 bp, Homo sapiens
  misc_feature (268)..(268): n is a, c, g, or t
  misc_feature (272)..(272): n is a, c, g, or t
ggttgagagacagaggcaccccggtacagagacgtgaagcactgaataaatagatcagaagagacggaaaaatgccccagagccgacatgtggaggaggagtgacgatgagtgagctgggacaggaagctcaattataatgcctccgacctactaggatagtccctgaatagagctgcaggaagatggacaaagatgagtgagagctctaatttaagtacaagtaaaacgctgtctgggagatggtcctgtggtgcacaagacttccngaanacgcgccacacaattggtccgtttcgtcagccacggtctacactccatggattctgttgcaagaggatgcgcaccggcgcacctcaaatcaactcaatagggtagccgtgtcagcattggcaggaatcgtcgggaaggtccccgttcagatagagagggtacacaaccccagttggttgcttttacaaagcgacacgagttgtccatgaaagtgacttaggacggtctacaatatttgccactgtgcgagagagaatgcaaccaggggggattatttgcttgtccagggccctcgcatacatgacggttccgagccaccaaccgttaccagtgcaacttgggggggtggaaaaggtatggggattagacacgtcaatagattattcatgggttctcgagccaagtcttaatcgaggaaccccttcggggcctcctcgtaggcggacagcttaattcgaagcttttggccttttcaagcctacccccaacggcttgggcacgcggagggggtttcactcccacaaggtgggacaataggcttaggggcggcagtgacggtccggaccaggatgaagcccattcaatattccgaaacgcttactcctggtttcttctaacctaggccggaatccgaaattgggaacccaaaggggcaaaaggaaacagccaacctcgttcgaagcacttgtgggcacgcactggtgaagagccgcctaggttccctgggattcgtgacaaggaagaagtggacgttcggggcaaccgcgggacaacgttcgctcacctgggcaagtaccacaaaccaactccctatttggcacccgctaatacaccttgtggccccgaccatcgttgcggacaaacggcaacatgtctcgctgccgttacaaaggcggtctaggctcgggttctcccaatgggaaagcgctcacgtgggatccgcgcgtttacactttcctcccacttggttgcgcccacacttaagggcccttcggtgtgggctatccgcgccccgttctcgtctcaccaacactaaggcgttgggtccccacactaagtttccaccgcttgtgatg

SEQ ID NO: 574402 - DNA, 276 bp, Homo sapiens
cccccccccccgggcctggggaaggggtaaagggtggggggtggggccccccccctctgggtaaaaggggccccccctttgggggggggggtttttttccggggggtccggggccccaaaagcggggccccggggtttgggcccccttttgggggggggggccgggggtttttaaaccggggccccccccccctttggggtttaaggggccccgtttttttgttttgggttccccccttttgttccgttttgggtttaggccccccttttgtccga

SEQ ID NO: 574403 - DNA, 210 bp, Homo sapiens
cactgcactccacgcctgggtcgacagagtgagactctgtcagaacaaaaacaaaaactaaaaaactggtaagttctgactaagtttctgataaggtttgactacttccagcacagctaggggcatggcttactccacgtgtccccaggtccttacctagtctggaaagcaggcaagtttaaccattttcaaatagccacggtctaccca

SEQ ID NO: 574404 - DNA, 402 bp, Homo sapiens
  misc_feature (62)..(62): n is a, c, g, or t
  misc_feature (222)..(222): n is a, c, g, or t
cctttgaaagtgcgccctcagaaatgttcccccctatgattaaagaccttacctctccccanggaaaagggcctttaccccagagtccttatcccccatcctggggagaagatagttcctctgactcgagtcaccctcctagattccctgtgtcaacctaaggaaggaggaaaaaggttaagaaacatttgtaaaggtcacagtacagcaacataggcccanccaaaagattgagatgtaatcctaagaaaatggaatgcttcccttccccactccttaccaccacagcaacagggctccttataataacagtggattacagctgaaagagctgcaagatgcagacaccggctggccaaggagagggggtctcaggaaagtccaaagaaaaaaggagagatg

SEQ ID NO: 574405 - DNA, 487 bp, Homo sapiens
  misc_feature (3)..(3): n is a, c, g, or t
  misc_feature (115)..(115): n is a, c, g, or t
ttnactccctgaccttggactggtcctcgtccgtggtcgttccgcgccgtcatgtctgtcctgacgccactgctgctgaggagctgaccggctcggccggcggctcatggtgccnggctcaaggtccactcgaaagccggcgcgggacaagctcggggtcctggatatcaccattgggctcacttcctgcttcgtgtgttgtcttctgcctgcgggctgggtcctgtcacacctggagagctacaagaagcgggagtgaagggagcaagtcttccctcatcctttgactagaccacttttgccagcccaccttgatcatgttgcctgcattcctggctggccttccccgggatcatgttattcaattccagtcacctcttctgcaatcatgacctctcgatgtctccatggtgacaactgggaccacatgtattggctctgcttggtggggtccccctttgtaacaataaagtctatttaaacctga

SEQ ID NO: 574406 - DNA, 108 bp, Homo sapiens
gggttttggcccccccggggggggggttttttcccctgggcggggttttttttcaaaaaccgggtttttttttattttggaaaaaaatggttcccggcccccgggcca

SEQ ID NO: 574407 - DNA, 364 bp, Homo sapiens
cctcacgttcatgtcacactatcttggtaaatggctttacacctgcaaatgacctagttgttgctaccgatatagtttgggtggtcccacccaaattaacttggatttgtagttcccataatccccatgtgtcgtaagaaggaaccggtaggaggtaatcgaatcatgggggcaggtgttttccccaataggtctccgtgaaagtgaatacctttcacttaattcctattggtttataaagggcagtttccctgctacgtgttctcttgtgtgtggtgcctatggataacttacctttttgggccctctctttggctcccaccatgattctgaggcctctccaggcttttggacattggcgtga

SEQ ID NO: 574408 - DNA, 179 bp, Homo sapiens
atggagcgtttcggtcggactcggtcactctccgaggaacgccggtttgcgccactctaggaaagctctcgttcccttttgcttgtgcgcggtctagaacatcaggccgaattgcgcggtttcgaagccgatgcctttcttgatcgcgcattctccgccgacgttgactcagtcgagga

SEQ ID NO: 574409 - DNA, 192 bp, Homo sapiens
ggaagtgctttgggagtatataacattcagaaaggccctttccaatggatgtaagtgtaaagttaataacatgaaagtgaaacgtgggaccatttttagtatcctttatcagacttccaagcacacgagaacggggcatgccgttcgcacactttacttgtgtcagaatgccgcaagggatcatggttagtt

SEQ ID NO: 574410 - DNA, 326 bp, Homo sapiens
ttttttttttgagacggagctgtgctctgttgccagggtgcagtgcagtggcgcgatcttggctcactgcaacttccgcctccggggttcaagtgattctcctgcctcagcctccggagtagctgggattacaggtgcacgccaccatgcccagctaattttgtatttttagtagagatgggttttcaccatgttggctaggatggtctcgaactcttgacctcatgatccgcccgcctcagcctcccaaggtgctgggattacaggctgagtcactgtacccagctggaccaattatgatcttttaagtcccaacccttcattcg

SEQ ID NO: 574411 - DNA, 379 bp, Homo sapiens
atctagcaagctatggtgctcatccccagatgtctgctatcttcactcaggacacttccctccgagactgacgtctgggctttctcatttcaccccaggctgccacccatgagcacccctaaatctcatctctccacccagcacccccagcctggctccagtctgaagaccccctccttccccttccctccagaacagtggggaaagcgagtctcggtccacccctaactgcggaaggagcaacggccaggagggcagcaagtgttcccttctccggtcctggcccagccagctcctgcgtgagtgggcgggaacccactgcgctcaacaccaggtctcacctccctctctccaggggggatggagcacccattggtac

SEQ ID NO: 574412 - DNA, 80 bp, Homo sapiens
aagtaatagtacttttaataaaattaagttcttaatagcacatttaatacattaaccctcccccttctgtcgtcttctcg

SEQ ID NO: 574413 - DNA, 719 bp, Homo sapiens
  misc_feature (598)..(598): n is a, c, g, or t
cgacatcctgggcggacgtaaacatactagtgctcactctacatgcgcaatactatcacactccctgagccaccgccctaatatgacgagctcacacactatcttgtatacgcaaatatgccatcttacgcgactccactaatgactccctaaagcccatgtggaagccacgatcgatgggtcaacagaacttagacaagtactctgaacactaggcgagatatggcataatacgccttacactcattctcaccccgctgaccacatctcctaccccttccttgtactatccctatgaggcataccgatagacaggcccatctgcctactactaacagacctgaaatcactcattgaatactcttcattcaaacacataggcctcgttgtaacagacattctcatacaaacaccctgtagcttcaccgtcgcaaggagatatcataagcgtccacagacttacatgctcattactattctgcgtaccatactgatactaccaacacgctgacaggatcatgataatcctatctcgaggacttcaaactctactgccactcataagcaattgatgactgtagcaagcctcggttacctngacttaccacccactagttacctactgggagaactcattgtggtagcacagtcttctgattacatatttaccacacagaacgggggttactacccacactttacaaggggcccccctccac

SEQ ID NO: 574414 - DNA, 841 bp, Homo sapiens
atcccagcacttgggaggctgaggtgggtgggttgcctgagatcaggagttcaagaccatcccggccaacatggtgaaaccccatctctaccaaaaatacaaaaattagccaggcgtggtggtggacttctgtaatcccagctactcaggaggccgagacaggagaatcacctgaacccagggagcgaggttgcagtgagccaagatcaggccattgcactccagcctgggtgacgagaaactccatctcaaaaaaataaaaatgaactttattccatgtgtgtatatagtcatatatgttttatgtacaaaactaagatcatattgtatacacaggttgagtattacatatctgagatgcttgggacaaaagtgtttcagatttcagattttttaagatttggaacatttgcatatgcctaacgagatatcttgaggatggaacccaaatctaaacacgaaattcatttatgtttcatgtacatattatacacataagcctaaaggtaattgtgtgcaatattttaaataactttgtgtgcaaacaaagtttggttcagtacttacatatggaatttccacttgtggtgcagttgcaccaaacgttcaagattgcgagtattagatttgattcggataggatgctcatccgttaggattaacaccagaccaggttctaaatataatgtttctcattgagtcaataggatagcaatacttcatctgggggccaaatgcattaacggaactgagaagctgcgcatcactggataccggttgggactacacgcagcgtacgtgtgcaccctattggcaacactgccatgcagaggaaaagagg

SEQ ID NO: 574415 - DNA, 432 bp, Homo sapiens
gaagccactttcctttacactagaagactcaaaaaaatctagccgcaaatgtgcatcactaatcactgagcaaatatattttacttgcttgcctgagcggagcatgacgacggtaggatagcacttacacacatatgcgagacactaatagccaagggcaaaataagatacagtctttgaatgcatctttcaaggttctaacattaccccagaaacaacgtaagttaaaatggaaggtttccatttatcttctgctgttttatatcacaatctcttgatacaaaaaacaaaagccaggaaccaagaagtctatgcacaaattcaggagagctctattatttataaacaagatggctcaaccacagcatgttataacaggacacagactattgatcacatggctttttgggggtttgtactagtcataaaacc

SEQ ID NO: 574416 - DNA, 468 bp, Homo sapiens
  misc_feature (4)..(4): n is a, c, g, or t
  misc_feature (13)..(13): n is a, c, g, or t
  misc_feature (24)..(24): n is a, c, g, or t
  misc_feature (27)..(27): n is a, c, g, or t
  misc_feature (35)..(35): n is a, c, g, or t
  misc_feature (39)..(39): n is a, c, g, or t
  misc_feature (44)..(44): n is a, c, g, or t
  misc_feature (63)..(63): n is a, c, g, or t
  misc_feature (78)..(78): n is a, c, g, or t
  misc_feature (87)..(87): n is a, c, g, or t
  misc_feature (136)..(136): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (166)..(166): n is a, c, g, or t
  misc_feature (173)..(173): n is a, c, g, or t
  misc_feature (176)..(176): n is a, c, g, or t
  misc_feature (178)..(179): n is a, c, g, or t
  misc_feature (182)..(182): n is a, c, g, or t
  misc_feature (189)..(189): n is a, c, g, or t
  misc_feature (195)..(195): n is a, c, g, or t
  misc_feature (200)..(200): n is a, c, g, or t
  misc_feature (203)..(203): n is a, c, g, or t
  misc_feature (239)..(240): n is a, c, g, or t
  misc_feature (244)..(244): n is a, c, g, or t
  misc_feature (252)..(252): n is a, c, g, or t
  misc_feature (267)..(267): n is a, c, g, or t
  misc_feature (307)..(307): n is a, c, g, or t
  misc_feature (335)..(335): n is a, c, g, or t
  misc_feature (348)..(348): n is a, c, g, or t
  misc_feature (352)..(352): n is a, c, g, or t
  misc_feature (356)..(356): n is a, c, g, or t
  misc_feature (368)..(368): n is a, c, g, or t
  misc_feature (387)..(387): n is a, c, g, or t
  misc_feature (399)..(399): n is a, c, g, or t
  misc_feature (402)..(402): n is a, c, g, or t
  misc_feature (452)..(452): n is a, c, g, or t
tcgnggggggggntcaggtttaanggncactatgngggnatcgnacatcgttccaagcccggnccccgccccagcccnccctcagcngggaacacagccaggggcccccagacccctggctctgcacaaggggggnctgcccccccgccccagctanananacganagcccanccngnnggncgggganaaaagnggggngcncctgggcccagtcaggggcccctacagtccaccagnngggngggggggnccagggggccactgnggggccagggagtttctcaaaacccagggcccagccccanctgggcccctgccaagccccaggcctgngtgcggggatggngccnccanactgagggtggnaaaagctgaactcaaaagnagcaatgagagngcngggggggcttggggggatggggagcaggcgcccacccagagcctcctctnaaggaggggacgctgc

SEQ ID NO: 574417 - DNA, 1278 bp, Homo sapiens
  misc_feature (370)..(370): n is a, c, g, or t
  misc_feature (662)..(662): n is a, c, g, or t
tggccagttttttttttatttggtaaagctctgccataaatcttctagcgtgtgccaagggtacacctgccacactcgcaccaggtgttgtgtccctgtgtgtacccagcaaaacaagatgttctgggccatcagcaagaccaggccagggaaggtggcactgggggtgggttctggccttagctggctgggtactggataatctttcttggtcttcatgttcattctacaatggatctctttcccctctctaaatacccccaatattcttgagatgcgctggggcgcctgtgtgggcaagaacactggctcatgaagcgggtttaagggctgagaacgcacaggggcgtgttgagatgagtattgcccnccacctattctaacgcggtggtgaaagggtggtttggctctctccgggtgagagatatcccctataaaactatggcgctctgggcctatctctctgtggctctccacagagagacgcacccaagaggagagatccacatctctggggagagaagacagggtacacccgtgtgtggtcacaagaattagcgcctgtgtgtgtgtgcgcccacatgtgtgaggtgtggggtctcttcacaagtctgtgggcagagtgtaagagcaccagggtgtacaaataacctctgtgaganccccatgtctgtgtgtgcccacaggcccaacagaggagaagaacagatgagataaagaggagtatgagctgcgctgagtatgtgggcgacagacaaacatcgcggggaacaacaaaaagaaacaacccaccattttctgggaaagtgggggctccctcaaatcctctgagaggacccacggtgtgtttctttttcggcgaaacaacaccccccgagggggtttatttccccaataaaaggactcatggggagaggggttataaaatctactccccggagagaaattcccccaaaggaaaggaccaacatttttttggcgcccgggtgtttctgctccccaaagacagggcgaggaaaggtcgccaccgcatcttcctcacggacacaacttttccctgttgggggtgtaatgtggggccccccacccataatattttcggcgcctccgtcaggggttgagagttcggccccccgtcgtggtggaaggaaatcaccacccaggagaagggcggcccaggtaggttccacacaccccccgagaggaagcccttggtaaagaggcggaccatctggtggcgccctcttgggggcgagagatattaccaccgctttctta

SEQ ID NO: 574418 - DNA, 190 bp, Homo sapiens
gcagaaattctgactttcaataactttgcaaaggtctcatggagagcagtacttagagttatataaccacttccagagcaggaattaaatgtgagcagttgttgctgatgtctagataaggatccgtgtagtgattattatgatgtctattcttattctgagaggactatatgcacatcagtgctctctc

SEQ ID NO: 574419 - DNA, 184 bp, Homo sapiens
ttctagaggaccccggctctctacctgggtctaggggatgcacatctcctcagaaaacttctcttatataaactatgggataacttagctttcagtttaaagtaattgattggggtagtattaccacttttctattttatgggcttttaaaagcaggggtaccggagctctgaatctcgtaatc

SEQ ID NO: 574420 - DNA, 3362 bp, Homo sapiens
ccccctgcccctgggtttctctgagtttgtgtaaacaggttgcagggaaaggtttgccctgccctgctagggccatgtgctcccacggctattctccctttttgtggaaagctttatgttgtaggtctccgggatagagaaaggaatgtcatcacaccctcccgagggaggccagtggggtctggggccaggcagcatacagaggggaacaagagggcagtccctgtgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574421 - DNA, 828 bp, Homo sapiens
gggcggcggcggcggctcggcaggcgggttcaggcttcgggggcctagccgctgacatgtatcctgctggaaggtgaacaagcgacatcatcggaggacgacgctcgcgtctcagagttcgatgaactgcggcgcgcgcggaatacaatagccggatagcgagtagaagtaacattgtgctagatctcgagtgggcgtcctgcgtatcactattctcaagatcgctaatgtgatgacaatgacagaaagtgagtggtcatgtgagtgttcgttttggagagagttctactaatgtgaatccttcagtgctacagtggtagcatgattgaagttgatctagaagcgagcggtcgtaactggcggaagtttacttgtgggttgagagatgccatcgaaatgcgacgggattagtagattggtcttgcatgtatgctcgttacgtgatgtacccgtttgaagagaagttcttacctggacgatatccgataggtagtatgcctagttgattgcactgctaatggctgggaccactgtcttcgcaaagcaggacatagtgtgctgttgtggccatgcgtagatgcagttttggcacatacacagtcaccgttcgctacaatgtccgtaacgaaaggaaggggggcaacggcacaagggcaggacgtaacaatggtgcataggttagtcacagtgtgagctaggcgagttgatcgaatgaacgattgtgattgttcggacgtcctgaatcactgtgactaggaggtcgaggaaggtaacttactgacgatgcatcaacggtcggttgtgacaggggaatcgaccggaactgca

SEQ ID NO: 574422 - DNA, 395 bp, Homo sapiens
ggtttaaagaataacccatttaagggtaaggataagagtttctttcaaagaacacatgtatcacactgtaccttttatctttaaaatctggatgagttcttttgttatcaatctactgtaacatgcgctatggcagaggtttgattccagagcttaaaaaaacatttgtgaataaaatttctttttccctctccttttcctctccaatacatttgttagtgcggcatgcaagtaagaaaacagtctccgcagcaataaaacattttcgtttactggcttattgaagttgtgctgtaagtgtgtattttaattgcagaatatcgcagttcaaagactttgtatctttttctttcatagggacagttgaaagttttaataaaaagcctggaacatga

SEQ ID NO: 574423 - DNA, 3518 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaacaaaaaaaaaaaaaaaaaaaaaaaaaaaaaaaaaaaaaaaaaaaaaaggggggggcggcgccccctataaaataccccccctcgggggggcgccccccacttttgacgcctccccccaggtttcttcttctggacaccagaggggtgccccacctataatggggggcgcgccatttctatagcgcctgatcggcagtgggtgccgtcgctttataaaaccggtcgctcgacgtggggaaaaagcggtccacgctggtggaacttctgtggagagggaacccttactttgggggggcgacactgttgggggccagatatttg

SEQ ID NO: 574424 - DNA, 300 bp, Homo sapiens
tgaaatatgtggcagctgagatgagacctctggatcaggtgaggataggtggtctcctgagatcggacctcttggctcaggggaggataggtgtctccctgaggtcggaccctcttggctcaggtgaggatcaggtggtctccctgagatcgggaccctcttggctcaggtgaggatcaagtggtctccctgaggtcgtgtaccctcttggcccaggtgaggatcaggtggcctccccgaggtcgggaccctcttggctcaagagaggatgagtgtggtttttctcagcctggtctccat

SEQ ID NO: 574425 - DNA, 2920 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574426 - DNA, 237 bp, Homo sapiens
gtttagaaaaagagagatagtatgagcaagtgagctactcaagagaatctgggcctaggtggaaaaaaaaaacgggtcaaatactaaatccacgacatttctgtcctgaaaatgggctgagaaactaaacacatcccccaagaaagggaagcttgtgtgggggttgggtacccaagctaggaaaacagtacatacagagtttgcgttttggcttgtccgacagcaaccagtagcaag

SEQ ID NO: 574427 - DNA, 158 bp, Homo sapiens
ccccccccccaaaaagcccgggggttcttttgccctcccctttttttttgccttttgggggggggccctttttgttttttttcccttttttcccccaatccccccccccctccctcccccatcccggtgttcctttacccctttttgggccgttggga

SEQ ID NO: 574428 - DNA, 3043 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggcagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574429 - DNA, 926 bp, Homo sapiens
  misc_feature (366)..(366): n is a, c, g, or t
ccgagggttttaattattttaagccagagggggttcttgtgctttttgggggggatacgtcgcctggctcacggtgttcgcccccctctggtagtgagcctccccgtgttccacccccctcgttgtttgttagccctcccccctttggtggtggggacactcccgcgggggacgcgagatgttccacgacctctttcccgcgaggtcttgtttttggcgctcttgtgggccccccgcgcggggggccagcgtgatgttgtccaccgaggtgtttgcgccacccacgcggggtgatacacagcatcttttttgtcccgccactttttggggccccctctctttttttagaggtgggcacacgctctnatgtgggcggacaccaagaggttttggtgcccacacaacaagatactcccatgagcctggtgtgtacccgcggtttccgggggtttttttctcggggggtgtgacccccctgtggtcccaagacttgtccagtctcagggctcatccacttgtcgccccctctccgtggttggcaccattgtcgcgggttatgccccagagaagtttcttgtggggcccccagggagggttttttcccgcacaccggtatggatttttggttaccggggggcccccacatgggcggtcttccttcccgcattgggcggatatttttgcggcgcccccagggtttgccacaaaggagtgggaggcctggagccctggtggggcaaattgtgtctctggggcgaacgacaacacatgcgtccacacatccaagccctgggggtgtacagcacccgtggttcaccaaagttataaccttgggggcaaaagattctgggtgccacactgggcccccgggttatattcgagccctgtttcccaccagagcctcagttataacccctgggacacca

SEQ ID NO: 574430 - DNA, 3049 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574431 - DNA, 3266 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtaccagaggggtgccatgcacacctgcacaccgcatggccagaggggtccagagaagcctccaaccagtccgcttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574432 - DNA, 147 bp, Homo sapiens
ctttttagttaactgggaatataaaaaaacaagttgcgaaaaagaactggattctcatgtatatccatttagcttctggaaacctttgtcttaagaggctgcagaaattatgtggtgatctgagccccaattctgccttccaagatc

SEQ ID NO: 574433 - DNA, 2249 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagcagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574434 - DNA, 158 bp, Homo sapiens
tcatctcccttcacgtcctcatctcccttacccgtcctcatctcccttaccgtctcatctcccttaccgtcctcatctcccttaccgttctcatctcccttacgtccacatctccctatacgtctccaaggtcactccaattccctatgaacaaaaaa

SEQ ID NO: 574435 - DNA, 179 bp, Homo sapiens
  misc_feature (15)..(15): n is a, c, g, or t
catgtttgaaggcantgtaatgttgctatgggtttctggtagataatctgtaaataaaggaagtttctttctacttccagcttacatagaagtttttttgtcctctacaaatcaggaacacatccaaaactttatctttttttttttttttttttttttttggaaaaaaaatttccctc

SEQ ID NO: 574436 - DNA, 2940 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagcagtcccctctgttgggccaggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574437 - DNA, 897 bp, Homo sapiens
tcagaatcattcagtaaagcttgtgacaaatgctgactcctatggaaacccaggagtgttctgcattctactcatgcgattaacatcgataggtttcgtaagatgagaggatcttgacacgaggtagctaagtctccctagtatcgattctaattacatgcgacgagtgccgagcatcgcccaacactatgtacagcatcttgcatgcgtgtatcagtgtccccataagcacggctattagaccttatgcaggccttggttatcgcactgatcgtcgaccgtttccacgtaatcagtcactcaaattaaacggaacgtacactcattcggtctctttatagttaaccataccgatttattcctaaactactgtaaattacgttactgactaaacaacttgaggtcagttctccccatcaattttgatatgtcaattaactcgaactgtaacaggtgaccatgttacttattcatagagctggattttatacatggggaatcaccacgacaaattgcacgcgcattgcggcagcataacatactctttttcatggaactacgaagccgccctccattacataatccctagaaatactcgaaaaacttcgggttaaaagtagacccttaattggaggcgtcgtttcccttccaaaacatttggtgatgggaatcccgtccttttcggcttagaacatccaagggaatatacctcaccattaattcttcatgaaccttagcattgtccttcataacccaatttaaaaagtaagctgcgaagaacgccttttcgagacctgggctcctttgttaagaacgaaagctcccatttagctctagaataccgtccgaatacgtgagcaaatggtaacctaatttctattatccggcgatgaagag

SEQ ID NO: 574438 - DNA, 3236 bp, Homo sapiens
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctcagaggggtgccatgcacacctgcacaccgcatggccagaggggtccagagaagcctccaaccagtccgcttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574439 - DNA, 2401 bp, Homo sapiens
aaaattctggccatttgccctccttccccccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574440 - DNA, 250 bp, Homo sapiens
tgatactaacttgataggaaaatagaggacatgtacatacagagtagaaggcaataggacagggaagccagcttagatgttagagtatggatcaatcgaggaggcataaccactcttgtgggtggctatagggctggaaaatgctgaagatgactgctttcactgatggtcaaggtattgtagatattgccagtcttctgtaaatgccattcaaagccacgaagctttctatcagatgactctgtgctct

SEQ ID NO: 574441 - DNA, 177 bp, Homo sapiens
ggctgtgcactgtggcgcttttcatttcatttggtgcacactagggtcccccagcacccctcgattcagcacacgtcacggtgcggcctacaggttctgggcatccgagggccttcagtctccttcagtccgcgctgccgaagccccatgcagacgcacagacgtagtccacaacca

SEQ ID NO: 574442 - DNA, 229 bp, Homo sapiens
ttaggcagacacgagaacagccaggcaacatggcgaaaccagtctctacagaaaataaagtgggtgggcatggtggcacgcgcctgttgtcccagctgcttgagaggctgaggtgggagggttcacttgggctccaggaggctgaggctgcagtgagccgatatcacaccaccgcactccagcctcggataacagcagtgagaccatatctcaagaaaaaaagcaaagt

SEQ ID NO: 574443 - DNA, 325 bp, Homo sapiens
tctgaccacattgaaataaaattaaatatcaatataaagagaaatattcaaaaactgtacatatacatggaaattaaacagcatactcctgaacaaccaatgggtgacacaataaattagggatgaaatttaaaacttcatggaaacatataaaaatagaaacacagcactatcatctatgagacacagcaaaatgtacttacgagacaattatgtagcaatagatgcatacgtcacgaacctagatagatgtcacttaatcagcctaacattgcatctcaagggactataaacgtaggagcaacccatcccccatgttagcagt

SEQ ID NO: 574444 - DNA, 686 bp, Homo sapiens
tacggctaggtaggggcgggtgttgaatcggccgaggccgactccgacctctacttcctttctgtgcttcgtgtcctgtgacggttacatttgtgtataattgattatattattagttattattattatatttttggtaattgggagttctcgcttggagagggggatgctctcatcccctctttctggtaccccccaccattttcactggctggggggctctctttttcgcgggaaggggggacacttgcacgtgtacacatatgctgcaggaagggggtggggggcccaataaggccttgggaaaggacaggtgccgagccctgcatgtggagccactacacacacccagccccagatagagggaaataaccaaaaaactaccaaacaacagaaaaccacactctagactgaaaccccaaagtgggctagatgggagggtaagagtagcaaggggaaagtgaggcagaggttctgaaaagggtctcaggcaaagtgttcatgtagccataggcacatggagacagaatacttaagcctggccaccacaaaatgccctggacaaacacgtgccaaccagcgccgattctgagtgtagctgacccccaagggtgtgggtgcaggatgagcaacgggacggaagggcgctgggcatagaagagagacagggtagagaggggcccctg

SEQ ID NO: 574445 - DNA, 189 bp, Homo sapiens
tctattcgtcagcgaccctcttaccatccagcgctaccgaatgatgatttcatacaaaggacagagaacactcagttggctgtctagtgctaccggtggctgttctttggaagaattctcatatgcgtcgagggaagaatcactcttaaatgaacatggggactgcgagtccctctcagcctccccggc

SEQ ID NO: 574446 - DNA, 871 bp, Homo sapiens
taggcggcggttgatcccagtgattgccgagttgctggcggaccgaggcggcgagctggggcccggtgccgaccctaagtgcagcctgacccgccctcgcgcgcggcgccctccccggccgggcccctcgcctgagcgcccagccataaacctggcgagccaggagcggggagtgcctggctgccggccaggtgctctatcgccaacttcgaaccaaggacgaacacgtccctagctgttggtaggtaaaagtccgcgttattcaattttttctccctatcttctagtggataacgccaggcaaccacgtaatcatatgacattgcacccgaatagcgcgcaaacgaatgtgagcatttgctagggagaggattttatatcttctcagacaaatacaaaagatgagcccaatacgtatgaggaccataaaacagcacccaaaaggaaaggcataaaaggagatttgccagttattaaaaaagggggaaccctttgcagtgaattctatgtcacgctttactaggctataatgctttcccagagcgaccgggatatcttgcgccgttgattgcaacgtccattcaagcgaggtgtacatgcaagggccttgattacgaaatttgcacctaagaaagtgatgtacccactttattaacaattaccacaaacaacacaagtaacagagagacagactaagaagagtacgcaatggagataaacgaaattcatcggcgaaagagcagacatccctaaaacccttatagtagaggcacattgtattaagcataagaataacatatcaagcaaaagaaacaaaacatggataaatataggatcgtatccccatcggtagaggtatgacccaatatga

SEQ ID NO: 574447 - DNA, 161 bp, Homo sapiens
ctagtgatactgtgcaggggcctgttcagggctacacggcagcctcattctcccgggccaggtgatctttccacctcagctttctgagcagtgggaaccacgggcttgtgacaccaccaggccgggataatttttttttttttttttttggaaaaaaattc

SEQ ID NO: 574448 - DNA, 756 bp, Homo sapiens
gcaaggtggggctttaaactttcaaggtacaaaagtatgtcttttaaaatggaagtaacgtgggtttagcatagtgaatgtgacaatatattttatgtatataatgagtctaatgtaattttgatcaacttggtaatgatgttattaaatagcaaaacaagtgcagtgtattaaagctaaacactacattgaaacgcaaacaaaattctggtgaaataactgggctgttgatgcaggtcaggtggaagctgagaaataaatgtatataaatatgtagctgaggatattaattcccattatataaccataattctgtgacttgtaataaaccaagctgtacaatttagtttataatagcagtatctgagctgctccaaaatatatatatcaacagtggtaaatactgtagatttatatatatatatatatatatgcaaaaaatatatatatacacacaagcactatatttcttatgtcatttatgcacattttattatctgtatacttttgtagatgtgattgtaataaaaacatgctaacaagtaataagtatattgagtgtctatagatgatgcatctatgacatcacggcaaacatggtgcaccccctgaatgcttcagaaggctaattctccttctaatcgaagtagctgaagccataaatattccacctgtgataactacagtctatcgccacagttctatgttcaaatgctctcactaattcaccagaagactatttcaaaactaaaaaaa

SEQ ID NO: 574449 - DNA, 939 bp, Homo sapiens
gtaaaaacacattttcccaaagaacactgaattaccgttcaaactggttgttgatgggtaataagggctgtttttgctgccccaaaagggcttaacaatttaggcggatagtttacttaaaaaaaaaaaatccttgggagacatactgaaaatgcaaactagttctctaaattatcaattccctacatgaagaagcagtttgccacgagtttagtctcagaaaatgactggtgggctctatttaaatcagaacccaatttctacgcgtgtcgaataaggtaacagccttcgatgaatttccttcacaacatggttcctagtgaagcaaacatttttctttcaaagggcatgggccttcctagtttcatcccttttcatgaactaaacttctctcatttaaacagtcccatggtcgtttctgaaaacctacagtattctcagaagtttgtagcacgcagtaaacaacaaaacacgctgtgctccacactcagctgcatgggcggccgcattacaccgtgatattgggtaaaacccacatttggccacagttcaccgtgcttcaaacttttacccctctctaaaaaccgctgacattaactaccccagtgtgtccctaaagagggacaacatattgctgctggcacacctacacgatatacttccggctaacagctacacatccactctttgcacacaattagaggcatttggggatatcaaacacaaagttctccccggctaactatcataactagtcgccacgaatctgggaaacccctcgtggcgagtacatctcttggggagagtttcccaacgtaaatgtgtacaacacaattataggctcgaaacatcattaacgaccgtgttcactgtgtgtgccaaaggtggtaacatggaaaacggactactctggctaccccctattttcctaaacgcgat

SEQ ID NO: 574450 - DNA, 455 bp, Homo sapiens
  misc_feature (18)..(18): n is a, c, g, or t
  misc_feature (35)..(35): n is a, c, g, or t
  misc_feature (116)..(116): n is a, c, g, or t
gagacctggggaaaaaanaggaagagggacctatngaattaataaaggaagtggggataatagatgggaatttagcctcatacctatgttaaagaaaaaccatcaaaaattttaanggagccaaaaggacctataatatcattgcccaattgtactcctaatttttatatgaacacagcttttgttgttgttgtttttgaaacagcattttgcttttttgccccaggctggagtgcagtggcatgatcacggttcactgcaaccttgaactcctgagctcaagcagtcctcccaccttagcctcctaagaagcctggactacaagcagaagctacctcgcccagctaattttttaatttttagtagagacaaggtctcgctgtgttgaataggctgatcttgaatttctgggttcaagcaatcctgccttggcctcccacaatgctgggattaca

SEQ ID NO: 574451 - DNA, 288 bp, Homo sapiens
ctgtatcaaggaatggtgtgtacatataaagcaggcagtagatatgaggacttcagacaatgtaggaagcacccatcagctgcgtctcacatccagtctgacgagagaaggagcttcatctttcaagataacccgtggaatcgaagcacgtggtcgggaattaagtgtgaccgcgacaagggaaaacatggcttatactgcggaatgcctgcggggtgatgttgatattctaatggagttcctgctcaatgtcaccacagcaccagaatttcgtcgttgggaagtagc

SEQ ID NO: 574452 - DNA, 186 bp, Homo sapiens
gcggcccaattacaccgtaaggggcggcggaggtggggtggcaggcctctcttggtctggggctattcaagtctgggattcatccactcttcaacgtataaaacacactggagtcactcaacaaatagtcggctactttcatctggagaggtcttcaaatttctatacaacatatccttgaagggg

SEQ ID NO: 574453 - DNA, 572 bp, Homo sapiens
  misc_feature (8)..(8): n is a, c, g, or t
  misc_feature (35)..(35): n is a, c, g, or t
  misc_feature (73)..(73): n is a, c, g, or t
  misc_feature (106)..(106): n is a, c, g, or t
  misc_feature (126)..(126): n is a, c, g, or t
  misc_feature (129)..(129): n is a, c, g, or t
  misc_feature (134)..(134): n is a, c, g, or t
  misc_feature (147)..(147): n is a, c, g, or t
  misc_feature (347)..(347): n is a, c, g, or t
cccagacntggagttgtattggaatgtgtgcttcnatttctgttttagcaacaactcttgtcccccctagccnttacaaaattcctaattttaatatttaattttngaactttctttacagccganttncaaanagagtaactaacnagaaagtgagattgtgatgggataccggaatgtccaagtctaattgtcgggaaaagaccaaaataacatggggattgccaatccaaatgggactaaggacttagaagatccgaaactatgaagctactaaaagaaacattggggaatgcctccggacttggtctgggcaaagatttcttgagcataccttaaaggacagncacccagcaaaatggacagatgggatcacatcaagctaaaaaacttctacacagcgaaggaaacaaagtgaacagaataacatgggaatgttttctgtaatttagtagtaactggcaatagtttacaaacacattttgtgtatactgctgtcattgcactgattaccttctgttgtagtgactttgttctattagtccactcaattaaaatatttggttttgttt

SEQ ID NO: 574454 - DNA, 1247 bp, Homo sapiens
  misc_feature (297)..(297): n is a, c, g, or t
  misc_feature (311)..(311): n is a, c, g, or t
  misc_feature (868)..(868): n is a, c, g, or t
aatcgtccatctggtggcgtatcgtatgatgacgtcttcgagactgcatagcgacgggcctgtgaacggctaagaagtttaatacaggcagggtaattctatattcccgtgatgtttcatgcgtgccgctctgcggtcactcatactagtgtgcagggtatccatgacagttgaatctgcgccgagtaatttacatgcagttgggcgtacattggctaaccgcggggtactgtactcaccccgcacagcctcacaacctggtgccatcagattgagcgaacgtgggcgcggacctantgaccagctggcangagttcttgtatacttggcagcttcgcattaccatcgctgtgtcgctacacctacaggagccagacgacagactgcggtctgtcaaaattttgctatagtcacaggattagactagagactcatcggtcatacgggggacgatataaatgcaagggacccaggtgtgccaagaaagatttaccttactgggttcgggagaaggtgaatggccaaaaccaatcggtcgattattaccccggttttcgcacctcgcaaattaaattacttcgagcttgagccagacaggagactgcgaagaccacggcgtctgtacttaggagagggtagtctgtggccaacttatacaattcaggtaggtacccaagagggacacggatgggcaacgttctagaggcatgacataatcgtgttggctactactcctgtacgaggcaaggtggggtcaattccggaaaaggggatcgagaagcgattggctcctgaacgaccatattagaaccggtggtaccagcccttttgacttagaaatcttcgatcaattagattcccaaagagnagattatttcccaagggcttgtgtgtccgataagtattaaggacgggataaacgcggtggcattgcgggctaggtaatcaccgtgctcttggatacgtcactcgtctcaactgaatcattgggagacacttgtgcgcttggcaagtttgctctaaggcaagccctggcaaggaattgtgttcgccgctaattgaatggcgcaccttggaggtgcctaggaccgatggccaatataacacagaaaatattatcgttgccagtgcgtggaatagaaagagaacgttgggccccggcggaacacgacccgtggggattgcgcagtaaattgcacccggtggcggacacaaaatacccgggttgggggcaaaacgttccccag

SEQ ID NO: 574455 - DNA, 528 bp, Homo sapiens
aaaacggaagaggggccccaattctttaaggttgggaacgcgccccttgttatatgggttccgggcaaaccaagtgtggtgaaaggcttctcaaccaaccccccttggggcgcttttctggttggtatattaaacaaaccagttcgggggggggtctcaaaacaatgggccaaaaaggttttgggggtgggcagggtccccaattttgcccaaaaagcccaaaggggtaaataaattttttcctccgacccgccccccccctttttaacaggggggggaaaacgggttccaaaccggttggtttcaatgggccctttaggtttggggggaaaaaccgggttattttaaccaaggcttggtaacccctccaaaaggaaagggaaaagtttttggggcccccttgggttttttttttggggggggggggttttaggtttttggtttttaaaaccgggcctttttaaggggaccccctggcccaaaaattgggcccgaaattttgggcccccttaaaaaggtttattggga

SEQ ID NO: 574456 - DNA, 85 bp, Homo sapiens
ggatttgctggtgcagtacaactaggcttaatagggaggctcgaattcgaggctcgaattcgaggcaaaaaggaagagaaggcca

SEQ ID NO: 574457 - DNA, 208 bp, Homo sapiens
tgctgggattacaggcatgtgccaccgtgcccagctaattttgtatttctagtagagataaggtttctccacgttgaggctggtctcaaactccgaccttgggtgatccgcccgcctcggcctcccacagtgctgggatgacaggcgtgagccaccgcgcccggccacctgtgcctatttcttgacgatgacatcagttatggggcct

SEQ ID NO: 574458 - DNA, 3147 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggtagagaaatagtatgtggggtttatgtgcaggtcctccccaggctccgctccatcccctaaagctccatttcctagcccagcatcccatttggtaaagcccttcgaagtgggccgcagcagggctgtgctgaatctttagcgcaacccctctgaggaatggtgtcgtttcctactcctcaaaagtacccccgatggcaccagccttcccctcatttcccgtaatactccaacttcgaaaggctggggagtgtgaagctaggctaaaccactgaagtttaaccgggtttgaagagaccccctcccccgacccgcttccccaaactgggctgctacccccaaagcctggtcaggaaagaccctacctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574459 - DNA, 1491 bp, Homo sapiens
cctccccccatgctaagtttctcctggatatactggaagttagattgtttcccagtttaagacacttgacactaatatctcctaagaaacactctgagctccactacttgctcttttactgtctacttaggctagcaactctcatagcactgtttacaacgctcatatcccttatccccacctaagacaactacgactatctctatagtgagacggaatactagctactgctggcgacgctgctactcaacactacctattcacaaggctgctctaccagcacactcctcttcaaactcaacactggcacactgcgtactcacaccctctctccactctacgctacgctgatacggacctcctacgtactacgcgtgtcatctgtttcaccgcctacgtccagccacagagtattggtcacgcctacgttcaggagcagtttacgcccgcctcggtccgtgagactttcgtcgataccttaggcgtgtctaccctaccaagacacacggcttaccatagtcccatctcgtggcttggatcgcaacacggcctaagctctccgacgtctcccgagccgctgggctgctagcgcactaacacacatcacgtgacggcctccgtacacacttcacggcgcactctgtccctcaaccttcccccaacacactctctcggacattaatccataaacccatcctctattaacaccctcgcatccctcggcgcccggcagcacagacttgtcacacagtgctgcatattcccttgccacgctgggcctccttacacctgctgggtcgcgtacatcaccgtcaactttcctctaacagccacaccacactcctctctctatcagcacacatctccaactctaccgtcgcggcttccccacgctcctactgctggacatccgacctgctacaagccaaacccttgccctccaccaaccgtggcggaccacctcttctctatagttgaccgcacgagctccgggcacatattggactcacatcttgtgaaccgctctctactacgccgtctcacgtcttcttcaccacgcgacctcctccctcccgcccccgccgcctctcgcgctcccggcgccgctgccggctccacccctctgccacccacttgggcccgcccccgcccccccccccccgcttcctcccgccgctcacttctcctccctctcgccttctgttaacttagctctcacatcctgcgctccttccacccctgcgtcccttctgcgtctccggcaacccgttcatcctgcttgcctcttgcctgctgttgccgtcgtcctcactctctcacccttcccctccctcgacgtcgcaccacaccccctctcactccgccgcatcacctgccccctcccctccctccgcgcgccctaacccccaccactttcaccccgctgctttaccatcccgcccgctcgcctcccctctctgccctccttgtcctacctccgaccgccctctt

SEQ ID NO: 574460 - DNA, 3480 bp, Homo sapiens
ccccctgcccctgggtttctctgagtttgtgtaaacaggttgcagggaaaggtttgccctgccctgctagggccatgtgctcccacggctattctccctttttgtggaaagctttatgttgtaggtctccgggatagagaaaggaatgtcatcacaccctcccgagggaggccagtggggtctggggccaggcagcatacagaggggaacaagagggcagtccctgtgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtacctagggcttggggctagaactgaggactcttatgggatgggaagtgggcagggaaagaggaagactctccctgatgcagtgtccaagaagtctgggtgaatcttacagagatgatcaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574461 - DNA, 295 bp, Homo sapiens
ggagagacagcaaggggccgcaggtgtcgatgggcccccaggcttctccaggacagcacagggaccccggatgaagacgcgtggccccctcaggcattcagctgcccacggagtttcctgcaccctggaaaagccccccacccttcctctgggaaactgacagctgtcttccacagcctctgatgtggacctggtactgaggagcaagactgtccagttctcctccacatggggcatcccagaatcaggatctgggactggcagggtcccctcctgtgtctcatctcttgcagca

SEQ ID NO: 574462 - DNA, 3409 bp, Homo sapiens
ccccctgcccctgggtttctctgagtttgtgtaaacaggttgcagggaaaggtttgccctgccctgctagggccatgtgctcccacggctattctccctttttgtggaaagctttatgttgtaggtctccgggatagagaaaggaatgtcatcacaccctcccgagggaggccagtggggtctggggccaggcagcatacagaggggaacaagagggcagtccctgtgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtactgatgcagtgtccaagaagtctgggtgaatcttacagagatgatcaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574463 - DNA, 2762 bp, Homo sapiens
  misc_feature (2732)..(2732): n is a, c, g, or t
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccancacgacgaccacgacgacagcagtcactga

SEQ ID NO: 574464 - DNA, 186 bp, Homo sapiens
ttatgaatcacaaatagacaatggtcaatagtaccgcctgaagatatcttaaaataagcaggtggatctatgtcatgtacacgatcaaaaactatccggcatatgtatggctagtgtaaatcagtaagaggtgtaatatggaaccttgttctggacagtacaccagttgccttttatcccaaagtt

SEQ ID NO: 574465 - DNA, 3259 bp, Homo sapiens
ccccctgcccctgggtttctctgagtttgtgtaaacaggttgcagggaaaggtttgccctgccctgctagggccatgtgctcccacggctattctccctttttgtggaaagctttatgttgtaggtctccgggatagagaaaggaatgtcatcacaccctcccgagggaggccagtggggtctggggccaggcagcatacagaggggaacaagagggcagtccctgtgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtattcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574466 - DNA, 2733 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574467 - DNA, 763 bp, Homo sapiens
gcctgcctcagctacttgggaggctgaggcatgagaatcggtttaacccaggaggcagaggctgcagtgagccgagatcgcgccactacactccagcctggatgacagagggagaccctatctcaaaacaacaacaacaacaaaactagatggtggctgtgaaaaatattttgtggaatttaaattccattcaaatgttggtcagcgtggttagtgatctagtcgaggggaaagaccagtgcagcaccagttaccacacacgcagagcgggccgggtgcttcagatgtgactgcaggatcagggaaggcttcactgggcaggagatgagcccagaggaaaggtcaggagggaagtgcgccaggaaaggacccctggtgcaaaggcgtggaggcaagaaaacaggactgtttgggaactgtgaggcatccagctgagccaggctggggaatgagttctgatcagcaggcagctctcctggggtctacagatgtcccgcaaaactatgagacacgtggatgatttaaaaattttccagccggtgcggtggctcacgcctataatcccagcactttgggaggctgaggcgggtggatcacgaggtcaggagatcaagactatcctggctaacgcggtgaaaccctgtctctactaaaaatacaaacaaacaaacaaagaattagccgggcgtggtggcgggcgcatgtagtcccagctactttgggaggctgaggcgggtggatcacctgaggtcaggagttcaca

SEQ ID NO: 574468 - DNA, 168 bp, Homo sapiens
cgaccagcggacagtaagagagggagatgtacagcagcagagagagaggaatgtgtcccaaataggctctcttgctgaccccccctcttcctaaagggataatgccagggtctatctatctgcagagaaaggggtagcagggagagagaactgagaacataataatct

SEQ ID NO: 574469 - DNA, 3093 bp, Homo sapiens
ctgctggtaagtggtctattcctgcccacccccgggtgactagcttggccagtagtcgaccccacccggggaccgactctgggggttggagagactcttggggccggggtcgggcactccagctttcttctagccccgagctgggattccctggcctgcgccagctgcgtacacggcgagtacaccgcacctgcccgggacttcacccgcagctgcgagactcctccattcccggagggctccccacacctgctgcggccgtgccccatctccccgcagctgcggcgctgagcacccccatgtcgagaggctgagaccaggacaggtgcagggcgttcccactcacccccgaaagtcctcctccttcctctgcgagtctgtgttggaggtagagaaatagtatgtggggtttatgtgcaggtcctccccaggctccgctccatcccctaaagctccatttcctagcccagcatcccatttggtaaagcccttcgaagtgggccgcagcagggctgtgctgaatctttagcgcaacccctctgaggaatggtgtcgtttcctactcctctcgaaaggctggggagtgtgaagctaggctaaaccactgaagtttaaccgggtttgaagagaccccctcccccgacccgcttccccaaactgggctgctacccccaaagcctggtcaggaaagaccctacctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574470 - DNA, 345 bp, Homo sapiens
  misc_feature (27)..(27): n is a, c, g, or t
  misc_feature (74)..(74): n is a, c, g, or t
  misc_feature (82)..(82): n is a, c, g, or t
caggtggaccccatggctttgagcctnagtttactcatctgtaacatgggcataagaatagtaccagctggacntggtggcncatgcctgtaatcccagcactttgggaggccgaggcaggcggatcacgaggtcaggagttagcgaccagcctggccaacatggtgaagccctgtctctactaaaaataccaaaattagccaagcgtggtggcgggcacctgtaatcccagctactcgggaagctgaggcaggagaatcccttgaacttgggaggcagaggttgcagtgagccgagatcgcgccattgcactccagcctgggtgacagagcgagactctgtttc

SEQ ID NO: 574471 - DNA, 2377 bp, Homo sapiens
aaaattctggccatttgccctccttccccccttcgtccgctctcattggctctgctggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574472 - DNA, 214 bp, Homo sapiens
attactgagtcgggagttggcaaccagactggacaacccggcgaaatccgtctctaccaaaaatacaaaaaaactagctgggcatggtggtgggcgcccattcatcccagccactcaggaggctgagagcatgaacaattacttgacacacaggaggcggaggccgcagatgagccacagctcataccacctgcactccagacctggaacgcca

SEQ ID NO: 574473 - DNA, 2125 bp, Homo sapiens
aaaattctggccatttgccctccttccccccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574474 - DNA, 2239 bp, Homo sapiens
aaaattctggccatttgccctccttccccccttcgtccgctctcattggctctgctagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574475 - DNA, 712 bp, Homo sapiens
agcgggtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttg

SEQ ID NO: 574476 - DNA, 643 bp, Homo sapiens
  misc_feature (412)..(412): n is a, c, g, or t
  misc_feature (472)..(472): n is a, c, g, or t
  misc_feature (492)..(492): n is a, c, g, or t
  misc_feature (501)..(501): n is a, c, g, or t
  misc_feature (524)..(524): n is a, c, g, or t
  misc_feature (535)..(535): n is a, c, g, or t
  misc_feature (549)..(549): n is a, c, g, or t
  misc_feature (571)..(571): n is a, c, g, or t
  misc_feature (579)..(579): n is a, c, g, or t
  misc_feature (610)..(610): n is a, c, g, or t
  misc_feature (627)..(627): n is a, c, g, or t
  misc_feature (640)..(640): n is a, c, g, or t
acctgggagtttgcttaagccctcttcaacaaatacagattgtaattttcacaaaaggaatctttgacaatgtctttttatttgttttttgaggtagggtcttgctctgtcacccaggctggagtgcagtggtacaatcttggctcactatagcctcgacctcccaggctcaggtgattctcccacctcagcctcccaactagctgggaccacaggtgcccgccaccaggcctggctatttttttgtattttgtgtagagatggggttttgccatgttggccatgctggtctcgaactcctgggctcaagcaatccaccatcctcagcctcccaaagtgctgggattacaggcgtgggccaccacactcggccaacaatttcttaagattgaaaaggaaaagcagataggcngggcctacaatccatgccatcagtggcacagggccctgtgccctggcatctgggttcacnctctgctgttgctgtcttcnaattcctantgatgtttgaacaaaggccctangtttgcatttngcactgggccccanaaatcacatggcccatcctganaagaagantctcacacctccagtctcctaaatcacctcnggaagtttttctcaacnaaaagaactgaanctt

SEQ ID NO: 574477 - DNA, 256 bp, Homo sapiens
cacgaggatggccgacatgccggtcgaggccggcgaatcgcgcgtcagcgtaaacatcagcggacagatcgagattgaccgcaagtaagcaggcactcacgctcaccgccgcgctgctgctggcaggctgcggtacgctgacggcgccggcgcccgatgtgccggcctcgccgcagccgcctgtcgtacagacaccggcacccgcaccgacgacgggcctgcaactggccgacgacacccacgcgcaggacgcggt

SEQ ID NO: 574478 - DNA, 1316 bp, Homo sapiens
agcgggtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgcatcattcagcagccacatcattggcatgggcatccctgcacaggtgcacactcgcaaacccaggcaagcacaaaggtcatttcctttcaacatccaagaaaccaatggaagccagctgcacaggcaaccagcaatttctggcacattggcatgcatgcgcagtcaagcacacaacgtgttcaacaattcagcagccacataatcaacatcgacaaaccagtgtacatgttctcaggttgtattctcaaatcctggtcgattttatttaacactgagggcattagggagttataatccataaaaaatggtttcattccaaaaagcatcaatggtaatggataaagggcattgagcagaggaaagcaaatttgggtcaaaggaatggcaattcactatattgaagagattaaaatggttagcggatgtcaatatcaaacaaaattcatatggcagttggcacagataaaatgtggtcgaaaacgattttaattttagaggggatttcaatttgttggtgcttggcgcctaacaaaagcttaaggtggttaaaagagattaaagaatctgcaaggtacaaattaacaaaattagtgtgaaaatgtggtagggttgaggcccttcatatataataggcattcattgcaagcaaggctttggagaataccagtggagttaataacagaggaccaaaaacaaggattacaccagaggttatatgacaattaggacatctcattattacaggtgatatttacaaacagcttcaaaggccgattactgtatgacctaagcttcacacaacaagggggtatattggggaacatgacgcaagtatgggagcgattataaattcaacaagataatattgggggcattggtatcaaaacgtatttccattactttagtagcaatcactataatcaacatatattacgccgacaatcaagaaaatgtgagttataacggacaaggttgtattatgagacacatatcacaacaacaca

SEQ ID NO: 574479 - DNA, 821 bp, Homo sapiens
cagattgctagtgtgacgtacctttactgcgcacgacatcaagggcagggtgcttactgatgtatagagacttttggtgtgctatccatgataggagaatgagagaaccgtgaaagaagaaggatgctctatttagaggcgaatcgatagatcacatctcgagggaacaaatatgctgacgttgatgatgctaatacgaaatctgttttacattagccgattagttatagctcgtactggatagtgagactttaatatgtgtatatacatcggctattgcaagattatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgaaaaaaacacttaaacacagatgagcggaggctcgcgcactccttccccttgaggggggaggaatttggttaattttctttttttctctctcgccgaatggcttctttgggcgccgaaacagggtaatcttttaccgcgtctgtctttgtggggggacaacaataagccgccgagagaaaaacaaatgcgggccgaggttggctatgggggggcgggaagcccctcctagagagggcggtgatttttttcttttaaaaaccccgggacgcctggtaaaaaattctttcccctatcagtgtagtgggggcgcacacccacatgaggcgctgtatgccccggcttccc

SEQ ID NO: 574480 - DNA, 448 bp, Homo sapiens
agcgggtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaagttaactcgggacaatgcggatgcaatagattcagtatttgggtcagtattccgaccctagtatgactagcgtcgcgttggtca

SEQ ID NO: 574481 - DNA, 653 bp, Homo sapiens
tgcagggagaagagatcgacagtattttgaacaaagtagaggaagatgaagaatgaggtcaggacagtactgtgcggtgcaagattaccacccataggtgcgaggaggagccatcgacggagatactggcccaccgacagaagggcgcctggttggaaatatgacatacgatgaagtggtatatgacgaagaattcaccattatcaagacatataaaaccttctaccactcgaaggaagtttggacatattctcatacttagtgggaatgtaatttggcagcagagtgattggaatatacccgggcagtcatgggccaggcggcacaggaagattaccgcgtggccacaagatgtactcaatcgcgagggtggagcacgggacggcatattgtggtgacaaataggcaaactaaaacccacggatgacactatcggtacagatgggcccacatgggggatagatgcaggtaagcacatactgcgaacaacgtgtggcgagggactaaacaaccctaaggagacggcaagaagggtcaaagagagcacggctcacgggcgagaggacacgcaagaagggagcatctggacttgcggaagagtggacaagcgcatcacacgccccacaaagactccaaggatacacggcaggccc

SEQ ID NO: 574482 - DNA, 1496 bp, Homo sapiens
  misc_feature (1384)..(1384): n is a, c, g, or t
  misc_feature (1402)..(1402): n is a, c, g, or t
agcgggtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgacttatatgtagccagagatgtcattaagcnttactgttatagtaggtnatatggttagttgtagggaaaagagcatatgagcacctgcttgtgtatttggctttgcccagtagaacagacaatggattctagacttgatgat

SEQ ID NO: 574483 - DNA, 1571 bp, Homo sapiens
  misc_feature (1318)..(1319): n is a, c, g, or t
agcgggtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttnnaaaaaaaaaaaaaaccttgtgggccgcttgggcccattcgattttaaattggaccaactttttccatccggccgaatttcggcctcattggcccaattcgccctttagggggtcgtttaacaatccactggccggtgtttaaaacgtggggcctggaaaacccctgcggttccccaattaattccctttgaaacacatccctctttgccacgttggggtaataccaaagaggcccgcacggatcgcctttcc

SEQ ID NO: 574484 - DNA, 279 bp, Homo sapiens
aaatacaaaaaattagccaggcgaggtggcgggcacctgtaatcccagctactcagaaggccgaggcaggagagtctcttgaacccaggcggcggaggttgcagttagctaggatcatgccactcactatagcctgggcaacagagggagacttcgtctcaaaaatcaaacaaacaaacacaacacaataggggttatgggctctgcatgagtctcaggagctctctatgagtaggaggataactctctatacgcttctcatgacatattcatcgcctc

SEQ ID NO: 574485 - DNA, 233 bp, Homo sapiens
cgatatcgcagaagtcatccaattccagcttggtccgcacggaaatatacacagagagaaagccagacatagatcctctcggtacccgcgtagatgtcaaacaatgcttgatcataccacactatgagaagagcccacggccccaggataaccgcattggaaggaatacagtgtccatgtgcgtaggactaacagcggctactcaccgtctggccgtcaatacccctagggcc

SEQ ID NO: 574486 - DNA, 347 bp, Homo sapiens
ggtggtctgcctgagaggaaagggttcacttacccctccttcgcacacctaaacacggagctatcagaggaggctgagtgaggtggcggccagacagacagcgccagccaaggaaggagaggtgggcaccgtgccaggcagccggaatcctcagtccagactgacagctgtcagacaggcattggtcctggcgaaccttccccttcaagtgaaagctggggggtcagaagtcatgggcatcctccctggttcaggagccggcttccctgcactctagctgtcctagccgaagagtgaagccctgtccaaatcatggcgaggctgcaagacaggcacacactactgcc

SEQ ID NO: 574487 - DNA, 811 bp, Homo sapiens
  misc_feature (699)..(699): n is a, c, g, or t
  misc_feature (717)..(717): n is a, c, g, or t
cgaaggcgagctcggtacccttcgcgtatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgacttatatgtagccagagatgtcattaagcnttactgttatagtaggtnatatggttagttgtagggaaaagagcatatgagcacctgcttgtgtatttggctttgcccagtagaacagacaatggattctagacttgatgat

SEQ ID NO: 574488 - DNA, 354 bp, Homo sapiens
aaaagggggggggggggggccggggggggggttttttaaaccagggttttttttttcaccccccagttcccgggggggcccccccccccttttttttccccccaaaaaaaccccgggggccctccccccccccgcctttttccttggccccggggggggttaaatttttcccccgggaaccgtttttctccttcggccctttttgggggccccattagcccagttttgtcccaaaaacgggggggggccgggccgggattccccgggtttttttcccccccccccccggtgtttgggggccccccccccggggggggggtttttttttggggggggaaagggttttttttttta

SEQ ID NO: 574489 - DNA, 228 bp, Homo sapiens
agttacctcggacagagtgcagtaatcggaggtgagttattagggtttaacagcagttctggccgtaatgtctttgtgggagtctttggagtttctttcatttctcgctgaaaagccacttgaaagtgtggtaagaagtgaagttatcttcggtatattaaccaaaagatctgggttttcagactggttccctgaaacagcatcaagaagtcatggggagggctgtgt

SEQ ID NO: 574490 - DNA, 112 bp, Homo sapiens
cctgcccctgcctcccacagtcattcccaaatcctgccaggtataccttgcagagagctcgcaaatctgtacacttctctactttccctacttgcagtaaccttggtttggc

SEQ ID NO: 574491 - DNA, 548 bp, Homo sapiens
agagattatggttatggacacatggtgtggatggaacatagtgcctcagagtgagatggagctggattggaattgatgttcgcagttgtaaaatggaaaatgtggacagttgcaattggcttgcgggatacatatgagaatagaagtactgtatgtaaaggatcaggccggacagtctcctgataaagatcgctattactataaccgtttagacagagatatagaatccatgtgaccactaaaataagcaggttgccctactctctgtgtccgtgatggttcgcatattggctgatatcctatcacagggtataactgcctagtagtggtggagttcagttctaagtgcccagaagagaagatgagtgggatgtcttactcgggggaagcttgcggtctaatccgggatacatatgggataaactatttgctgaagtctatgcaacagacacatgctttggcattcatgaatgagagagagtgtccctatgggacggtgaagtcaggatggattctatgacaaggtgtaccttgagaggcatcctgag

SEQ ID NO: 574492 - DNA, 292 bp, Homo sapiens
gggagtcggcgcagaggagcctctcctgccctggtcacgcctgactagctggtgtacctgcttaaacaagttctccaaaatacagagacctttcgtgagtatactgattttataataaaatagttatttgcataagtttagtaagagtcttttctctcaaaacaggacaattggagacacttggttattttaccaagctttgactggaataacatttgtaggtcaagttccagcaaaagtcaacttgaaaagagcctatctggccaaactcttgctggacttcatgcaaata

SEQ ID NO: 574493 - DNA, 472 bp, Homo sapiens
  misc_feature (430)..(430): n is a, c, g, or t
agtgtgttgtgattaggacaggtgccctcggagttttctgtgtgttgttggtggtttttgagagagcgtctccctctgttgcacaggctgagcgcagtgtgggtgatcccaaattcaccgtagcttcaccctcccccaggctcaagcaatcctcccacctcagccttccaagtagctgggactacaggtgtgcaccaccaccacccagctaatttttgtattttttgtggagacggggttttgccatgttgcccaagctggtctagatgaccctgggcttgagtcatccgcctgcctagtgctgggatgacaggtgtgagccactgcgcccagcctcccctctgagtttccatcattacattggcctatctgctgctggtgatagccaacctctgggaggcagaggttgcggtgagtggagatcacaccnctgcgctccagcctgagcaacagagtgagactctgtcttgaa

SEQ ID NO: 574494 - DNA, 807 bp, Homo sapiens
ccgccccattccgcttctggcgaagaacctgggaggaaggtgcgcacttgatgcctaagaagtgtgcagagaccccacccctaaaggcccccccccgggaagagaagggttcacgggaagagtaaccagaagccccacgctgatcggaaggaggagcaaaaggcgctgcccctgctcctgaggaggagatggatgaaagtgagacacgccctggctctgagcccaaaggcccaaggaccccttcgctcacctgcccccagagtacccttgtgttggatgaattttagcgccagtactcccatgaggacacactctctgtggcactgcccatatttctgggagcactttgataaggacggctggtccccgtggtactcagagtatcgcttccctggaggactccctcagaccttcatgagctgccatctcatcactggaatgttcccgcgactggaccaactgaggaagaatgccttcgcccagtgtcatcccttttgggaacccaccatagcagctcccatttctggagatctgggtcttccgaggcccggagcttgcctttccgctgagtcccagattggccaggtggactacgagtcatacacctggcggaaactggatcctggccagcgaggagaccccgacgcctggttcgagagtacttttcctgggagggggccttccagcatgtgggccaaggccttccatcagggccagattttcaaatgaacatctcttgccctcacctagctgcctgcacctgcccctcagggagatgggggtccttaaaggaaactgaaccttgga

SEQ ID NO: 574495 - DNA, 380 bp, Homo sapiens
cgcaccgatccaagccgaacttctgccccgagttccggatctgggtccaagagctctcagcgggtatcaacaaccatcacaagcggctgctgttgcctcagcgtggtcggcgtcgtacaaacaccgtccaggctcctgcccaagaagcccactgccattaagactgagggaaaacctgcagaagtcgagaagatgactgcaaagcctgtaccagctgacttgagtcgcccaaagagcaagcttacagtgcttgactgacccactcacatcatgcacaaaagaagtaggaaaggctgctttggaaccacagatagaccacatcactgagccaatcagaacagagaaagaggaagctgaggctcgtatgcgacaagcatcta

SEQ ID NO: 574496 - DNA, 1076 bp, Homo sapiens
ccaaaactccggcgccggtcacggactgggaaagcagccttcctttggtgtttaatcattgcagggatgtctctccttgtctctaccccttctctgcttttctggggaaggggcaagtaccccaaccccttctctccttgtctctaccccttctctgcttttctggggaaggggcaagtactccaaccccttctctccttgtctctaccccttctctgcttttctggggaaggggcaagtaccccaaccccttctctccttgtctctaccccttctctgcttttctgggagaggggcaagtacccctcaaacccttctccttcacccttagtggcaagtcccgctttcctggggcagggtcaagtacccctcaagcccttctccttcacctttagcggcaagtcccgcttttctgggggaggagcaagtacccctcaacccccttctccttcaaccttagtgacaagtcctgctttttctagggggcaagaacccccaaataccttatttccacaccccaagctcttatctctgtgccactatcctttatttccagtgcccaaacccccttcccgattttcaggagggtaagaacccctgaaccctttcctccatgtctctagctctcatatctctgggtttgcttccttcaatatgggcaacttcaaccctcaatctccttctctccctataccgtggttcctcaacacattaaaactcttcaatccaaccggacttaaacctaaaggttaatacatcgtgctgcggttggacacataataatcgacagaagtccaatgccgaaaagggcttggactgtccaacctgggagaacataaaatttgtgcgcaaatagacatgagtctagtgccgaacatccaggaattaaccatatgcctccaaactggtacgcaaatcccaatccttgtcccccgtgccatcacacccaggagcatattacataaatgaaccgatatccacaccagtaggtagcgacaacacaacatcctcaaacagccgtcgcgtgcccctcattagcccctcacatatatcatcatctcttctccacgacatct

SEQ ID NO: 574497 - DNA, 353 bp, Homo sapiens
acggactgacgatatcctggagactagggctggaggacgggtcaggaggagtaggggaggaggaccggtcaggaggagttagggctggaggatcggtcagggaggagttagggcaggaggactggtcaggcaggagttagggctggaggaccggtcagggaggagacttagggcaggaggatcggtcagggaggagacttagggcaggaggatcggtcagggaggagttagggcaggaggactggtcagggaggagttagggctggaggactggtcagggaggagttagggctggaggagtggtcaggcaggagttaggggaggaggactggtcaggaaggagttagggctgg

SEQ ID NO: 574498 - DNA, 302 bp, Homo sapiens
gtcccgcactcatcttatggagagaaggaacacgaagtatgaccgagtgcgtcttagattgtttagtaagcgcctgtaacggtgctttaatcggaatgggaggtgattcctagggggttgtttgatcccgtttctgtgcatgaatagtgaggtgtcgtgctgctagtggctgtgattattgagggcccgctgcagtgacatgtaacgaatcctgtcccggtgggactgtctactgagttagcctcctcagattcatggaactccgtctgtccgcaaatttgtggcactggcggaataagtat

SEQ ID NO: 574499 - DNA, 257 bp, Homo sapiens
cacacaggcttctgtcagtggtaggatgacaatccatttgaaaaggacaggctcatcctcatcaggggagccctggaagataaagttcaatcagtgagaagtaaagaaggcaaagaactttgcaccagtttatcccataatggttcagctgcttcaaaagggtatgtgtgatttcagtaaggacatgaaatattagttcatttccaccttgaggaaacccattgatagttggcagttaaacacagactgcaaaaggg

SEQ ID NO: 574500 - DNA, 2162 bp, Homo sapiens
cgggacgcgtgggtcgccacgcagtccggcttctccgacgggcctccctctgctgggctgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574501 - DNA, 107 bp, Homo sapiens
ggatttgctggtgcagtacaactaggcttaatagggaccacagaaataaccaagtttccttgccaaccgtgtcacgaatataataaaatttcatcagatcccaaaaa

SEQ ID NO: 574502 - DNA, 407 bp, Homo sapiens
tgacaaagaccaaaatcattactgtaccccacaatacatctctatcaggggcaaacgggttaccaaactattttaaccgacaagtatgagaatatagtacatggaagtcccatatcccaccttcttattatcatcttctatgaacatggtactttttatttccaacgaatgcactaatattgatacattcttattaaagtccatactttctccagcattcttcagtctatcactccatggcctttttctttgttcaaatatatttaattgctttgtaacaattctacatatgtaggggtacatacgtcgaggtacatgcctacaattagtcataatcaaatcaggataattaagatatccatcaacacaaatatttctcatcctattgtgttagaaacattacagtt

SEQ ID NO: 574503 - DNA, 607 bp, Homo sapiens
tgcaacagaaagcccacagcctgctccattctccagtctgaacagttcagctacagtctgactctggacagggggttttctgttgcaaaaatacaaaacaaaagcgataaaataaaagcagattttcatattggtaggcggagagtgaattcaccaacagggaaattggggccttgtggctctatgccatttctgttggtagtttgggggcagtgcaggtggacctgtgtggggtgtgaaccaagggcatctaatctggccactctggccacatgtaaagctattctggccatcttggatctccaatggctggcgccagagcctctcctcttcccccctatatttccaacctgggtgtaaaggtgagggtaaaaggggcccaaacaaggtttgggctggggatctgtgtgtatattattttagagaaagactgtcaggtgtgtagatatatatttttaacaagtgtctttatggagttatcaagtggtgtggcagaacacttatattccaacaagcgagtgttctttaaacaccaaaagaaagtgcaccttgtttgctaaaaagggacaataaccggtggggctcaaaagtggacccgtgagctccg

SEQ ID NO: 574504 - DNA, 2333 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574505 - DNA, 187 bp, Homo sapiens
gggtgtaggtggatctttctcatggaccaagagctggaggacgggggatgatctcccaagggaggttccccccccctccccccgcgccagttacggcaccaaatttaatgcacgtccatgtgaagagaccaccaaacaggcttgtgtgagcaacaaggctgtttatttcacctgggcccacatcgaa

SEQ ID NO: 574506 - DNA, 1969 bp, Homo sapiens
  misc_feature (1)..(2): n is a, c, g, or t
nnggtacccccccgtcagtcgctcttagggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574507 - DNA, 357 bp, Homo sapiens
acgcatgtgtgaagcagagcatgtcaaaactagcaagtatttacgccaaatcctagacagcaaaacctcattatatagcagtaaacctggtctggagaccctctcagatacatctagtctctgaagcaccttttgagttgtacggatgtaagaatagctttgaattatagaagttatatgcatctttaagaatcacattttgatgattataaaaatttttttctattttacaacataggttcagctacactgaaaaaattacactgcttattgaaatacatttcattttagaaacagactaccaaagaagtctatacaaaaactctaaaataatttctgtagtaaaataaagagtgc

SEQ ID NO: 574508 - DNA, 1338 bp, Homo sapiens
  misc_feature (17)..(17): n is a, c, g, or t
  misc_feature (23)..(23): n is a, c, g, or t
  misc_feature (31)..(31): n is a, c, g, or t
  misc_feature (34)..(34): n is a, c, g, or t
  misc_feature (38)..(38): n is a, c, g, or t
agctcggtacccagagntaggancgcgctgnccntganagccgcccgtttggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574509 - DNA, 2039 bp, Homo sapiens
  misc_feature (1896)..(1896): n is a, c, g, or t
  misc_feature (1905)..(1905): n is a, c, g, or t
  misc_feature (1908)..(1912): n is a, c, g, or t
aggccctgtccaaacgggcactaattggccccgggtatttaggcgccccctttttttttttgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtaagagatgatcagggtgcagttggcgtgggcaaagctcagcaaggcgtcatccagaggtagctggtgtctatctagatcaggaatggagaacttcttgtagtacttcttgttggttgttctgacaatgatgcagcgctccttctggtccacagagacactatagacatccttaggataggggaggtttcgaatccgccactggaaactcatcttggtgtccttgcgcatgaagataggattggcattgctttccttgatgagttcaggccccaggttccctgctcctaggggcgctgggtctcctacttcaagctgccactggcccatggctcccagggcacttttcacacgccactttctcacaagtagttcactcgtcttctcgtcatattcttcagccatttccttgccgtctgggaataaatagtgaaccttccttctccccctccataggcaaaggggttggagggcctcaattctggatttccacgtgcagcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccgggtgctcagctggtgaagtcagcctggctgagcttgtgccttcaggagaggaggctggtggatgtagctggattcagcatcttcatccccagtaggtacttggaccatccacagcccagcaaggcagagcaggatgcttctattcctcctggcacccatgaggccctgcttcagacagccctttctcctcctcctcctcccaccaggcctgtgtctcctccccaaaaggcaaaagaggcaccaaacacccaagcccagcccatctctgatgatgaagccagtgatggggaagaaacccaggttagtgcagctgatctggaagccctcatcagtggccactaccccacctcccttgagggagattgtgagcctagcccagcccctgctgtcctggataagtgggtctgtgcacagccctcaagccagaaggcgaccaatcacaacctccatatcacagagaagctggaagttctggccaaagcctacagtgttcagggagacaagtggagggccctgggctatgccaaggccatcaatgccctcaagagcttccataagcctgtcacctcgtaccaggtacccaggggctagagtgggaggaggggtctttactggccagtggttagtaaccccagtggggttcaggtacagtggtgaagattttatggggtctaggacttgcncaaaaaaanaannnnnaaattgatgaaagcagattggcaaaatcttgatagttgttgaagctgggagatgtacgaaacttgggggttatatggatctctccacttttgaattttttaacataattaaaagttttttattttta

SEQ ID NO: 574510 - DNA, 268 bp, Homo sapiens
gcgtggtcgcggccgaggtactttaagtcctagccagagcaatcagacaagagaaagaaataaagggcatccaaatcagtaaagaagaagtcaaactgtcactgcttgctgatgatatgattgtttaccttgaaaaccctaaggactcctccagaaaggttctagaactgataaaagaatccagcgaagtttccagatacaagattaatatacacaaatcagtagttcttccatacaccaacagtggccagaaaatcaaatcaagaac

SEQ ID NO: 574511 - DNA, 2998 bp, Homo sapiens
  misc_feature (2531)..(2531): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaaaaaaaaanacaacaaacctcacaaaacaaaaacacacatacacacacaaaacacaaacatacaccacaaacatcttacacaccaaaaacaaaaacatcaatatatcgactaccacaaacaccaccacacccacacaactcacacatactcatcagaaggaggatgagatcgggtggaggggcgagagaagggactgctcgtggagagacgtaggtgaacgagagcagcgaagacgagggacgtgagtgacgggctggggaacgaagataaacagaagacgccagcaggtcagcgaggcaccgggtgatcccagggcgataaagcggtctgcgcatcgtgatgccctaacgaagcacaaggacgcacacatgcgggccggaggagagcagagcgaagagacgggggcggctgcggaagagacacggacgagcagaacgaaccgataagcagaatcgacgccaccgagccccaccaa

SEQ ID NO: 574512 - DNA, 1624 bp, Homo sapiens
aaaattctggccatttgccctccttccccccttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagaggcctgcagtatccctgggattgggaagcggatggctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactctgggctgctgtgtgtggcatgtggttcataccgacggggaaaggcgacctgtggtgatgtcgacgtgctcatcactcacccagatggccggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574513 - DNA, 104 bp, Homo sapiens
caacaccctcctagccttactactattaataattacatttggactaccacacctcaacggctcacatagaaaattccacccctacggagttcggcttcgaccta

SEQ ID NO: 574514 - DNA, 153 bp, Homo sapiens
atacaacgaacttgacgccctattcagactcgctttcgctgcgccttcgcctatcggcttaagcttgctcgttaaattaagtcgctggcccataatacaaaaggtacgatgtcacccagaacgtatcttgggctccatctgtttgtaggtgtc

SEQ ID NO: 574515 - DNA, 2463 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagacagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574516 - DNA, 1042 bp, Homo sapiens
agaccggtttgacttccaattcaaccttccaccccccaggaattggggcccgggggttccccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattga

SEQ ID NO: 574517 - DNA, 2945 bp, Homo sapiens
  misc_feature (2666)..(2666): n is a, c, g, or t
  misc_feature (2701)..(2701): n is a, c, g, or t
  misc_feature (2822)..(2822): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcngccacggtctgctccccaggagcctctgactcctntggtagtggcggcaggggctggagctcagtttacttgttctgtaaatgcggagaacgccctgctcggcccccaccacaggcagccagtcattgctgagtgaggagggcttggcacacaaangcaggctgctggggcgggcctctgagccaacctgggagggaccccgagctgggaccgagggccggaagacaccgaggcagcgcctgcacccctgtgccattcccgtccccaccctcctgcaca

SEQ ID NO: 574518 - DNA, 632 bp, Homo sapiens
ccccctgcccctgggtttctctgagtttgtgtaaacaggttgcagggaaaggtttgccctgccctgctagggccatgtgctcccacggctattctccctttttgtggaaagctttatgttgtaggtctccgggatagagaaaggaatgtcatcacaccctcccgagggaggccagtggggtctggggccaggcagcatacagaggggaacaagagggcagtccctgtgcagtaagtaactcagaatgactttactcaggaaatatgaccatgactcactggctaggagtgccccatgcccagttcttagagacccttgatagctcctagaagacaggaggctgccgtggtcaagaagggccaagccttgaagtctcacggcaccccctgtggtggaggtataaggctcaggggccaactactgggtcttgcagtccccatcgttgctgtgggctgtcttcaccttctttagttccttctgtagctcagactcggccaccacaacctcctttggcttctggtactgtggatgcagccaggaataagaaaataattcagtcactgtcccatctccttccacacacacttggggccccttctctttctgatccccttatttgcacgagaaaattg

SEQ ID NO: 574519 - DNA, 2391 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574520 - DNA, 647 bp, Homo sapiens
cacgcgtccgatgagaattagtcaaccatatagtaattgttttgagagctggtaataattttgacagataacagagttatttgaaggctttttcagtgcctgttaaccctgcttgattactaatgaccttaaaatgatcctctaaatgtagatgaggcttagcagatcacttttcattataatgacttttattaaaaataataattaacatgagaatggtgttccacagtgctctttacatatgtaattaatagtgctgtagttgctatttgctgaacacatgaaggacagatattttgctgcgtgcttggcatatattatctctaattttagcagtaatgcttaaaaaaaataggttgatggggctgggcacggtggctcacgcctgtaatcccagcactttgggaggctgaggcgggcagatcaccggaggtcgggagctcaagaccagcctgaccaacatggagaaaccccgtctctactaaaaatacaaaattagctgggtgtggtggtgcatgcctgtaatcccagctactcagaaggctgaggcaggagaattgcttgaacccgagagacggaggttgcgttgatccgagatcgctccgttgcactccagcctgggcaacaagagtgaaagtccatctcaa

SEQ ID NO: 574521 - DNA, 261 bp, Homo sapiens
cacgtatggtgatggataaaatctactcagcttttgtttgtctgggacagttgtgatcactctctcctatatgtgtgtgaagaatattcacaccaaatatagtatactagggtaaaaggatactaaccatcaacactataactatatcatgccactctcccctggcctgcaaggtttcaactagaaaagtgtcctgccagaagtattggagctccatcgtatattatttgttgattttactctagcagcttttagaatcat

SEQ ID NO: 574522 - DNA, 2577 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccctgcgccgcgcgccgcagctgctgctgctgctgctggccgcggagtgcgcgcttgccgcgctgttgccggcgcgcgaggccacgcagttcctgcggcccagagcgggctcgaagaaaataattctctattatttttattaccaagcgcttctttctgactctaaaatatggaaaataaaatatttacagaaagctttgtaa

SEQ ID NO: 574523 - DNA, 2302 bp, Homo sapiens
  misc_feature (2068)..(2068): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgcaggtaggtgctccctgtncgctcacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaac

SEQ ID NO: 574524 - DNA, 841 bp, Homo sapiens
  misc_feature (592)..(592): n is a, c, g, or t
cacagtagctcacacctgtaatcccagcactttgggaggtgccaaatcaggtggatcacctcaggtcaatagtttgagaccagcctggccaagaaggtgaaaacctgtctctacttaaaaaaaaaaaaaaaaaattggccgaggtggtggtggcaggcacctggtaatcccagctactcgggaggcagaggcaggagaatcgctttgaacccaaggttggcaagggtttgcaggggggccgagaatggtgccatggcactccaaacggggcaacgagagcgaagtccgtcctcaagaaaaaaaataaacaaatacaaaaaaaaaacagtgtgtgctgagcggcgcctcagggagcccttgagagaaaggtttcaaacaaccccactctgtgtgtggcgacgccggggcgccccccagcagggatagacaggaacactgggggcacacacgagcgtgtggttgccctagagagaaacagctgggggcactaagacaactaaggcggctgtggactacttcactccccccaaatgttgaaaaaaacacgcgcccggggtggacaacacacagaggcggtttctggtagaacaanaaactcacaaaagatgggagatatctagggggcggagccaacacgggggcgctctcaacacaaacaagggaggactccacaagggagagcggctcagataactactaataaattaacgcccccgccgtcggctggagtgccatactacacacgtcgacatacagcacgatatagcgaacaagtagctcaagcacaacagctacgaacgtaatcgtcgccaagatagaagtacgtaaaaaaacgaatgat

SEQ ID NO: 574525 - DNA, 388 bp, Homo sapiens
tacccacggcaggtgtactgttccatgggtgaaggctctaacacggccctgtaaaaactgggtaaggagatgtaagagacatgggccaagtgctaaatggaggaagagggtaatggcagggcctaggaagggcagtagccaggtgcccaggagttacgaaatcacctgggccgggaatctgaaaggcgctgcctgatttcagcagcttttttttttttttttggagagtggagtcgtggctcggttcgcccaggcgtggagttgcaggggcattcattctcgtgctcacgtgaaagctcggcctccgcgggtttcaccccacagcgcatttctccgtgcctcagcctcttgagttagcgtgggagatcaacggggcgggggcggggag

SEQ ID NO: 574526 - DNA, 236 bp, Homo sapiens
gcttcacaaagtgtgatgcggtgagtgtctggagaaggagcacgattacagggatagcatttggtactttatccagttcacaccatgcggtaggttgctgccttcgaggtgtatcctttggaggcagctacattgtcaccgcagaggcagggctaacattttcttcatcggtagcctgtaggtcagagcggccttcttcgtctgtggcggaacctttgacaacccttcttcagagt

SEQ ID NO: 574527 - DNA, 92 bp, Homo sapiens
ttttccatccaacaagaagccacaactttattagtgatagaaacagtacaaattttaaaccaagctgtagttccacttttcaaacaccaaaa

SEQ ID NO: 574528 - DNA, 83 bp, Homo sapiens
aaactctgtttaaaaaataaggtctgtgtgaaacacacatgtgggggtgaggctggattaaagtgaaattttttcttttaaaa

SEQ ID NO: 574529 - DNA, 953 bp, Homo sapiens
gatgccctcaggtattggcagcgagatccatgtggaccaagtgccatgtagtccagacctccacatgcctttggcgccatcctggtccttgcagcatggagcctagcagagacggatcgcctggttcaacctgccagtcagtctgctggtctgaaggacgacatcataactgtgaagcctggccaggaatccgtgtgcttctctgaggcggtgatcacatggatgagcgaagcacgatctggtaccgtgcgacgccgggatggaccgtcttcccaccgccttctgcccgctcacatcccgtcagcacccggggaagaagctgggatgagcaggaacccagcagaagaccctcagtgcagcgagagccaggctcttgtccgctgtaccttgacaagtctcctgatgagtatgactctaactcaagaactgagtgactggatccatgggtcccctgatcaccggagcacagtgtacagctgacaccatgtgaaccaagtggagcgaggtctcatcacgcatgcaagatacagagtagacttggctaagaaaactataagccttgggtgcccaccggagggcttcccatgggctcggagtcttgccgtacaattcaggcgaaaaatggcccccttagccacagcgttcaattctaccctagataggcccccccagcgcatggttacactcctctccccgtagggcccaatgccaaaccaattccctaacgcttcccgagggtaactcaagggctgcacctcggggcccgtacgcatggcgccaagtacacctacggcacccttggaagttcatgtttccacacggttcgcatccatcgggaggaatccctgcggccataggttggggctagctgggacccaaggagatccggttggatcccttgggaccgcatggaatttgcacgccaagggaaccttcaaggaacaggacttcgc

SEQ ID NO: 574530 - DNA, 1090 bp, Homo sapiens
gtcaaggatctggtgtttgaggaggctgcgggtactaccagcggcggagtctgcgtggtgcccagctcactccagaacgaactgagacacagcagcacattaccgggcagctcaggctctggcctccatcctccagggaccaccgtgctccccatcatgcactgctgacggcatgtacgagagaccggagcttcgggattaccgaggcttagaacagctgaaggcccagctggtggctggggatgatgaggaggctggttggactgagctggcggagcacggaagtgcgcacgcctgctgaggactgagttgataggagaccagctagcccagctcaacaccgtatatccaagcccttcctacagcagcctggggtgccaacctcagggaccctgcagactaccagctagatgtggaatggcaagctgaggtcccaaagcacaccactgatgtagtggaagaaagtgttcgggggaataaccgcatggacaggaaccccccaactggacatactgaccacctttgaactcctgtgccagtgtctgtgccagctggagcctcgatggctgcaccctttgtggagctgggcacaagcagcagggcgggccggagactggcgggagcaggcggcccagcgaatgacacctgtatcgccaaacatactggaagagcatacgacgaacagaggggaccacagactgacgccggcactacaagctgcctcatgaaccagaggcgcacggcacaacagctgtgcaccaagaggcgggcagcaggcgcacaagcaaacagggacacgggaccggcagccgccaggcccacgaccctcaccacaccgcaccgccagaaccccacctgcggcgcccactgcccgaaccgacggccgagcacagtacccctacggaacgtgccacacaagggcccaggtcccccggccctagccgccatcacacctgaggcgccccacacaacacatacccaacacgcggagaacgcccgacacacaggagcaagtagaacaagaggacacaccgcaacccacacaagcacacaccaagataacgaaaagcccgcgtacacacaccgcccc

SEQ ID NO: 574531 - DNA, 353 bp, Homo sapiens
cttacccctcaaagacataatatgtttatgttactttctgcttgtcttcctgcatttgtttcctcacagtcgaccttttcttctttcctttggtctctgtgatgatggaaacttacatcaaatgtcaggcagtccttcactgtctatttaaaaaaagaaaaaaaaaaagccatttggcagctctctaaaaggccttccagacgactggcaggctcaaattgccaactgactttttgctatgggattcccaaatgtcagtttgtaaagatcttttcctgggttggttcagtttctccagaaagggatcctgtgttctctgctgcccccaatggggaacagtggagggaaggggt

SEQ ID NO: 574532 - DNA, 327 bp, Homo sapiens
  misc_feature (18)..(18): n is a, c, g, or t
gatacaattccagctcgntacccctaattggttcttcgatgacgaagtcgtagacgcagttgtggaagtaatagaactccaggtgcttgaactcgctcttggcggcgctgaagagttcttccacgcggtgcacgtgctcgtccatcgtgccgcccacgtccatcagcagcagcaccttgaccttgttgtggcgttcgggctgcatgcggatgtccagcaggccggcgttggcggccgtgccgtggatggtgccgtccaggtccagctcaaggtctgagccctcgcgggcgacgtcatcgaagaaccaattaggggtacgagctcgga

SEQ ID NO: 574533 - DNA, 696 bp, Homo sapiens
gtcgagacgagctggaccagacacgaggtcttctcggtaacgacgcaatctacaacgttatcgtctacacgcaccatgcattgtaataatcttcttcatagtaatacccatcataatcggaggctttggcaactgactagattcccctaataatcggtgcccccgaatatggcgtattccccgcataagacaacagtacagcttcttgacctctgtagctccgctctctccatactccgtgctcgcactcctgctatagtggaggccggatgcaggaacccaggttgaaccagtctatgcctcccttagcagggaacctacatcccgacctggagcctccgtagacctaaccatcttctccttacagctagcaggtgtcctccctctatcttagggggccatcaatttcatcagcaacaaattatcaatatagaagcccctgccataacccagatacaaatgcccctcttcgatctgatccgttcctaatcacagcagtcctacttctcctatctcctcccagtcctagcatgctggccatcactatactactaaacagaccgcaactcaataccacttcttcgaccccgcggacggaggaagaacccattctataccaacactattctgatattcggtcacctgaagttaatatgcttatcctaccaggcttcggaataatctccatatgtaatt

SEQ ID NO: 574534 - DNA, 803 bp, Homo sapiens
gaaatccgccgccccaagagggcccaaaagggggggcccccccccggtgtcgcccccccctaaagttagggaacccccgggggtacagaaattcggtcccggggcccggtacaagagggcgagggccaaattttgtgggcaaaaccagggggggagatatttggagtttcgagaaaggaatccgaagcagcagctccagtcccaaaaaggtactcttaagggtaagagggcttgcatctccccttcaagcaaaaataaatggaaaactcagtcaaaaagttttcccttgaacctttgagtaggacttccggctcctgcaatgggtcaagccagtagtccggggctctttatgtcatggggctttggcaccaaaggatgaccctcacctgcccaactgaagtgggcagtggccctcccacgctgacagacgcagtatttacatcccctcctcagctttgatttcataagccacagccccccgcacagactgatctcaggaagaatagctctctaacatcggtccacctttttaagacacaatgtgttagccaaagggctgccccaaaggggaagggacaaaaaaaccctcgggcctcacacactgtcttcaaggcccaattcccccagaacaggtccgtaaaagaggccggtgtcatgggttcccattttcatgttgggaaagcaaggaccccggatctgtttcccaagccttcacaatggggaagaaactcctgtttttacaaagggataaagttggggttaggcccctaaaagaatgttcaaaaaaaaattaaaataacttt

SEQ ID NO: 574535 - DNA, 180 bp, Homo sapiens
aaatggtagcactgtcaaatacttcatacgtaccgtcttcatagattgctttaataggtttttcattaattggctttaattgtttgtttgttttaacaaaattcttctctgcgtaattgttaatctcaatctagtctgttgctgtctttaaacgcgttataaatcagagttttaactgat

SEQ ID NO: 574536 - DNA, 2795 bp, Homo sapiens
  misc_feature (2328)..(2328): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccgggcgcggggaggccggcgcagcgcagagcgggctcgaagaaaataattctctattatttttattaccaagcgcttctttctgactctaaaatatggaaaataaaatatttacagaaagctttgtaaaaaaaaanacaacaaacctcacaaaacaaaaacacacatacacacacaaaacacaaacatacaccacaaacatcttacacaccaaaaacaaaaacatcaatatatcgactaccacaaacaccaccacacccacacaactcacacatactcatcagaaggaggatgagatcgggtggaggggcgagagaagggactgctcgtggagagacgtaggtgaacgagagcagcgaagacgagggacgtgagtgacgggctggggaacgaagataaacagaagacgccagcaggtcagcgaggcaccgggtgatcccagggcgataaagcggtctgcgcatcgtgatgccctaacgaagcacaaggacgcacacatgcgggccggaggagagcagagcgaagagacgggggcggctgcggaagagacacggacgagcagaacgaaccgataagcagaatcgacgccaccgagccccaccaa

SEQ ID NO: 574537 - DNA, 157 bp, Homo sapiens
gcacagactatgagtcccttcgtgtgacgtctgcgctgaaacatgttctgcatgttcatgctcaatcggcccatccaaggaggaagtgccactggaaacaacgggtcgtctcgtggtaagagagagtggatatgatgctgcattcatacccaggact

SEQ ID NO: 574538 - DNA, 2320 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574539 - DNA, 418 bp, Homo sapiens
  misc_feature (78)..(78): n is a, c, g, or t
  misc_feature (112)..(112): n is a, c, g, or t
  misc_feature (169)..(169): n is a, c, g, or t
  misc_feature (200)..(200): n is a, c, g, or t
  misc_feature (279)..(279): n is a, c, g, or t
ctacggacgcgtactgaaaggcggtgtcgatcagctttttgccggcctcgctgagggttccgtcttcaacccgcaggnctgcctcggtggaaagcatttgccgatgcagggngagcagttgggctgatcgtgatggctgcttgggggagcctacgggtgatcttttccngtagctactgagcgcgcctgaaaagcgggtngcgatatcgtgtgcaagcgttagcagggaacctgatgctccaacctggtttggggagcacccgcaggtccgtcaatgtnaaagcccgtttgtatgtcgcactgtgctcttcagatgttgggcgtgccagtgacggcgtttatgtggacttgcgcggctttttcgagcaatgcctccgataagattggcgtagaaatcagcacggggcgtccgtagcgg

SEQ ID NO: 574540 - DNA, 120 bp, Homo sapiens
aacttatctgtgctgggtacaattgaagaagtttctaaataacacacactatgcacattgggccaactattttgtaagcccggatagacttattgccaaaaacaaataaatagctttcaa

SEQ ID NO: 574541 - DNA, 1919 bp, Homo sapiens
  misc_feature (1861)..(1861): n is a, c, g, or t
  misc_feature (1864)..(1866): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctngannnacgggtacgtgcgtcgcactccctggcaggggacgaagggggcccgcggtggg

SEQ ID NO: 574542 - DNA, 1198 bp, Homo sapiens
tggtggggaaaatatttaatggctgccatccccagggtgagccgcggggggtgtgagggggtgaagcgtgggtgtgggtggactcacagcattcttcgtggaatagggcgagtggcctcatccacgctttccgtggagctcgtgacttcgtgatcgtgtgggagctgtggctttcactcgtgcctccgtggacttcgagcgggcacctttgacagggattacgcccgaggcagcacggggttcccgcagacgcgtgggcctgccgcttggcgccttcaacttcgctgtggctttgcagcttgtgcccagcttcccgtgcggggtccaccagccccgtggaagctgcagggtggctggagcagcgactcagaagccagaagccacaggggcaaccctgtggggggcgggagcccccagggccagaaacagccaccacacctgtgcgcgggccagggcctggacgtagccggacaccgccgatgccagggcgcccggggcctcatccgccacttccaggaaacagtcaggccggatccggggtgaggtggtagtcggccctgcagggagcgcacggctcgcgtgatgcttagcgccagctcaggggcggttctgcctcggggtccttccaggagcactctgagggctccgggtaggggggtcacacagaggctagggggagctagcggaatcctccgggggcagcttctggcaacagtccttccgtcacgaggcgctgaaggtgaaagccagccgcatgacaagtccaggcagtgcacagggtctggcgggaacacatcagtgccaactggtgcaccccatcagcaaggtacaagggtccccaagaagaatctaacaaatgccaaaaggccaacttcgttcgcggctttggaaacagccgcgagaaatacaacagccgagaactacatatatgtgagcgcctcaaaaccttggaaacgggggtggagaaccaaaggacacaggagtcctagtccctgcacactactgagagatgtcaacacaccccaaagaacgtagcagtgactagtggtgtcaaccttaatgaaagagagaataaacacgaaacctaactactactacaccatagcgatcataactagtactgataagtactatagcatagtacttcatctaattggctaggtctaaagctcagacatcacagtaatgaggcatcaaa

SEQ ID NO: 574543 - DNA, 1541 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 574544 - DNA, 278 bp, Homo sapiens
catttcgagctcggcacccatccttccctctctacgatccttcccatccttccctttccacggatttataagcctcactcccacttttttttttatattttgaaaaggagtgtggcactgtcgtccggcctggagtgtagtaccatgatcttggctcactgcaacctttgcctcctgggttaaagtgattttcctgcctaagccccccaagtagctgggattacaggcccccaccaccaaacccagttaatttttttgtatttttaataaaaatgggg

SEQ ID NO: 574545 - DNA, 1305 bp, Homo sapiens
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgttaccatgcagcgctacggtaccgagctcgattcgat

SEQ ID NO: 574546 - DNA, 180 bp, Homo sapiens
tgcgatcgaatcgagccggtacccctagttagaagttcaatagcacaagccacattaaaaagaccacatgaaaggctgattctaatggtgtgtaggtctgaggattaagcacacaaatttcacaaacttctgttgagtaaacaaactcagccttctgtaaatatgcatgcaagttgggaa

SEQ ID NO: 574547 - DNA, 399 bp, Homo sapiens
aagaatgtggctggactttatcacagctggggcctttcgtgtccttaagatactaacacttgtaaccatgctagatgatgtaagctaatgtgacaacatcacgaaccacgagtccagaagcctaatccttaatcctacctcactcatgatgaagtctcatgctctgtgctcacacgtggttagctgcacaagatgtaaaccaaagcttcactgaaccctcgaaccaaatcagtaactcacgtgcgtcaatcataatgaaactccccgaactcagtttatatgattatatatagaggcagggtctcactctgtcgaccagactggagtgcagtggcaggatcagggctccgtgcggacccgaccttccaggctccagcgatcctcccgcctcagcctcct

SEQ ID NO: 574548 - DNA, 968 bp, Homo sapiens
  misc_feature (869)..(869): n is a, c, g, or t
  misc_feature (918)..(918): n is a, c, g, or t
  misc_feature (938)..(938): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctcttngagagcatttcacttagaaggagagaaatgtattccagggtcttctttntaatgttgcaaagtgcattntagtaaatgtcctcttaaagggtccttccc

SEQ ID NO: 574549 - DNA, 976 bp, Homo sapiens
  misc_feature (877)..(877): n is a, c, g, or t
  misc_feature (926)..(926): n is a, c, g, or t
  misc_feature (946)..(946): n is a, c, g, or t
agcggggacgcgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatcatcaccgtatctgttaagtccatgcgtacgcatctggatagtcgttctccgctctatagtggagctcgcgccatattagacgttatctcagccatcagagcagctggtgcatgtggggcggcctctggagacccccactgtacacttgggaagggaggacagcaagaaagtgaaacccagagaccccgggtcagcccgtttaactgacaccatcttagagctcttngagagcatttcacttagaaggagagaaatgtattccagggtcttctttntaatgttgcaaagtgcattntagtaaatgtcctcttaaagggtccttccc

SEQ ID NO: 574550 - DNA, 163 bp, Homo sapiens
acggcacccaatatctgtaccttccagtcaattttgctgtgaacctaaaactcctctaaaaatagtctttaaaaaaaaaaagtcaggcaagaagcacagtgatggacatgtgtgagcagtttgcctaacttttaagtgggcattaaaaaaatgggcatataag

SEQ ID NO: 574551 - DNA, 239 bp, Homo sapiens
  misc_feature (139)..(139): n is a, c, g, or t
  misc_feature (149)..(149): n is a, c, g, or t
  misc_feature (156)..(156): n is a, c, g, or t
  misc_feature (166)..(166): n is a, c, g, or t
  misc_feature (174)..(174): n is a, c, g, or t
gttgagactaggagattaacagtagggtgttaaatggacaggactgatcacaatcttatatggtgaaggaagaaccaattggacttagtgacaaattaaatgtgattagcaatgaattggaaactattttgagggaatnttccccaggntgccctntccaaaaaantagttttntgaggggtgggaatagatgttaattgaaaaaagggtttctgaaaagacattttggggaatcgtat

SEQ ID NO: 574552 - DNA, 349 bp, Homo sapiens
attcgcggccgcgtcgacctggaggtttagcctgattttgaagggtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagactgggtaacagagcaagactttgtctc

SEQ ID NO: 574553 - DNA, 424 bp, Homo sapiens
  misc_feature (147)..(147): n is a, c, g, or t
tgtttttaaccccccaaaacagatcatgccaaatgagttgcctgtcaaaggctggagggcaggaggagggcctgggtttgggttttttcctcccagcctttggagggggccttgggccccttagccccagggccagggcctcccagntgaggccccagggcaagccctttttttttatgtattaaaaaccccaggatggggcactgccaaaaggatcaggaatttaggggatgatttcggtcccgtgtcccgggggctgaggggaaaggaagggggcatgattgtagacaatgagggggtttttttgatgtaaagaaaagcaattttatggtttggggcaaaaactcctattttccagtaaattaactttatttttaaagcaaattttgttttgcccccaaaagcaataaagcctttaatttta

SEQ ID NO: 574554 - DNA, 221 bp, Homo sapiens
gccatgactggcactctctggccctacctgagtgccgtgcgggccacattgcagtgctgccctctgcctggagaacttctcctcccagtgttgtggaacgacacaacaagccggaagtggaagtcaggagtagcaaagagctcctgttacaaccttgtgaccatcagacaggaatgagaaggcataaggttctgcattgagggctccatcaactctgtccg

SEQ ID NO: 574555 - DNA, 700 bp, Homo sapiens
gagaacatgtgtgtccccggtcggtcgaagagctctgcgtgactatggtcatacgtcgtggtctagggagacctcgggttgcttaggtggagggattcaaaccagtgataagaaggtgtagatgagctatggttagacgatccatggatcaggatgagacgtactgagactcgatgagagtcctcactctaataggtggctactcttgagttgtgatgatggatctttgcgcacgtgaatgtggccacgatgtggatgcggatttgatagtctaatgaggctcgcgagacatccagggatgaatggaatacgcactcagctttctgacagaaagagctgtccacaacacggtgtgggacctcatcaaatcaaaattattgcgcttgacagtggtatatgcggaaagttgactgtaggaatgaacaagaacatagatcgattagacatgggttgagtcttaataatgattggaacataagagattaaatttacgttttgcgtggagaaccgtcaaatggctggagggtgtaccattagacagttttgaaaaggtggagcggtgagaaagagagatcacatgtactgggaaatttagtgaatgggtgcaatactgagatatcgtgcaagtgcaggagtcagggatatcaaaggaggactgatgatggaaaagtttgcatgagagtaaaatcataccattggg

SEQ ID NO: 574556 - DNA, 138 bp, Homo sapiens
agccagactctagtaggatccccctcctcacagtcactaggctaccaccctttctccatcaacaacctaatgtcagaacagacaccagacacctatcaaaactaggacgtagggagtataggaaggctacagagggct

SEQ ID NO: 574557 - DNA, 98 bp, Homo sapiens
  misc_feature (68)..(68): n is a, c, g, or t
  misc_feature (79)..(79): n is a, c, g, or t
aagacaggtaggccatgaagcatacggcgcaatcaagcaagagcccctaaattcgaggatctatgtgnatgcgatgtgnccccgtggcggttgggttt

SEQ ID NO: 574558 - DNA, 1340 bp, Homo sapiens
  misc_feature (180)..(180): n is a, c, g, or t
aaaaaaaaaaaaaaaaaaaaaaaaaaaaaaaaaaagggagaacaaaacaaaaaaaaacccaaaaggagagacacaaaaaaaaaaaaaaaacgcgcgggggggccgggcaaataaggtgggaccgctaatgggggagtcgtgtgtttttagaacgacaaggatatgtggggacggacgagngtgaaccacgggtaggaggaatgggggaaaatatggaaaagatgggcgctatgttgggcagagggacaccttaactattggagggaggagatatatgatgaggggaaagactatctaccttgaagagagagaaaattaacaaggattaagaggggggaagagagatataaaagtgttgggaaaggagtgatactaaggtgggtatcaacaaaaagaaggcgaaatatggacatgagagagacgtgagcagaaagattagggagtaaaacgaggaggcaatgagagaacaaatagaggcaaacacatgtatatgaaaaacagagaggacgtgagtgagagtgatataaatcccaacagagagaaatgaaaaaacaacagcaaaaaacatataagataaacgcaccgcgacacagttacagaaaaaacaacaagaaagaaggacgaaaagcacaaaaaagaaaagagacgagaaaaaggagaagagaagaacaaagccaagggaaagcaaagagagaaaaggaaaacaggcggaaaacagaaaaaaaaaagagaagaaagacaaaaggaaagagaagaaaaccaagaaccagacggagaagagaagaagaaagcacgcgcgggacagaacgaaggaagaagaaaagacaaagaagcagagaaagaaagaagacaaaacaaaacaacggcaaaaaagagaaaaaccagaaaacaaaaaaaaaaagaaaaaaacagaaaacaacgaagaaaaaaaaaaaacgacagaagaaaaaaaaaaaagaagaggaacaaaaaaaagaaaaaggagagcggacaaaagaagagaaagagagaaaagaaggaaaaggaaacgaagcacgaacgacaacaaagagaaagaagaaggcagaacaaagagagagagacaacacacaggagagaaagacaagagcgagcagagagaagaagaagcagaaagagaagaagagagaaaaagaggaaaacagagacaacagaaagaggaaagaaaaagaggaagaaagaaaagaaaaaacaaaagcagaagaaaaaaagaaagaaaggaaagacagagaagaagaagcacgagagaagaagaagcgacagaaaacaaagaagacaagaaagacagaaaggaaagaaagagaagaaagagaaggagaagg

SEQ ID NO: 574559 - DNA, 171 bp, Homo sapiens
caggatcctcatgcgctgtcttacacacacgttctgcgtggaaagcggccctggcagcgagctcgaaggatatgttgtagcagaggtagagcatattcaccgatggcgtagttgttgtgggcgtacgcccaacaagtgtggtggtttttgccgggtaccgggcaacaaagc

SEQ ID NO: 574560 - DNA, 135 bp, Homo sapiens
tcttggtggctggctgtccgtgcgggctggccgctgctgtccagtttctccgcctccttctgcctgctgcaactccacctcgttggcctgctgagagcagtggtctggtggtcttcaaaggatggattgtaggaa

SEQ ID NO: 574561 - DNA, 222 bp, Homo sapiens
tgatctagagatccgtatgtgtgtacgttgatacctctggtcatattattaaaaagatattcacaacaaaagatatgtatcaaataaggggtgggatcttaccatggtaagatattggtgtattggaccacaggtgtgcctgatggcttctttcatggcagttagaagtagtcaagaagtggacgggtcacggtaacaccacaggaaggggtaccggggttg

SEQ ID NO: 574562 - DNA, 742 bp, Homo sapiens
  misc_feature (600)..(600): n is a, c, g, or t
  misc_feature (605)..(605): n is a, c, g, or t
catggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcanaaaanaattaaataaaatattataacctttcaaaaatgctgtgtgcattttcatgttcttttttttaacattactgccactctccctaatgaaatgtaccttcagaaaagcagtatttggttaaaaaaatacataaccttca

SEQ ID NO: 574563 - DNA, 978 bp, Homo sapiens
  misc_feature (704)..(704): n is a, c, g, or t
  misc_feature (714)..(714): n is a, c, g, or t
  misc_feature (726)..(727): n is a, c, g, or t
  misc_feature (731)..(731): n is a, c, g, or t
agcggagtgtggcgagcgcgagggcgggctgtgacgcggccggcgctcctcgtgcggcggggcagaggagcgagtgcagcggccagcagcacatccccgctccacagtcgccgcagtcgccgcagccgccgccgccgcccgcgcgcccaaccgccgcggccccctgccccgccggcctgccagtgagagagcggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctactgacaccacagccacccttggtgatgagcctcggaaagggctnctgcggctgnatggagcgaatnngcanacgaaggtcctgcaatacaagcagggaacagaagaaggccacagaggacccgcgccaccccaggcgcctgaaggaccatcgctacatggaagcgcgtaaacgtaggccctacgacgacgaacaagcgccacatgcaccccacaaccacaacgcgaaccaccacccagggcacacggaccaccgatatacccgacgccgaccaaaacaaccgccgaaatcccatgacaaaacacgaacacccacaaaa

SEQ ID NO: 574564 - DNA, 840 bp, Homo sapiens
  misc_feature (566)..(566): n is a, c, g, or t
  misc_feature (576)..(576): n is a, c, g, or t
  misc_feature (588)..(589): n is a, c, g, or t
  misc_feature (593)..(593): n is a, c, g, or t
agcggagtgtggcgagcgcgagggcgggctgtgacgcggccggcgctcctcgtgcggcggggcagaggagcgagtgcagcggccagcagcacatccccgctccacagtcgccgcagtcgccgcagccgccgccgccgcccgcgcgcccaaccgccgcggccccctgccccgccggcctgccagtgagagagcggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctactgacaccacagccacccttggtgatgagcctcggaaagggctnctgcggctgnatggagcgaatnngcanacgaaggtcctgcaatacaagcagggaacagaagaaggccacagaggacccgcgccaccccaggcgcctgaaggaccatcgctacatggaagcgcgtaaacgtaggccctacgacgacgaacaagcgccacatgcaccccacaaccacaacgcgaaccaccacccagggcacacggaccaccgatatacccgacgccgaccaaaacaaccgccgaaatcccatgacaaaacacgaacacccacaaaa

SEQ ID NO: 574565 - DNA, 308 bp, Homo sapiens
gggattgataataaacctttctgagatgcagagggtccaggtcaaaaaaaaaaaaaaaaaaaaaaaaaaaaaaaaaaaaaaaaaaaaaaaaaaaaaaaaaaaaaaaaaaaaaaaaaaaaaaaaccttggtgggccgccttgggccaagtcaattttaaactggagaaagttaatgcaggcggccgaaattggggctaattgggcaaattcgccctatagggaggggaataaaaattaacgggccggggtttaaaaacgtggggacgggaaaaacccgggggtaaccaaattaaatggcttggaagaaa

SEQ ID NO: 574566 - DNA, 134 bp, Homo sapiens
  misc_feature (45)..(45): n is a, c, g, or t
  misc_feature (76)..(76): n is a, c, g, or t
  misc_feature (87)..(87): n is a, c, g, or t
  misc_feature (130)..(130): n is a, c, g, or t
ggggcttggttgggtaagagtttccagatctaaatggagacaggnctgggatataggagcttgtacggataaacancacaaacaccnttgggtaagtgatacaccaagagagatcaaaatagggtaggancacg

SEQ ID NO: 574567 - DNA, 575 bp, Homo sapiens
ttttttttattttgttttatttggattggttttcaaaataggcctacggaaggggttctgacactgggtggagaaccattcattcacatattgggaaatgttacacgggggacataaaggacacaggttcacacaaaggggatatacaaccgagagccaagaacagacaccttgccctcaaggggatcccctccgtttcgggcggcccgcacacgcctccagaaaccagggtgaggccccatatggggggtctcatgatcattgcggtttaaagtggctaattgaaatacctgtggaaaatctgctttcagacccacccgcccccaaaattgtaaacccaaacattaccgagcagaacccgggcgcaaaaagagtgagttaaactcactgtactggatcgagttgacaacccggtttctggggcggcaacatagtgtgccaaacccactaaggaaaggcccaaccccacaggggaggtgattcgcgtaatgggcccctgacacggtcccctcgcacagaaccgttttgctagcccgatcagttggagcacacggggaaggccattaaaaggagaa

SEQ ID NO: 574568 - DNA, 372 bp, Homo sapiens
  misc_feature (7)..(7): n is a, c, g, or t
  misc_feature (30)..(30): n is a, c, g, or t
  misc_feature (87)..(87): n is a, c, g, or t
  misc_feature (99)..(99): n is a, c, g, or t
  misc_feature (145)..(145): n is a, c, g, or t
  misc_feature (324)..(324): n is a, c, g, or t
  misc_feature (350)..(350): n is a, c, g, or t
  misc_feature (365)..(366): n is a, c, g, or t
tttgtanttgtctgaagatcattttgaganatttgctcatattgggactttaaaaaaaaaaacacctgtcagggccgggcacggccntacgcctgtaantccagcactatgggaggccgaggcaggcggatcccctgaggttganagttccagaccagcctgaccaacgtgtagaaaccccgtctctactaaaaatacaaaattagccgggcatggtggcgggtgcctgtaatcccagctactggggaaggctgaggcaggagaattgcttgaacccgggaggcggaggttgcagtgagctgagatcgcgccactgccctccancctgggcaacaagagtgaaactttgnctcaaaaataaaaanntttttt

SEQ ID NO: 574569 - DNA, 209 bp, Homo sapiens
ttgatgtcctgcatctgtatttgagccacaggagaataaataaaagaacattttccctgctgctgcttttttttttttaaagggaaaaagttaccaggggcactgttctaggcacttacaaaagtccaatttaatatagtagagtataaaacttgaaaaatgcagatgttgaaggaataataggtatctgggtgcttaaatactttatg

SEQ ID NO: 574570 - DNA, 464 bp, Homo sapiens
cccatctcaccagagtaaaagcccaaatccttgtggtcatccccaaggcccatcatgacctgaccctgaaatgtccaagtctcctactctccacccagtcctccaacatgcctcctttccctgctttgtttttatccacatcacttactacaactacacaagtatgttacatgtctttttgttcctcctaaccagaatataagctccacagaagaatggatttaaaaaaatctgttgccatatccctagcatcaggaagagtgcctgttcaacgaatatttgtggaatggaccaatgggtccccagctcttcatgtgagtagttggagagggagaagcataaggggatgggaagtagtatattactgttctaagactccttagaggcgaagcaccatccttacacacgtagtgccttttcacctgtcgccactgggtggcatgacgagaccatcaaactgctaa

SEQ ID NO: 574571 - DNA, 4987 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggccaccatgccccaggtcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574572 - DNA, 516 bp, Homo sapiens
actactactaaattctgcggccggtcgacaagattggtaccaattcttctttgaaggtctgatagaatttagctctgaatctatttggtcctggtctttttttggtggtgattttaaaaattaccatttctattttgctgcttgttattggtttgttcacagtttatatttcttcctggtttaaactagaagaattatatctttccaggaatgtatccatctcctctaagttttctcgtttgtgcgtatacaggtgtccatggtagacttgaaaaatcctttggatttcctgggtatcagttggaataacttccattttcatttctaatttagcttaattgggaacttctctcttcttttcttgggttaatcacactaatgggtcaagcaaattttctttatcctttccagaataccagtattggttggtacaggacaataagccaaggccggtaatcccagaacactgggaagctgccgaaggacaattcactgaaggccggagagttcggtaca

SEQ ID NO: 574573 - DNA, 635 bp, Homo sapiens
  misc_feature (562)..(562): n is a, c, g, or t
gattttttggttcatctgcatttggccttctctgatttgactctttcactgcagtaacctggctgcggctgctcaggttcccctcctcatgccccttggtaccctttcctgtctgctctcccatgccatgtacacacccacaaccctgccttacacttggaatatttttaccacctatcctgatctttgaaggtagggttaggactacttaacctctattcccactcccctgcaaactggggcttgtgggacgtgagcagccatctacctgcgtgacaacgttaacatttgcctctgaatcactttgccatgtttccttcacatccagatccctagcggtgctagatccactctaggtctttcacgctccccttgcctgtggaacattgactggtcctagctgtggttcccattggtcccccttgacccttctgtggtaaccttgtgcctggctcctgtatgatcacattaccaaaaaggaggaggagggagaggactcttttatcttggccattttgtaatcgtataaaaatagtacacaactgcttactgggtgcagttntttcacaattttaacattagtgacttgcttccctagttgcaggttaaagggctagtcatcgcttcttttagac

SEQ ID NO: 574574 - DNA, 4767 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggccaccatgccccaggtcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574575 - DNA, 230 bp, Homo sapiens
  misc_feature (168)..(168): n is a, c, g, or t
ctgagatcgcgccactgcactcctgcctgggtgacagagcgagactccatctcctcggagatggtcatgatctgccccaggcacagctgcagggctacctgatacttcctgtcagacagcagcagctctaccggcctctcgtactgactgtgctcgatgaagacgtcngagcagcggtccaggagcgcaggatctgacgtctcatccaggtcctctgctatagggataag

SEQ ID NO: 574576 - DNA, 4480 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574577 - DNA, 5094 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgtttttcacattcagtgttataatatttgattatgctgattggttttggtgggtactgatgcgaattaataaaaacatttcatttcca

SEQ ID NO: 574578 - DNA, 5466 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgtttttcacattcagtgttataatatttgattatgctgattggttttggtgggtactgatgcgaattaataaaaacatttcatttccatgtttaaaaaaaaaaaaataaaaaaaaaaaaaaataaaaaaaaaaaataaaaaataaaaaaaaaaactataaaaaaatacactaacataataacaaaaaaaaaaatttacccattaagttggaaccaaattctaaattaataaaaaaaaaattttgggcctccttttcccccttgtcttttttaaacttgcaaagttttattttgggcccgattttgggccctcttggcccaatcccccttagggggggttttaaaaaaaacgggcccggttttaaaaacgtcgttttgggccttggggtcccccaataacccccttgggaaattcccctttttcccggtgggttatacccggcgcccctccggcgcctttc

SEQ ID NO: 574579 - DNA, 756 bp, Homo sapiens
cggggcacctctgtgcagggttcccagtcaccgcgacgctcctcgggaagccatagggcgcctcccagcccgtctccccgtctccagtttatggaatcctaattcccaattcccggaccgggcccagccctgggctcttagctgtcgcgtttttgctgggacctgttccaacaaatgggcgtcttctgccttgggtccgtgggggttgggccggtaagcttgctggacgcctggtgaaggggccagtatgcagttctcttgagccagcctctgtcggggaccacttgctagtgccatcccagccaagaatggtccccggttgtggcatgagtgagcctgggacgccgattctcctcgtccgctgagtgcgcgagcagttgtggacctggatccagtaggaatcaatggccgtcgcgcctgcttcagactcgcggcccgcaacgtgcccgtggcgtcatttggagagtagctggagagatagcatccgtcacgcgggagagttcgaggcaaaccggtattttagtcaagcctaatgtggactttgttgcacgagagaaagaaatgcattaacactgttttatccaacgccctataccaaagtcttcacctggaacccagatgtgtgacatagaagatgtgaaggttgtgcatcctgggacacggatccatatcatggacctagatcaaagctcacgggctctgctttagtgttcaaaggcctgttgcgtctccgagccagtttggagaaccttttac

SEQ ID NO: 574580 - DNA, 5393 bp, Homo sapiens
  misc_feature (56)..(56): n is a, c, g, or t
  misc_feature (459)..(459): n is a, c, g, or t
  misc_feature (2171)..(2171): n is a, c, g, or t
  misc_feature (3096)..(3096): n is a, c, g, or t
  misc_feature (3098)..(3098): n is a, c, g, or t
  misc_feature (3100)..(3100): n is a, c, g, or t
  misc_feature (3108)..(3108): n is a, c, g, or t
  misc_feature (3114)..(3114): n is a, c, g, or t
  misc_feature (3120)..(3120): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccnctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctntntntgtgtgtntgtgtntgtgtntgtgtgtgtgtgtgtgtgtgtgtgtgtgtctgtgtgtctatctgtctttctctttcattcttttccatttggccctgttctgtcccaacatgaaggcaataatttgttacctcattaatggatctatccttttagtttcttaaccacttccctatgctacccatgaaacctagttggggctctgttgtgtgtgatttcccctggcttattctttactttttcctcctttttcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574581 - DNA, 315 bp, Homo sapiens
ccctggagcttcccaaagccctccatctccaatacagcaacttccagctcccaggcaggccacgataggcagagatctcaacctagtgatcctgcaactccagaccgaaagctaccagtggtggatgaatggtcagagcctccctaagactcacaggtagcagctgtccaacaccaacaggaccctctttatatatggtgtcacacagtatatagcaggaccctatgaatgtgaaactacggaacccagtgagatgccagccgcagtgccccagtcaccctaaatctccatcccgtcacatctgccaaagggtac

SEQ ID NO: 574582 - DNA, 5365 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcaaaaaaaaaaaaaaaaacaaaaaacaaaaaaaacccgttgccggcgcgcgggcctcagcgcctaagagaaaagcttcttcaaagaccattccggttggggcggcggggggcccccacgtggcgtgtacgttggacacttggcgccaaagcgcgtggtcccaaaggaggaacccggggccaggagacagggggggggggcagttcctctaccccaattaaaaaaaaggcgcccgggggggacacaccggagcgggcttctggacaaactctccaaagggggagctccggagggcgccaaaccaggggcgactcattctaacccgggggcccccaagggagaccccagaaaatcaaaattaaccccgggcgtcggagtt

SEQ ID NO: 574583 - DNA, 4743 bp, Homo sapiens
  misc_feature (56)..(56): n is a, c, g, or t
  misc_feature (459)..(459): n is a, c, g, or t
  misc_feature (2171)..(2171): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccnctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcagcagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574584 - DNA, 5171 bp, Homo sapiens
  misc_feature (56)..(56): n is a, c, g, or t
  misc_feature (459)..(459): n is a, c, g, or t
  misc_feature (5051)..(5051): n is a, c, g, or t
  misc_feature (5080)..(5080): n is a, c, g, or t
  misc_feature (5120)..(5121): n is a, c, g, or t
  misc_feature (5136)..(5137): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcaaaaaaaaaaaaaaaaaactcttgttttggagcttcaagactttgcatttcctagtatttctntttgccagttctcaatttcctgtgtttgnaatgttgaaattttttggtgaagtactgaacttgcttttnntccggtttctacatnnagagatgaatttatactgccatcttacggctatt

SEQ ID NO: 574585 - DNA, 166 bp, Homo sapiens
gaagacttgcgtaactcagtggactaacattttccccgattagtatccatgaggacatgggttctttccctggcttcgctcagtggattaaggatccggcgttgccatgagctgtggtgtaggtggcacaggcgcctcatatccatgttgttgcgtctgtggcgta

SEQ ID NO: 574586 - DNA, 4960 bp, Homo sapiens
  misc_feature (56)..(56): n is a, c, g, or t
  misc_feature (459)..(459): n is a, c, g, or t
  misc_feature (2171)..(2171): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccnctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggtcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574587 - DNA, 153 bp, Homo sapiens
cccagctgttgtcagttatttgggggtatgtatcaggagtggaattgctgagtcatatggtttagtgatgacaaagaggctattcttagattaccggatagtgactctagtcactcctgtaaccgtgccgaatacccagcttgagacaggcga

SEQ ID NO: 574588 - DNA, 191 bp, Homo sapiens
atattttttatttccaaaaaaaattcattaattgctttttaactctttttataaccaagcaatttaattccaattgttaaaactgaaatactggaaaaagatatttttcctgtcattgatgaaatatatcaaagtaactggagtagctgggatttactagtagggtaaataaaattccctcttcaatccca

SEQ ID NO: 574589 - DNA, 318 bp, Homo sapiens
  misc_feature (82)..(82): n is a, c, g, or t
  misc_feature (140)..(140): n is a, c, g, or t
  misc_feature (153)..(153): n is a, c, g, or t
  misc_feature (228)..(228): n is a, c, g, or t
gatttaaaaaaccaggtcccccagaagcaggggggaggctctgcttccagcggccgctcggcagcctggacctgtggacccnggttgtaaagagtaaattgaatcataggaaaccagtgtcacctttaaaaacaccaatnaatttaaaagaanacgcgtcaaacatttccgggaacggaagtgttaatttcaccgcactacaggggaccaactgggaaacaaatgaantgtaaggcatttaacacgtgtcctgaataagccacaacctggaaattgaagcaaaccaagcctttgaaaaaaaatttaaaaacccccaaa

SEQ ID NO: 574590 - DNA, 204 bp, Homo sapiens
ggacaattggagatactaattcaaggctgtctctaacagagtttaacatatccgtaaacatcagtgcttctgataccctccccttgcattcagatactggtacacactttagcacaccttcacccactagtcagcatgtcacaatgtagaaaggctgtaagtatcaaactaacttctcatcttgataccccaaacaacaactct

SEQ ID NO: 574591 - DNA, 962 bp, Homo sapiens
  misc_feature (962)..(962): n is a, c, g, or t
ctgaagatggctgacaaagggcctcgtggtggatggtctgtggtgtcatatgtatcctgagagaacatcatgctgaaaatatgtgtagacgatagaacatgattgttgaccctagagaaagggggcttgttgaggcgagtttgcgttcatttgaaatcgatatgaggtgttggaagtggatctagcgattacgaacgtgaaatacaagattattgtatgtgagatggctgcgaattttctagcttatgggtcaatgcattaaagttgagtacagagggaagacgtgtcagagcagagcctagataccaaatatatggtcctgtaacatagtgtggttaactttaaatcggaacactggaaaaaacggaaaatactcatagaggagaataaagtcttcgttgggagaattatgttggtgaggggttgaggatgagatcttgactaccaatttttgtaacgaaagcattaggaaggaagagttgcgcttgattgactggtctccatataagcgggtgtttgtctaaggggtagggatgtatgtgtggagataggttgtgtggataaagcttctaatggtgggatgtgttgggctactaaaggtggcttgcctgagaatgtaaatgagttttaaggcagggaaatcaaatgttgactgatcattaggtcagagggttcaagggtgggggattgcgaatgtctatctgtggacgttggagaaattgagggtcatctaacaaagtgagtgcatttggatgttcaaaagttttttgctgtggtgaaacgatgcgatgggatgcggcaaagcagtgtgatttgaaatttttgtaagagaaagcacgatgtggtgtgtttcgcacatcagatgaaactgatttggtaggggaaaataggaaggggtaaggtaaaagagagagaattaaaagagttattaaaacaaaaatgagagtggattgtgagctatn

SEQ ID NO: 574592 - DNA, 388 bp, Homo sapiens
  misc_feature (90)..(90): n is a, c, g, or t
  misc_feature (338)..(338): n is a, c, g, or t
  misc_feature (343)..(343): n is a, c, g, or t
aggtttttctttttgaaaaaaggtcttgctctgtaacccaggctggagtgcaagtcatacaatcatgactcactgcagcctcgacctccnaaagcataaatgatcctcctacttcagcctccccagcagctgggaccacaggcgtgcgctaccacgcccaggctaatagtttaaaaaattttttggcagagacagggtctcatcatgttgccctggctggtcttgacctactgggctccagcgatcctcctgccttggcctcccaaagtgctgggattacaggcgtgagccaccgcacccggccacacttttccaaattgtaagcaggtaggaggccncttanctcgtcggcccattgtgcagggtggccactgtccaaagagatggg

SEQ ID NO: 574593 - DNA, 415 bp, Homo sapiens
ctccacgtttgggcatctcccttgggtttcccgggaaaccaggggcttggtggctaaaacggactggcttggacctttcacagtttggtattttctcagagaggtagccagggttagctctggtaaacgggatgctgctggcaaactggctcttctcggtatccaggagcaccagctgttggcaagtacacaggaggtctgggtggcttggaatggctgtggattcatcctaacggtcagttctttaaaatgcccgttaatcgagtatctggcctactcgggccactcacatggtccaatgcggcatagaggcagcatgcttctcaggaccaccggtggttcatggaaaagaccgggccccacgagatgtacacatgtgtggattatttttaaacccctgcaggtgagagcccag

SEQ ID NO: 574594 - DNA, 689 bp, Homo sapiens
tcggtctaggtgcgaggctggtttgaattcggccgagggtgatggctgctggagtctggcggcgctgggagctgaccctgcgtgggtccctgggtggggtgatgttgggatgcctgcgaatgcccccactgagtgcctgcgctgcctgggcctcccctcccccccgtggctgggctgccatgcgtgggtgatgccctgggcgactgcggagctggctggcatgcgctggggtcgcctgttcgaggagctggacagtaacaatggatggcctgcgtggactgtgcacgatgttgcgccatgggtgctggccatggctgtggctggggtgcaacccagaccccggcgcccaacagggtatctcctctgagggtgatgctgacccagatggcgggctcgacctggaggaattttcccgctatctgcaggagctgggaacagcgtctgctgctcatgtttcacagtcttgaccggaaccaggatggtcacattgatgtctctgagatccaacagagtttccgagctctgggcatttccatctcgctggagcaggctgagaaaattttgcacagcattggaccgagacggcacaatgaccattgactggcaagaatggcgcgacacttcctgttgcattcgctggaaaatgtggaggacgtgctgtatctctggaagcatccacgctctcttct

SEQ ID NO: 574595 - DNA, 115 bp, Homo sapiens
ttaaaagggtgaggatagtataacacaatattacccacgcaaagaaacacattggtttctaagaaaagaaacataaaactatacatatccgtgagtatcattggtaacttctgtt

SEQ ID NO: 574596 - DNA, 466 bp, Homo sapiens
ctttgctgtcgctgctagatggatccccaatgtctctccttgctgaaccttccgtgggccctcttgactccatcgtcataggatcttggattaaatgggggtcaccgtaagcctatctctaggtcttatccatctttccccacgtctgggttaggtatccccagagtgattggcttgtatcttctgcttactccatctgaggtacttattgccagctggcttatctatctccctactcaatactacgagtgtatgccttgttcacctaaattctactgtctagctcaacattttattgaatcaactaatcatcaaaaggcctaacaaattatttcacattcattaaaatacagctgtgcagtaaatacaagttatcagtgaaattttacctaccattaatgagtaataataggttctgttcaacaagttttccatttgacctgccatgttataaactagaaatatt

SEQ ID NO: 574597 - DNA, 104 bp, Homo sapiens
  misc_feature (14)..(14): n is a, c, g, or t
  misc_feature (38)..(38): n is a, c, g, or t
  misc_feature (61)..(61): n is a, c, g, or t
  misc_feature (78)..(78): n is a, c, g, or t
  misc_feature (85)..(86): n is a, c, g, or t
  misc_feature (98)..(98): n is a, c, g, or t
aaactgcgtttatntccacccacactatcatagattgnttaggtaaatacaatgcttatcnagtggtattctacttgnacacagnntactgggtgaanatgtgt

SEQ ID NO: 574598 - DNA, 1115 bp, Homo sapiens
  misc_feature (930)..(930): n is a, c, g, or t
atttatatctgcgggggatcagctgacgctccgcatgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccangaatgtcatccctgccctggaactggtggagcccattaagatagtacgaggtcccaggaaagtctgatgtgtactgggaggtgtgtgaattgcctggtgaatggaggtgaccgaagtcgtgatggatcaacgagagagtactgagtaaagaaatactcgacgcttgtgacatagatgtggtcgaa

SEQ ID NO: 574599 - DNA, 568 bp, Homo sapiens
ttctagatcgcgagcggctgccctttattttgttttttaaagtcttctaagtccttttaatggtccttataaagctagcataagatataaacttaagtagtacacatgagtttataattgactaatctcggacagatagctaagcatagcacatcagagcataacacagggtggagggaaatacggtggtccaaggacatcttctattctgggacctaataattcaatagagaaagaactactggtagtcacgggggttacagaaggtttcatgggacagcgaacataaagctctactagctaacaaataggtcttaagtgataaaaagggtgggccttcagagaagctaagggtaccaatgtgtggtggcagtccaaaattacgaggaaaagtgagttcccttcaggggttcacattcagcaatttattttttccccctttggagacagagtctggctctggttggcccaggtgggatgtgcagtgggcatgatctaggcccatgggaacactccgcctcccggggttcaagcaattctcatggcctaagcctcccgagtacgctgg

SEQ ID NO: 574600 - DNA, 1128 bp, Homo sapiens
  misc_feature (943)..(943): n is a, c, g, or t
gcacaacagaaatagtagagcgcgataccccgcttgttatttcaggcactcaggtgctggagctttgcttgtatattactgttcccttgccgtgatcaattctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacggcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccangaatgtcatccctgccctggaactggtggagcccattaagatagtacgaggtcccaggaaagtctgatgtgtactgggaggtgtgtgaattgcctggtgaatggaggtgaccgaagtcgtgatggatcaacgagagagtactgagtaaagaaatactcgacgcttgtgacatagatgtggtcgaa

SEQ ID NO: 574601 - DNA, 359 bp, Homo sapiens
  misc_feature (19)..(19): n is a, c, g, or t
  misc_feature (29)..(29): n is a, c, g, or t
  misc_feature (237)..(237): n is a, c, g, or t
  misc_feature (343)..(343): n is a, c, g, or t
gacaaagtaaccaaatctncagccagctnccgggcagagaagaaagcagagcccccacctagcaagcccacggtggccaagacggggctggcactgatcaaggattgttgcggggccacccagtgcaacatcatgtagcccccacgtgggtgaccctgggccatggggacccccccccaccctcttgtctttatagcccccggtgaaatgggggctattaaagacaagaggggttgnaagggcaagcccgtgactgttcaccagagggccatgggcacggcaggcgggctgggccaccctgttacagagttttaggcagttagggatcttttcaccgttcgcntggttccttccccaga

SEQ ID NO: 574602 - DNA, 914 bp, Homo sapiens
gggaaggttgtgcatggaggccactgaaagctgacatctgtataaggccttcaatggaatgagaaaccaggccctgcgtcaggcagtgtgagtttgccgtttgtccttaactttctttttatttttatttaaaaaaagaaaagtttaaaacaaatctccgctttaaagacggaataccgatcgttgggtgtctggcaacaagggtaatttccaacttattgcgtatgaggttattctgttcgtgcaaggtctcaggatatttttcgagccctataagaggcccccgtgagttttatgccctttctaaaaagaaagaaaacatgaaaaaaaacatgacaaacaaaagagagagggctggccgcgacctccccatgagagacgtacacacgccacgagagtgagaggacccccaaatggttgatcagtggcacatgaccccaccgcgattgttgtcgggccacagagaggggtgggcacccacctaaacagctggagagcaccagacgtctataataaaaacgccacaaagagcaacacgcgaacgcgaacaacaagctaatccaacaaaaacgaaatcgacgaagacaagagtgagacgacacaaaggaccgtgctgcaagatgagcgatgatgttgcgcacaaaatcatacgccgtaggagagagggccgcagagcgacaacacactcaaagcacaaacaggcgagaggcggtgcgtccacagacgccacaaaacgatgatgtacgaacagaagacaccaactgccacgctcctctcacaccaggccagaggaaagatcaatccgcgagcacgaggttagagcaacacgacgaagcgcgaagtgacctcatgaacaacaagcccaggtaaggcaacaaacacacctgcgtgcacaccctaacccatgcagacgt

SEQ ID NO: 574603 - DNA, 929 bp, Homo sapiens
gacgccgggagctatctgcgtcttgctacagtccgggcgtcgggtccacagacgtcgaaagggccctcgcaatggcttgggaaaccgctgaccacacggtctcctattcccagtagccccgtgctgctgtacgcccacactacctcttccttagacggcttccggtcccccgcatcctcagtacctctgctatctcttttgcagaagtccaggttcaggccccgtcctgttagttgcgtgcaactccctcacccacagcagtacctgaggtggcttctggagagactgcacatgtagctccaaactgctgcagagcaaagcttcgcgtgaactggggctggggtcatacaccccagtgccgactgatccagaatccactggcaatctctgcgtgtcgatctgggcctaccttgcgtgcgggggccatcgctgcgtgtacagtctttgcccgctgcctgattcttcctctcatcgcgacgggccagcgagaggcagccaggatccacaatcaccttgccagagatccagacagtacaccaagtcgaatcagagaggccaagtcagcaggagacccacattcgcagctactacaaaggcttacctcggaccatgggcacctcaaccacaacaaagccattggcatccaacccctaattacacacctcatcattcgtccctggtgactccacgccccccaaagccttcaagcactcacttcctcacattggctcttgacccacccacaccggccccaaaagccatacacatgctgtacccaaaacctggcacgaaaccggcgccagcactccaagcaaaggctatcacaacgaattcccaccgcgccaacccgaacatcacaatcacagccgcatattataccgccctgcgcagccccaacatggcatccacaaatgtatcgccctgaccac

SEQ ID NO: 574604 - DNA, 329 bp, Homo sapiens
ggaattccacccatcacaacttcattcaggaaccataaaacagtcctgcgtgggcctgtacgcccaaaccccgactgactggtgtgtctgataggcgacacagatattaattaagtagctgccgcaaaacctttccgcctggcacccgtgtgacccgtgcctttatcacccatgctgcttcccatggagtttatggaagcatgtgcaatgtccttaccatgatgatgatgcccttgctttttgatcaaatgggcgatgtgaatcgcatgaaaactaagcgagctgaagtggctctaaatgatttgaagatggctttggggctttggatc

SEQ ID NO: 574605 - DNA, 175 bp, Homo sapiens
gcacttgagctgcgacctgatcggactccgacctgggcacgttcactctagtcattaggcaacctcgtggttcccggctcccgacagtataccatattgacgccgaacttagagcggacacccgatcggcatagcgcactacagctcataactcctggccgcaagctaaccgagc

SEQ ID NO: 574606 - DNA, 462 bp, Homo sapiens
gaatacatgcatataccaacacacctgcctaattttttattatttgtagagatggagttgtccttatgttacccaggttggtctcaaactcctgggttcaagcaatcctctcaccttggcctaccaaagggctgggattacaggtgtgagccaccatgcctggagtacattctatatattcatatgatttctcaagctgggtgcagcacgtcacgcctgtaatcccagcaccttgggaggccaaggcagacggatcacaaggtcaggagatcgagaccatcctggccaacacggtgaaaccccgtctctaccaaaaatgcaaaaaattagccaggcatgatggcatcatgtgcttgcagtcccagctactcgggaagtagaggcaggagaattgcttgaacccaggaggtggcggttgcagtgagccgagactacaccactgcactccagactgggcatcag

SEQ ID NO: 574607 - DNA, 960 bp, Homo sapiens
ggttttgtgtgcggtgtgtcttgagtgggtttgcttgggcttgcgcgtgtgtcgcgtgacaggacgaccgatgagggcggtgtcccgctatggtgctcccctgccgggccgtttgtggatggcccgaattgcggccaccagtagttgtaccttgcgccgggatgaccgtgtcttgtctttctgtcggggttcgcctccttctataaaggggccatgtttggcctcgcgttgatggccggttctcgtgccttgcatgggtttgtcatcaaccacccccacgtgcagggggggttttaacgctccctcatatgccacatagttgtgacttgagctgctagctccgccgtaggtagaattagacggttttttgtccggggtgatccctgctatagaatcctgttggtattgattgaacgctatttgtttttttcgctgaatttttcgacgccatggtcccatttgcgcattgtgtccgcctccccccgggcccgccctcaatagtttcgacgccacggttaaataggaatatcaaaggggtgttcaactcactggtgtagcctctcgctcccccgcgtcgcccgtcgcccctttggggacgcgctccccgcctcgcttacgcagcgtgtttatttgacccaaataggcaccgctttacgtagatactccctcacatatacacattagcctctcacttaagccccgccccattctttaaggcccccctaccgcctcgccccttactccttacatcattactataattcgccttaattcatgtgactaccccctaagacccactagcttcaccccaaattttgacacacacacgtcacatccaaccggccctctttgttaacacaaaaccaaaaaccgccccccctgtctgccgccccccctatcttccccctccccgcgatttctcccttttcccccttttaataaaaatctgcaacaaaaaca

SEQ ID NO: 574608 - DNA, 149 bp, Homo sapiens
cacagcctgcctgctcggtctccaaaagctccttcaggtcggcgctggcctctgagcggatgatctccaggttgatccctgctgcttgcgagggctgttccatgtcccggggcagctgccggaggtcggggtggctcttttccgcttcc

SEQ ID NO: 574609 - DNA, 183 bp, Homo sapiens
accactccaccttactaccagacaacttagccaaaccatttacccaaataaagttaggcgatagaaattgaaccttgcgcatagatatagtaccgcaaggaaagatgaaaaattataccagcatattatagcaggctaccccttactctgcatatgattactgattacttgcagggagccagc

SEQ ID NO: 574610 - DNA, 286 bp, Homo sapiens
aaaccccgtctccactaaaaatacaaaaaattagctgagcgtggtggcacatacctgtaatcccagctactcaggaggctgaggcaggagaattgcttgaacctgggaggcagaggttgcagtgagctgagatcgcaccactgcattccagcctgggtgacaaaattaaataaaaaaaaaaaagaaagctttctcactagctcgacttttcctttttttcttattgcgcgttacatgtgtacttcggtttttcatgatcagataattcttccttttttggaaaagt

SEQ ID NO: 574611 - DNA, 1186 bp, Homo sapiens
atgatgctctccttatacggtggtgaaccagtgctcagtgtgcagcggtacctcagttcccgcacggagaatggctgctgtgctactccatgttatgcagtgttcccctatccagcaggtgtccctcatgcgtgggctagcctcatatggcctggtcatgttcgctgtattaccagtgagtatcccatgagcattcagcaagtgctcaggcagccccagaccagttctgtccttgtacttatgtgatggatctcctgaatggtgcctgccaggcctgccagtggctcttcatttgcctgcctcttcagccggctctctcagcacatatatcctctgcttataattcatttggcaactatgttacgatgtgaagacctgattacgacctatggtaccctgcagttctcttgaagccctgtggaccatacaatgctattccagaaggcctatgcccttttggcctatgaggctgcttattgtctagcgacatggccctatattatcctacccagatgggaccctgttgcttgcacggcaagcaaatcaggcatcttttggcactgcgtagaggggacacgcattgctgtggaaccatctatcatgccaatatggggaaaaatgatacataataccaattgattgccataaaccttccatggttgcatggatgtgaggcactaaatgagaatgggcatccgatatggaccttactggaattggcatcggaaggcatcagatgaaccaaaacatgtggcttccagcaatgcccaacccatctacactatctaattgtagtccatgatttcctccccttgcccaccaagtcttaaaccgtattgccacctggttgacccaaacttggctgccctttgactaacctactacaaaagccgcacatgggtttagaagcggggtcctaattcccttgtgcctacactaatctgcaacaaggttgggtcaacaaaatcccacccgccgtgaattgttggtgtgacctgattgtctaagacaaacaaccacgggtgcaacatttaaacggcggacctgtgacccttgctacagatatacccagagggtgtacaacgctcaatggacaaccgatcaagtatcactagaaagtggccacgtaacgtacactggactgagaccacataagaggtgccgtcctaagacgggcactctaacg

SEQ ID NO: 574612 - DNA, 4251 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggtcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574613 - DNA, 4034 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574614 - DNA, 827 bp, Homo sapiens
gagcgggcagtggctgttaccgcaggcaggcggcggtagacatggcggagtgagcggctggcgtcggggcttcacaacaacagtggtggccgtagcatcggcggcagcagcgtcaatagcatcggcgcacgagcctgagcttcagctaccaggacctagcgtcgtgtgccagcatgctcgctgtcctcggagcttctctggagcgtgctgcaagcatcgtccgcggtggggctgtggccggcgccggacagaccggacgaaagggagcagagcagaacgcagcggcggcggacaggccggcagctgtgcatactggcactaccctgcctgggggcggggcacacgacccgacttgaccacaatgaaacactgcgtttacgcgggtacacagtcacccagtcgacgaaactaagaccctggcagtgaatcccacacgtccagccatcccgcccgtgcggtgaaggaagacgcccggatgactccggcctgagcgcctagaagggccgacagggcagtgaggagccggaggtcacaccggacggcccgacgcgactgccaatgagctgggactcgccatggcagggcttcgcgaaaccgacgatcagcgaacagagggtgggccggagggagcccagaacggcccaacaggtaataaacggggtaaccccgagacggacagggaaagcacgacccggctgcactcctagccccaagatcctccattcacgcgacccggcgcgtgacaacaccggcacaacaccgagaaagacacggggcccggagaacccggaggcctacagagccaacaaccaccctggcgcctccat

SEQ ID NO: 574615 - DNA, 4859 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggactttcagcaattgtggatgcttaattctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctctctctgtctttctctttcattgttttctacctggccctgttctatcccaacataaaggcaataatttattacctcattaatggatctgtcctttttcttttctaaacacttccttatgtgacttctgaaatctagtggggctctgtggtgtctgattttccctggctgcttctttagttttgtctccttttgctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574616 - DNA, 968 bp, Homo sapiens
cgtggctgaagtgctggtgctggtcggcatcatcttcatctacgagaagcgccggaggcccgaggacgtcctgtggagtgagttgatcgagcgcccgtgctctgcatccctgaagatgcagcgggctggaccagaatgactcaaggcaaggaacgtcacgccagagggtacactacttgcccgtgaggcaggtggggccgttaggaacagcgtccactgacgtaccgctgtctgcagcacgtgcaggtcccgtgaggtcctattcgcacatttgctgtgcgagtattccaaggttctcacctgcttaagagaatgagcccatcactggacactatccacatttgattcatagcattcccgtatcgtttgtgtctaaaagaaaaaggctctgggggtgttcctcgcaattgcaagcgatatctgtattccagttaaggatttatatcctctcgtctcatgaagagtgttatctagcgagaaggcccagggaggctggaattggcccatggccgagccccccagtgcttggtgggctattcaaggccctcgtggaggtctcgatgttcacatgggcgcagttccgtggcgcggcagccaggcacctttcatctcgatctggtgcccggtaggtcacgttggcccacgggatccgtatagccccgtttttgggtgcgaaaacggtcgacaggggtcacgaaactaggaacggtgggtggcaccacccaggtgtgaaatcccattggcgcggtaggcttcgttggaacaacggcccccaacttggccttggttcttggggctatttgccttccaccaagcaacagatgtgataataaagttgaatcgattgcacaggatacaaaacgacacgtgaattaattaaaagacaccaaacgggtataccaaatcactccacagtagcgggaggggtcggtaattggccccgcaataaggtagtatgcgtccacatg

SEQ ID NO: 574617 - DNA, 4935 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctggacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574618 - DNA, 660 bp, Homo sapiens
  misc_feature (27)..(27): n is a, c, g, or t
  misc_feature (346)..(346): n is a, c, g, or t
  misc_feature (629)..(629): n is a, c, g, or t
  misc_feature (640)..(640): n is a, c, g, or t
gaactcgagttcgacccggagacactnacgtatcagaggctagccgagaacaacttaaaattcttctttaaacttccacattgagtcatattatttggaagacccattaaaagaaacataatatacggaatgtaattagttaattagtgaatggctgtccctcttcgtacctcccctattcaggtactagccttggctatgagaaatagaagagaaagcatactttacaagcacatcctctgataaccaggcttgtgaaaaaataagtccttagaaggaaaactggagagccacagatgtaagtgatcagaacagtgtgttttacataccttaacatatgacctcnagtggctctccaatccttcctcatggcactgggcaaccacatgaataatgaccctacacaccacaggagtgaatcaagcaaagaatatgtaaaaatggaaacatttcattattatcacagcagtagtagaacaatgatgatgctatcagcacttaggaaacaaggagacaaggaattagatggggtccttacacatgggatccaagacatttcttaaatataatgttcagcacacagtagcatcccagctatgcatgactatcctccagatgtggaagactanaagtcgaagtngtcccgggaatctctagagt

SEQ ID NO: 574619 - DNA, 516 bp, Homo sapiens
gttcagattacagtctaaatctacactgtgagtacagccatctgggttccgattgtaacgtctgtaatatggcatagaaaaggcatagctctcaggtctgtggggcaaaggttatacctcctttttgataaaagccctcctcagaaaccaggcaccatacatgtcactatgtacatctttgttcaaaatctcggtcatgcgcgacatatggtctgcatttctcttccaccacttgtaatccccaaaagaagtcgaacttgttattggtttcgtctgctatagcatgtgatcctggctactttccaagacccattcagactcattcttagaaacagtgaatacgatggtagatcagcaggatgtgcacaactccatgcctccaggtgcggggcggttccaggaaggtacccatttacagccagaaacggttaactatactcttagcatcgttttcagaatctgtatagaggtccaatgggtaacagctaggtacccaacgtatgacaacgcgtatag

SEQ ID NO: 574620 - DNA, 829 bp, Homo sapiens
gagcggagtggggccgggacgcggagctgtgtgcatctcctacgcaggctcgctcgctcccgggagccgccgcaggtttccgccggcggtggctagggagcggcgaagagcgccatcagcgggcgccttacggaccccaggtccgtcgcggacgcgcggtccgctcgcgcacctcttcgtcctgcctcaagcctgctggtgcgtgtggaaggcgtgaggcgacgacaaggcgaggcgcctcgagcagggtaagccgctgcgggcggcggtcctccctccacctcctcgctcgggaccgcctctcgcgttccgcgtcgctccacagcttgcgacggagctcgcgggcgtgtcggcaggccgacggctcgacggctgctggcacggaacataaaggaaggaccccaggcggcagtgagggagtgccgccaactgccgtctggtagctcggagccgattcgcccggttcacgccgggcaggcgggcatgctatgggcggccccgtgcatccaagccattcactcggaagggccattcgagctcacggacacttccagtcgttgaccgggcttgcagcagcggaagaaagccccggctttgcgcatttcggggaacgctctgccgtgctatgaatacaataatgggcttcgaaggagacatagacgctaggaacctcgctggggtgccacaatgccttgtggttaggaaacagtggatgttgggctgtgggaatgtgaagattcctaagtggacaaagattgggagctgtggttccagtgtggattaagaaagaaacatgcttcggcaggggagaaaaaagtagtaggagaaa

SEQ ID NO: 574621 - DNA, 140 bp, Homo sapiens
ttccttgaaagcttttgaaaaggggaaagggccttttggggcctttcccccttttttgtttttaaaaggcccccaaatccccagccctataaaggggtgggtttgaacttttccctttgaattaaagatgtttaccctga

SEQ ID NO: 574622 - DNA, 5189 bp, Homo sapiens
  misc_feature (56)..(56): n is a, c, g, or t
  misc_feature (459)..(459): n is a, c, g, or t
  misc_feature (4963)..(4963): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccggctggctcatataaatcacaaattacccggaaaattgggcccacttttaccggcccttgtttacaagggcggtttgcaaaggaagcattctttggccgggtttaatttggccagggtatttaaccaatccataaacctttgccaaaaaaaaaanacccaattgggccactggccaattcccccttaggggcgggtaaacatcaatgggcgcgtttaacaaggggggtggcctcgggccacacaaataccttgtgaaacgctctttcgccggggcactcaaagagcgcccccaaggcttttccaaggggcgccctcttgcgcgcaacaatgcgcgcatcttttcaccgctatcttgaccccttatctaccggcgcctcccc

SEQ ID NO: 574623 - DNA, 3807 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574624 - DNA, 315 bp, Homo sapiens
  misc_feature (21)..(21): n is a, c, g, or t
  misc_feature (228)..(228): n is a, c, g, or t
  misc_feature (252)..(252): n is a, c, g, or t
  misc_feature (272)..(272): n is a, c, g, or t
  misc_feature (308)..(308): n is a, c, g, or t
tggcttccacccacccaccangttatccttaaaaactctgctccccgaatgctcagggaggctgatttgagttataataaaactccagtctcctgcacagccagccctgcatgaattaccctttctctattgcaattcccctgtcttgatgaatcggctctgtctaggcagtgggcaaggtgaaccccttggacagttacccaaggcgatcctcctgccttggcttgnttttttatttctttatgtacctgnttaccattggattatacctnttcaaggcaagggccatgtctcatcatctttttggnatcttta

SEQ ID NO: 574625 - DNA, 606 bp, Homo sapiens
  misc_feature (2)..(2): n is a, c, g, or t
  misc_feature (66)..(66): n is a, c, g, or t
  misc_feature (70)..(70): n is a, c, g, or t
  misc_feature (148)..(148): n is a, c, g, or t
  misc_feature (161)..(161): n is a, c, g, or t
  misc_feature (217)..(217): n is a, c, g, or t
  misc_feature (247)..(247): n is a, c, g, or t
  misc_feature (253)..(253): n is a, c, g, or t
  misc_feature (342)..(342): n is a, c, g, or t
  misc_feature (385)..(385): n is a, c, g, or t
  misc_feature (388)..(388): n is a, c, g, or t
  misc_feature (396)..(396): n is a, c, g, or t
  misc_feature (542)..(542): n is a, c, g, or t
  misc_feature (544)..(544): n is a, c, g, or t
  misc_feature (550)..(550): n is a, c, g, or t
tnccagaagggggcagaatggggtccttggggagtctctgtcccagcccggacaggcagatctcanttcnagaagagcacaatatccagaaaaagcagccagaccggggtagaaggcccagggacagcggtgggaagggcagggcgcngtagtgtgagtgntccaagcacaccctgggctagcgctagccaggaaagggctgccagccctcggccantgacagtggcgcctcctgcagctcccgccncaggancaggctgccaaggcgcgtggctgccgggctggtcagccccagcagggcagcatagagggtccggggcccatgaggcttggcaagcgccncgctggagacaccatggtggatggccagccggcagcccagtgngangttggtgngggcgaatgccgccccgctgcagtgctaggtagctcagggctaccagcttcagtgccatccagcccctgtctggggcctgtgtgcttaccaccctgtaagccacaggccggtgggtattgtggggcagggccaggcccgctgcctnantcgccngcagtgtccgccccccagcctcagcctctgccactgggacgtgctgggtggccacg

SEQ ID NO: 574626 - DNA, 4935 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574627 - DNA, 250 bp, Homo sapiens
ctgacgaccgggtcctccagttcccgtgactcactgtagatactggtgccgcggcttctggtgtcggggacctccgtgccgttggggaatgacacagcagcagtagccgatgctcccatagcactgaagtggcagataagtagccgtatctcgtcgcacttgggcctgaatgaacccgggtagaacagaaaggatgtggctagacctcttcctggcacttggtcagtactttcggtggagcttcccggag

SEQ ID NO: 574628 - DNA, 4931 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574629 - DNA, 150 bp, Homo sapiens
gaccatgctgctgcagcccgcggggtccctcggctcctacagctaccggagtccccactgggcaagcacctactccgtgtaagttggtggagaccgcttacgcccagtaccgcgttgttgtacaagccaggcagcaagggcccctcggga

SEQ ID NO: 574630 - DNA, 116 bp, Homo sapiens
cagcgccagggtcgaaagaatcaacagggtttttttcatggtacgaaggcctcggttaaaaaacgcgcagtgggcggggcggcgtgaagcgttggactggaaaaccgcaatttagt

SEQ ID NO: 574631 - DNA, 3525 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574632 - DNA, 4478 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggagagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 574633 - DNA, 1195 bp, Homo sapiens
  misc_feature (273)..(273): n is a, c, g, or t
gggggggggacattaaaaaagtggtgatgacccaaatttttgagccaattaatgtttggcggggtgggtggtgcttacgctggtgggaatcctggaatgggttctataacagtgaactagctgggcttaatggcagccagcgtgctggggcagcagaacatattcattcttactgggaaatactattggctgggttccaaaggtgatgattttcaacgcagactattggtgtctaatatgggtgctggggtgtaaggatctgtggtggcccangctctaatcagagctcggcctaacctgggcaaagctggcgctacccttcaagtggggaaaattatatatccattggtgttaaccaagggttcacccttctccaccctggttcctaaaggacctttggtggacatgtgctggcggatatttcctggcgtcaatagcaaggtgggtagcctcgggttacattttaacgaacagtgggagcgctgagggccttggtcatcaatactgtgtgcgaatcccaaagaagttccccttgggtaacacttaaggggaaaggatctgggtatggatttaacccatttcctaatggcctggggctatgtgacgatattcattccctcttttacaaacgtacaagggggctgaacaaatgtttggccattggggccatcggaccaaaggggggtgcactattagggggcacaatagtatattataaaaccctgggtaaaggggtctttcaacaagtggtctttgactctttacacagttttggggacacgtggggacgtggaaattgtgtacgcccataagacgacagatacccggcgaggagcacatgctctaacacactaattcacaggggacggggggttgagtattcccccaaggttgcgagcaaaaaccgacaagagacggcgcgcgttgcaaagaatagtatcgacgaagaatatacatcggggggactagcagggggacaaaatacgaggggggattgaagtgttgtgtcccacgagaaacggggagaaacaaacggggggcacaacctagtggtgaccaccgaaaacgatgtggcgtatagcacgcggtggaaaaactgggttcgcgaaaaaagcggaaatgagcgagcacacgacgcgggaacggaggagacaccaaaacaaggtgggcggcgggcgcacactaaaaacacacg

SEQ ID NO: 574634 - DNA, 350 bp, Homo sapiens
tgattgacggcctgctgagtttgtcagagggaggcgcctgaggagagcttcatccagaacctgtctttggagctggatcttctgagctgtgagcagaaatcgctggctcaggacagtgcacacacgggcagagtacatgaggcccccaagcacagatcagagctgtagtaccaggtgcacctgtagttgactggagaacactgtcagtggctgcagcttggaccaggcacagccagagcctgtgctaccacacgaagtgactgagagtctcttgacacctctagatgtcctttcggatgggcctcactggactggagatgacccatcatgtgtcagttcaggcagctgat

SEQ ID NO: 574635 - DNA, 464 bp, Homo sapiens
tggggtggagcacggggtacttaatggagggtccatgtgacaggggtgcggcttcccttaggccccttccccttctttcagggggctcatacatgtggcaacgtggtgagggaggggagatttcaggtggtgggtggggtgacgtgagtgtggtggcgagggaactccccagcgaggtggagggttcctcttctctcttctccctctgtggtgtgctctcatgtggcgtgggggcgtgggtggctccagggggggtctcttaaaacctcctgtgtggaggcgccatgtgtgtgtgggcacatgtgagtggctcacaccaactcgctgtgtgtgtgctgtgttacgcacagagattctcggtgtgctacataatacacgagagaaaacagtggaagctctgcgagaccaaacgagtgtgagggctgcgtgctgagagagtgcgcccacaagtgggcacgaagacc

SEQ ID NO: 574636 - DNA, 205 bp, Homo sapiens
atcccaccttgtggtcccagagtgctgggattacaggcatgagccaccttaccaagccaaatcataactttgaaaacacagtgaaccactaaaatagtgtagccactttggaaaatagtctggcaattcctcaaaacattaaacacagttaccacagatcccagcaaggacactcctaggtatatacccaagagagcacacaggt

SEQ ID NO: 574637 - DNA, 120 bp, Homo sapiens
tggcacgcgctggttttgaactcctgacctctctgatcccccgcccgcatgatgatcacatgctctctctccgaccagcgcccaggcaatttctggccaccttgtgcccttgcagatcac

SEQ ID NO: 574638 - DNA, 844 bp, Homo sapiens
  misc_feature (47)..(47): n is a, c, g, or t
  misc_feature (65)..(65): n is a, c, g, or t
  misc_feature (92)..(92): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (141)..(141): n is a, c, g, or t
  misc_feature (157)..(158): n is a, c, g, or t
  misc_feature (163)..(163): n is a, c, g, or t
  misc_feature (180)..(181): n is a, c, g, or t
  misc_feature (189)..(189): n is a, c, g, or t
  misc_feature (198)..(198): n is a, c, g, or t
  misc_feature (203)..(203): n is a, c, g, or t
  misc_feature (205)..(205): n is a, c, g, or t
  misc_feature (207)..(208): n is a, c, g, or t
  misc_feature (214)..(214): n is a, c, g, or t
  misc_feature (217)..(218): n is a, c, g, or t
  misc_feature (223)..(223): n is a, c, g, or t
  misc_feature (227)..(231): n is a, c, g, or t
  misc_feature (235)..(236): n is a, c, g, or t
  misc_feature (238)..(240): n is a, c, g, or t
  misc_feature (246)..(247): n is a, c, g, or t
  misc_feature (251)..(251): n is a, c, g, or t
  misc_feature (254)..(255): n is a, c, g, or t
  misc_feature (262)..(262): n is a, c, g, or t
  misc_feature (276)..(277): n is a, c, g, or t
  misc_feature (284)..(284): n is a, c, g, or t
  misc_feature (286)..(288): n is a, c, g, or t
  misc_feature (290)..(290): n is a, c, g, or t
  misc_feature (310)..(310): n is a, c, g, or t
  misc_feature (314)..(314): n is a, c, g, or t
  misc_feature (318)..(318): n is a, c, g, or t
  misc_feature (320)..(320): n is a, c, g, or t
  misc_feature (337)..(337): n is a, c, g, or t
  misc_feature (339)..(339): n is a, c, g, or t
  misc_feature (351)..(351): n is a, c, g, or t
  misc_feature (357)..(357): n is a, c, g, or t
  misc_feature (361)..(361): n is a, c, g, or t
  misc_feature (366)..(366): n is a, c, g, or t
  misc_feature (371)..(371): n is a, c, g, or t
  misc_feature (376)..(378): n is a, c, g, or t
  misc_feature (388)..(388): n is a, c, g, or t
  misc_feature (401)..(401): n is a, c, g, or t
  misc_feature (420)..(420): n is a, c, g, or t
  misc_feature (428)..(428): n is a, c, g, or t
  misc_feature (435)..(435): n is a, c, g, or t
  misc_feature (467)..(467): n is a, c, g, or t
  misc_feature (514)..(514): n is a, c, g, or t
  misc_feature (524)..(524): n is a, c, g, or t
  misc_feature (543)..(543): n is a, c, g, or t
  misc_feature (548)..(548): n is a, c, g, or t
  misc_feature (550)..(550): n is a, c, g, or t
  misc_feature (560)..(560): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (582)..(582): n is a, c, g, or t
  misc_feature (590)..(590): n is a, c, g, or t
  misc_feature (603)..(603): n is a, c, g, or t
  misc_feature (610)..(610): n is a, c, g, or t
  misc_feature (613)..(613): n is a, c, g, or t
  misc_feature (742)..(742): n is a, c, g, or t
  misc_feature (756)..(756): n is a, c, g, or t
  misc_feature (761)..(761): n is a, c, g, or t
  misc_feature (791)..(791): n is a, c, g, or t
aaaacattaagttgacttcccattaattaaatactttaacactgagngtagaaaaacttgggcanatccaagaaagagaatttatgaaaganccgggganaaagncngccccgtacctctaggctattgataaaaccagcngggagggggaacagcnncaggnagggtacaggggaattnngggggggnaagagaggnggggngngnngggggnaannggggngacnnnnncganncnnngggagnnaganaannaaaaaangggaagggaaaaannggggggngnnngnagagcggcggcggggggggngggngggngnggggggggggggggggngngggggggggggngggggngggnggggnggggnggggnnngagggggggnggggggggggcangcgggggaagcagggggcnggggggcncccggancgcaggcgggggcggcggcgacgggggcgganggcgggggcacgaacgcaagagcagggacgggggaaccgaagaggcngcgcaaagcnaacagccccccccagaagncccgngnggccccgagnccctacagggcagnggnggnanaaacccancacccagtgagcnggccagnagntcagccccaccacatgcggcagcggccgcaagacacattcaccaggcagttgcccaggcctctcacccatggggggaacacatctggccactttttttttttctgtaaacctcaaatgaaacagaatcncacagatgtggggnccccnccaaattgtaataaacgttagagaaatgcnccagaaaggaacaaagggagaccctctcagatcagcctaaaaccagagtggaa

SEQ ID NO: 574639 - DNA, 439 bp, Homo sapiens
acccaagattatcatggggtcctctacaggatctttggttggttggttggttggttggactataggctgagtctggttttctgtagttactgcaaataaggtgttgctggaagatcatctgtgtatgtccagcaccactccccaccatgccagtctgcagtagttaacacatgcgttgtgaatagcccacagagcctaccatctggttcctaagcagttgcacctctgtttaggactttgtttttctttgttcttctttgtaattcttaagttagctttcccaggttagtctctgagctagtgcttacccttcttatgttagggaaaccttcacatcatgaaaagacatttagataggaaactagtaagttgcttgtgataggttttgaaagtttattatctgaaggaagttttttagtatatgcaggcatgtcgacgc

SEQ ID NO: 574640 - DNA, 340 bp, Homo sapiens
  misc_feature (45)..(45): n is a, c, g, or t
  misc_feature (235)..(235): n is a, c, g, or t
  misc_feature (287)..(287): n is a, c, g, or t
  misc_feature (340)..(340): n is a, c, g, or t
tctattgcgagtctgtttatggtccgaatatgggcgcggcttttnggagggaaatttttagggggcacttagggggtttaaaggttgggtttaaaattttaaacaaattgggaattttttgggggccaaatgggggaaatttttccccgttctaaaaaaggggccccaaaaacttttggggggggataaaggggggggaacacggggggggttttttgagagcggcccccccccnagcaaaagagggtttccccccccccgggggggggggtttttccccccccccnaaggggcaaaacaccccccccgggggtggtggaaaaaagggggtgattttttn

SEQ ID NO: 574641 - DNA, 214 bp, Homo sapiens
accggtctgccgaagaaatggaggacacactgaatcatctgagttcctcaatgtgctgagtcccagggcgtcacatcccaaactgtgacaagaaggggttctataagaagaaacagtgtcgcccttccaaaggcagaaagcggggcttctgctggtgcgtggacaagtacgggcagccattgccaggctatgacaccaaggggaaagacgacgt

SEQ ID NO: 574642 - DNA, 268 bp, Homo sapiens
actgatggtgtggtgcagaggggccgcagggtcggtgtggtcgtcgatgtgaagctggcgagcctctaggtcccaccacttgcgggtagaaacctgaccgtcaatggtgactgtttctgtcccgccgcgcgtgtcgtagctggtcatgatgccatcagggccggtgtggctggtgagacgcccggccgggttccaggtgtaacggtgggttccgccggcgggatcggtggattcgacgatctggtcgagctggttgtatcgataggtg

SEQ ID NO: 574643 - DNA, 227 bp, Homo sapiens
cgcgtgacatgatagatccagactactcgggaggctgaggctggaggatcgcttgagtacagagagattctgggctgtaggtgcgctatgccgatctgggtgtccgcactaagattcggcatcaatatgagtgacctcccggagagcgggaagaccaccagtgttgccataaggagagggtgaacctggcccagtgtctggaaactggtgcgattgagcccaaacgg

SEQ ID NO: 574644 - DNA, 155 bp, Homo sapiens
acgaggaacatctagctaccggataatttcttcatattagtatcatcccacagccaacagattgaagggtcactatttgcctgacagatcatccttaaatgggattttcagagcatgtcacccttttgcttcaagtcaggtttggtggaggcacc

SEQ ID NO: 574645 - DNA, 411 bp, Homo sapiens
  misc_feature (17)..(17): n is a, c, g, or t
  misc_feature (220)..(220): n is a, c, g, or t
  misc_feature (258)..(258): n is a, c, g, or t
  misc_feature (348)..(348): n is a, c, g, or t
  misc_feature (378)..(378): n is a, c, g, or t
gcctgtaaaccccagcnactgttaggcccaagatggggcagattgctcccccaggagtccgagacccaacccgggcaacacagggagaccctgtctcctacaaaatttacaaaaaatcagcccaagtgtagtggtacgctcctgtgttccccagctactcagaaggctggggtggaaagatgctagagcccagggaggtcaaggctgcagtgagccaagntcataccactgcactccagcccccacaacaaagcaagnccctgtctcaaaagacaaaaataaaaccttctaaaacagtgagcttgctaagcacatgtgtcacgcctgtaatcccagcactctgagagnccaaggcaggcagatcacgaggtcaggagntcaagaccatcctggctaacacggtgaaacccc

SEQ ID NO: 574646 - DNA, 425 bp, Homo sapiens
gtcgaccatgcaatcggtgctgtcatgctgcgacgggcgtgtccggatgactcctctctcgcggatgaaatactggaaacttgccgtgctgagataatggcatcactgccaccgagtcaaaaaagcagcctctagagcaccatcggcgatgatgatttcactggtgccagcttttttccaaggccaggcccagtgtcggagccgtcagtgcatcatcagcttcgagacacagatcaaggctcactttgaaccctcctttgtcagcctataacgcccattctccgaatgaaatggtgagttattcgacgactacatctgatcgataatgagaattggttttaactgcgaatagtttgctataacatgcttgggtgttgttggcgtttttaccctctgcattgacctattcgtaaaggttttcctct

SEQ ID NO: 574647 - DNA, 142 bp, Homo sapiens
ggtcggaggtgtgcacggtccacagaaaaaagttaaactgctgctgatgaagattatgacgatgattatgaagaggatgatgattaagatgatgatgatgatgattttgattgatgaggaagctgtaagaaaaagcgcccgt

SEQ ID NO: 574648 - DNA, 404 bp, Homo sapiens
  misc_feature (1)..(1): n is a, c, g, or t
ngggccaggcaccacggctcacatctttaatctcagcctttaggaggcccaaagcaggaggatcacttgagctcaggagttcaacaccagcctaggccaagagagcaagaccccatatcattttttaaaaactcatagagaggaagaaaataatatctaaaataaaaaaaacacactggattgaattaacagtagaaagcaatgacatagcaatagaaatgattgaagttgaagcagtgagagaaaataagaattaaaaagaaatgaataggccatatagtctaacatacatatgagctctaaaagagagaggaaagaaagtgaagaatacagccaaagctttccaaatttgaataaaactataaacccatggatccaaaaactttaacaaagtaaagtccaag

SEQ ID NO: 574649 - DNA, 377 bp, Homo sapiens
acgaggttacagaccgaaggaggctgcacggagacaagatactgagcccatgaacactgaggcctgaatgacccagcagacctgatgaccttcagcaagcaagatcatgactgggggcttcttccacaacggaggagtccaggcctcatgcctccctaccggctcttcaacacctggctggtgcacccgtccaagatccctgtatgctggctgaggtcatcaagatcatcatgcggggaggtacctgctaaatattgcagcccatgccgatcatggcctgctcacaggactgctggacctccaggccctgtccccccagtacatcagcagtgtgagaggacgaggcaccttttgctccttcgatactcccgatgatt

SEQ ID NO: 574650 - DNA, 1227 bp, Homo sapiens
  misc_feature (306)..(306): n is a, c, g, or t
  misc_feature (363)..(363): n is a, c, g, or t
ggtgtggctgaaactgtctggtggtctgaggctgggagagccggaagccgacttgttccctctccctccccaggagcttctgtgactcctgggccacagacggtccaaggcatgggtaaagggccgtggtggactacctcccgtgatcttgtgccctcgcttgctccaatatctggtcagtgggggctcagtgcttgggcagcaatgcaccactcttttcacgctcaagcttattggagtcgtccgtgccacagccaatgacccaagatacaaatccacgtccaaggaagtgagtctcttgctcantccgactggcaaggagagggggcgttctggggtccaccgcgcgcgcaccggaggganggctgccatgtccggcatgtcatggcattctgatccgctggtggcccagtccgtggccgtctcttctggcttggtggacgccgtaggtcccactgtagtccctgatgttcctgttgcttcccccgtgaattgatgcaaccttgaggcatgtggcaattgccggtcgtgcgaggtaggcgcccatggggtcttaagggggcgggagccacggatatggtgcacgtcgtgattggattggcgcagagggcgagtcggtaaggcgagcaaggtcattagctgacatagttgacgtggtccgtcggtacttccctttaatcgccagtgacgaatgatgaaccaaacgcttggaaaatagacagtgttcccgctcgggtcgactcgaggagcttccgtgccttgcgaaccccgtgtgggcccccattcctgcgtggagtgacgcatgcgcagctgggacctctctgtccaacagtgggatcaattggtgccaaatttaactgtgcgcacaaacaggtgggagtgagagtcgcacaatacggggaatcaaggaagcggacacccttcattctgagaaaaggccacgagcggtgcccaattctctctaacttgggggacttacacgggtttaaccaatgtgcggctttcgcgcagaaaggcgtgagtaggccttggttcccgagcaaacagatcgcgcagcgtgcgaccccaatgctgtgcgttttcgggggcaacacccacgagagggctcttaccggagtcttcatcacgacagggctcgggggccaattctatacggctcagagtgttagttcgcatggattgcgggaccgacccgaacgttcgctcgaagagtgggcgcgctcccaa

SEQ ID NO: 574651 - DNA, 429 bp, Homo sapiens
ctactctgaggaccccggcactgcttcgtgattctgaggcagcgcacatctggagaagatgagtactttgtgtgccctagcatcagctaagggagtagtttatcaatcaacacaagctttcctgcttgccttgaatcatggcctgcagctgaaagtcagtggcatcagggctgtgggttatcggaaattttcttagaatttctcctctgctccattgatcagggtagggatggttactgcacttcctccaatcccatcattggtgttgatgagattgggcatgttgtgcttgatttgcccccttggtccggaaggaaaagttcttctcgaggatggcacggtagtactttttcttggatattggtcagttccacctcaatgatcgtctccttgtatgggagcaaggttcttttccacatcatctttcag

SEQ ID NO: 574652 - DNA, 128 bp, Homo sapiens
tctggcctgctgctgtcgtctctgtcccggttccccttggcgtgagcggcgcgtctggcctaacctcgacccctgtggggcctgctggtgctcccgactcttcctgcaacgggaattgaagcactcca

SEQ ID NO: 574653 - DNA, 4854 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggagagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcaaaaaaaaaaaaaaaaacaaaaaacaaaaaaaacccgttgccggcgcgcgggcctcagcgcctaagagaaaagcttcttcaaagaccattccggttggggcggcggggggcccccacgtggcgtgtacgttggacacttggcgccaaagcgcgtggtcccaaaggaggaacccggggccaggagacagggggggggggcagttcctctaccccaattaaaaaaaaggcgcccgggggggacacaccggagcgggcttctggacaaactctccaaagggggagctccggagggcgccaaaccaggggcgactcattctaacccgggggcccccaagggagaccccagaaaatcaaaattaaccccgggcgtcggagtt

SEQ ID NO: 574654 - DNA, 230 bp, Homo sapiens
acgccacgggtaggtacagcttgatttgagaggccagtgttaggcatgacctgggctgtctaggctgctgggagacacgcaggaatctggccaggaaggttgccatgagacgaaagttgggcctggaaaggcccttgtgaagcatgagcttggcctaaagaggccactgggtggcaggagctgggtgtgtagaagctcccaacctttcagcagctgttactcacccgtgg

SEQ ID NO: 574655 - DNA, 3988 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagacaccgtcgaagaagatcggctagagtcatc

SEQ ID NO: 574656 - DNA, 3921 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttgcttccagatggtggtaccggctcgct

SEQ ID NO: 574657 - DNA, 103 bp, Homo sapiens
cccggcaagtgaggtaataaggaatcatggatacttctatattattgactggagcaaccaggaagtaactttagaaggaggatctgatggatatggcagagga

SEQ ID NO: 574658 - DNA, 3907 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaagtgtctgctgttgcaaaaagaagaaaacattctctgcctgagttttaatttttgtccaaagttaattttaatctatacaattaaaaccttttgcctatca

SEQ ID NO: 574659 - DNA, 929 bp, Homo sapiens
  misc_feature (520)..(520): n is a, c, g, or t
ggtggatccagagaccagaggccaaagagatgtgataaactatgtcagtgactggagccgaccctggtcagtccctggggcaggcatggcagcaagaggctggtttccacatgtgcccagagtttgcttcatggaaaggccagctctgcgcaaaggtccagggggaccagtcacgaaggtgtgaagaggcctgagtgtttgtcttccattcagctgagaaaggcagaacaccgccacactgctgcacagacggcaccttctacacctttacactcctcacactgagctccagggtccggacagctgtgcacctgccacctttagcaaagcgaaggccagggcccctgctggccttctgcaatgggcatatattttgtctacccagcattcctttcctttttgagaataactcttcaggtcaaagtagtcacgcccagtcttcctgggcaagagaaacagcccctccttccccttcttcctgggtgaatgtgatgaggatgaccaattagaatagccccancccctaggcagggtgattggctcagggctgggcatgtgacccagacccagccatactgagtcctcctggggtcttgccagagttcctgtgcaataaacccactgtctgggacggtaagcacggcactagctcacgatggccagtagccaactggtcccccttgaaacggctgtcttgccggtgcagtaaacagagctgagagatgaaggcacagcatgagccctgatgtgcgctttcttgtcctgttcctgtccttgccccttcggaaggccttgtgccagtgggcagttgggcccggagacaccaggccggcactgctctccttcggagggcaccgttgtttggtgcggaggctgaactcccgcgtggctgcagcagccacgttggccgacattggaggcttctccag

SEQ ID NO: 574660 - DNA, 365 bp, Homo sapiens
ggtatcattcggcccctatttttccaataattttcaagggctttttaaagcaaagcagacccagccgcagtcatgttgacaggggacctggttattaagctgtttgcagactccagaatcagtaaaatgtttgccagcgcaggggcaaatacggtattagcaccattgtttaatccatgtttcaagggcagaatttgaacccatgtttttgcccggagcgggctccaatggttggaaggatactgtcataaaaaaatgccaggggcccccccgggatgcccctccccagcccctgggctccccaccctcccttggacagggcatttttcataagccaaaaggtggggggttttgccatgacccca

SEQ ID NO: 574661 - DNA, 3747 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgcctgcaaaatgaatccctgaggattttgtagctacccagagaacatgggtacc

SEQ ID NO: 574662 - DNA, 707 bp, Homo sapiens
  misc_feature (415)..(415): n is a, c, g, or t
  misc_feature (634)..(634): n is a, c, g, or t
  misc_feature (650)..(650): n is a, c, g, or t
agcggtcatccaggacaggagtggctcagtgttggggatggacgctgtcgcccagccatgctccaccaggccaccaatgtgtagttggctggtggtcttcgggcatgtgagacctgctcttcactgtttccaccccacttggtggcctccaggatggtagtggcaccctcagagccccatcttcagcatgttctgaagcctcagagtgggaacaggtggagaccagcacttccctttcctgctgctgaggtagggattggggggtcagaacccactcacttttgctctgtgtggacgcctttctcccgtgatctaaaggggacactgtactcaagcttttgacctcatgccttgtgtagtaaaaaaggatttgggggttttgtttggttcctgagagggttgtgttttgttttgnttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgttggcacactcaccctcgccctttccctccggttcagtacctattgtttctcctntcaaatatgtgattgnactagctctttccatatgaaagaattctccttattttaataaaaaaagtttaaaaac

SEQ ID NO: 574663 - DNA, 3177 bp, Homo sapiens
  misc_feature (56)..(56): n is a, c, g, or t
  misc_feature (459)..(459): n is a, c, g, or t
  misc_feature (2788)..(2788): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggccaccatgccccaggctcagcagggagctgctggaggtagtagagcctgaagtcttgcaggactcactggatagatgtnattcaactccttccagttgtctgaacagctgactctgccagcctatgggttcctttatgcctggaggaaacacctgttgggtttgattctgaaagtgggagacactgatcaggcaggaggggcagaccacaccgtcaggaagatcaacagattgcagagggacgagaagcagggaagagactaaaccacatgccagggtcacaggggcagatgacaaggaccaccgaagtgggaaacgcggacgtgtataccccgcaggccgaaaacagagcatacacaaggaagctggtctatacaaacctccgcccaagggcagacatcaagagcaaacgcgctgggaacaacagagcacagaaatccccagcaacacacaccaacaaggccatccc

SEQ ID NO: 574664 - DNA, 633 bp, Homo sapiens
  misc_feature (341)..(341): n is a, c, g, or t
  misc_feature (560)..(560): n is a, c, g, or t
  misc_feature (576)..(576): n is a, c, g, or t
agcggtcatccaggacaggagtggctcagtgttggggatggacgctgtcgcccagccatgctccaccaggccaccaatgtgtagttggctggtggtcttcgggcatgtgagacctgctcttcactgtttccaccccacttggtggcctccaggatggtagtggcaccctcagagccccatcttcagcatgttctgaagcctcagagtgggctctgtgtggacgcctttctcccgtgatctaaaggggacactgtactcaagcttttgacctcatgccttgtgtagtaaaaaaggatttgggggttttgtttggttcctgagagggttgtgttttgttttgnttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgttggcacactcaccctcgccctttccctccggttcagtacctattgtttctcctntcaaatatgtgattgnactagctctttccatatgaaagaattctccttattttaataaaaaaagtttaaaaac

SEQ ID NO: 574665 - DNA, 1219 bp, Homo sapiens
  misc_feature (393)..(393): n is a, c, g, or t
gatctccgtgggcgcggggcggcgggctggggcccagtgaggcttggcaggctgtgctgcggacctgctggccctggacggctgaaagcaggccctgtgatgtggggctggccagtcctggctgtcccagcgtcctgatggctgagccatgatagtgctggcccactggtccagtcggccatccctgtgtccctgtgccctggcgtacgttgctgcttgctgcccgacttccggctcttgtgagccgtgggtgcgcgggtccttgaccgtttcccctggcccctctccctggaccacctttgggttgggactgtgcttgttcacgcatgaaagctgcactatgccttgttgggacaccccctaaggggtaaccctgtgttaacgcgggcgctnttttgggcggaagaccttgggtgtttctgccgttgcgttgacttttggcgggaaaccgccttttggccctttgaagccttttctccttccaatgtgggcgcgtttttgcaacggacaggaagttcctataacaccggttcccaaactttctctgtggcggtctggtggcccaccaagtttgtggaacaaaactggtggaagcccctttttggggcaccgggaaagggaaaggccccgcgtaattttgcaacacgcggcaactttccgtgtggtggcgccgaattttccggtgtttcccatttcgcgtaagaaggggacacaagaaggccttttcccacaaaagggctccaaaggcgattaacggcggttgggcaaccggacaaaacttggaacagccccccgaatgggtcgcgcccgtgtttgcccccgtttgggtaaaacccgtattaatacccggattcgcgccccgattttttcgctcgttgcgccgataagacggttacacggaacacaaggggcagcaaagccttttgggggaacatttgggaacaccaccagaggtagaccagccagccagaaaaagctttttgggtatgtaaagcctaaatggggagccgccgcgacacagcttgggggaacatggtgagcccccctccgattgtgggatttacgccacccccgacaagggcaaacacaggcggacaactttgggcgaagtctggtcgccccacagatggcccgcacgcccaaaaatgggcgcagaagcacttacccgacgatttcttttggtgccacaagcgagattaatctggcgatgtgacagacg

SEQ ID NO: 574666 - DNA, 447 bp, Homo sapiens
gaaggaagcagccttgtgcagcaagaagaagaaaaggctgaacaacggaaagagctcgggctgagaagaaagcgttaaaaaagaagaaaaagatcagaggcccagagaagcgcggccagaatgaggacgatgagaaagagtagggcgatgatgaagaagagcagccttccaaacgcagaagggtcgagaacagcatccctgcagctggagaaacacaaaatgtagagtagcagcaggcccccctggaaatgtcctgccgtagatgtggagccccttcgagcagaaggagaaggcagcctcctaagaggacatgccaaggtctgcacgcagcagcaggcagcatcaccgtctttgtcagcacctcccctcagcatcaggaccgcacgagctcaggccactcttcggggcctgtgagtgtcagtcgccatctcagcacctgggattcag

SEQ ID NO: 574667 - DNA, 2798 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggacagaattaaaaaggaccaagaagaggaagaagaccaaggcccaccatgccccaggctcagcagggagctgctggaggtagtagagcctgaagtcttgcagactcactgatagaggtgccgagctcgattctat

SEQ ID NO: 574668 - DNA, 2952 bp, Homo sapiens
  misc_feature (56)..(56): n is a, c, g, or t
  misc_feature (459)..(459): n is a, c, g, or t
  misc_feature (2563)..(2563): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggccaccatgccccaggctcagcagggagctgctggaggtagtagagcctgaagtcttgcaggactcactggatagatgtnattcaactccttccagttgtctgaacagctgactctgccagcctatgggttcctttatgcctggaggaaacacctgttgggtttgattctgaaagtgggagacactgatcaggcaggaggggcagaccacaccgtcaggaagatcaacagattgcagagggacgagaagcagggaagagactaaaccacatgccagggtcacaggggcagatgacaaggaccaccgaagtgggaaacgcggacgtgtataccccgcaggccgaaaacagagcatacacaaggaagctggtctatacaaacctccgcccaagggcagacatcaagagcaaacgcgctgggaacaacagagcacagaaatccccagcaacacacaccaacaaggccatccc

SEQ ID NO: 574669 - DNA, 2602 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccactgactgtcttttgacgtatgataaccacttaggtttctttgatgtgagaaccctaaaccttcaacctccaattgaattaaattcttatgaaaaacacaacttg

SEQ ID NO: 574670 - DNA, 268 bp, Homo sapiens
gagccctccaggggcccacgggatggttgggatagacaaggtcgtgtgcgtgaattcttcagcccagtgcccagcacagggtcacggttccctgagaggcaccccgctcttatttttagttattctttctaatgggaacctatttttctcctaactgccatctcacagcaaactgctgaaagggaccaggcctcctatgtctgtgcagcagtatggtgtggcgtgaacttacacctttgtcacatctacagaccccatcgccgggtac

SEQ ID NO: 574671 - DNA, 346 bp, Homo sapiens
  misc_feature (18)..(18): n is a, c, g, or t
  misc_feature (28)..(28): n is a, c, g, or t
  misc_feature (62)..(62): n is a, c, g, or t
  misc_feature (118)..(118): n is a, c, g, or t
  misc_feature (251)..(251): n is a, c, g, or t
  misc_feature (274)..(274): n is a, c, g, or t
  misc_feature (283)..(283): n is a, c, g, or t
  misc_feature (316)..(316): n is a, c, g, or t
  misc_feature (335)..(335): n is a, c, g, or t
cacacagggttctggggnaaaacaaggnaagagatcatcaattatgaatttgacaccaaggnacctggtgtgcctggggcctgagcagcatcgttggcgttctggtacctgctgaggnaagcactgggattgccaacaacctttttgggcctgggccttctcccttaatgggagtagagctcctgcacctcaacaatgtcagcactgggctgcatcctgctgggcggactcttcatctacgatgtcttctnggtattttggcaccaatgtgatngtgacagtnggccaagttctttcgagggcaccaataaaattngtgttttcccaggatcttncttggagaaag

SEQ ID NO: 574672 - DNA, 174 bp, Homo sapiens
ggcgctacggacgcctgcaggcattgactaaccgcgccacccccgcgccgttatctttgatcctgtggcaacacgcctcatagtgcttgcagagcatcacttctcaacgggagagtcgaacatgtccacccccactcccgcgagccatatggcctttatccgcgtccgtagcgg

SEQ ID NO: 574673 - DNA, 532 bp, Homo sapiens
cggctcagaagttaaatagccgcacggatgccggtgatagatagaaaaggctcccaaagctcggataggagagctggacggaaagaaatatctgtgtagccattctgatctcacagttggtcagttctacttcttgatccggcaggcggaattcatctccgagctgaggatgccttgtatatcttggtcaacaatgtcattccacccaccagtgccacaattggggtcatgctgtaccaggaacaccatgaagaagacttctttctctacatagcctacagtgacgaaagtgtctacggtctgtgaagctgcttgccctgagctggaggggggtctcattctacaaagagagaggtggcccccctttcttgacctcctcctccttcaagctcaaacaccagctcccttattcaggaccggcacttcttaatgtttgtggctttctctccagcctctcttaggaggggtaatggtggagttggcaacttgtaactctcctttctcctttcttcccctttctgaaccctgacct

SEQ ID NO: 574674 - DNA, 255 bp, Homo sapiens
gttaacaataatctactgtatatttcaaaatagctagaagagaagatttggaatgttccaacacaaagaaatgataaatgttggaggtgacggacatcccaattacccagcttttaccatgacacgttgtatgcctgtatcaaaatattacctggaccccataaatatgtacagttacaattacaatcacaatcaatgaaaaggaagagtatttgaaatgtataatccttgagcttcaatgggcccatagggatg

SEQ ID NO: 574675 - DNA, 1238 bp, Homo sapiens
gctcccggccaagaatgtctgcaccatggcaggcatgcatttccatgtgcgcatgcatgcaggcaggcactcacgcaccatggcacatcactcatgcacagcatcagtcacactaccgcagcccaacatgtaggcattatggcacaacatcacagtcacatcatcacagttacccacaccagccattcacacacagcacagcatcgcacacccacacacagcaggccatatcacaagccaagtatatcaccacaccacagagtatataataggcacaccattgcacaagggttgcacacacacagagcagcacataggaggcattttccacacaggcccacagtggcacacacccatacatcgacatttacagaggcatctccaacgtatcccacagatataggcacacacacaacgtatatcacgcaaggcacaacatggcaatagcacaattcagccaatccattcacaaggcctaggcactccatagagcgcacccgtcaattcattctcccgagacaagaattgacacaaggttctacacaacaggccacacaatatacattatccattagccacacaactacattcacccaatttcaacattatccataccaatctccatattgagcacattatccagtcaattcatctcatacaacctgatcctttcacaacaccacaagccacattatcttagccaatcgagatatactacagtcggttccccagccattcgcggcaattattacaccctgtggcaccaggggccacaattttcgtgtccattagaccaccccacgcaacaacgctaccattgcgggccacaagcccttgtatctgggcaccatcagcgcaattggccgttcaagaagctacatatggcaatctcaaggtcacctagggtatggcgatcctcttccacaggcacacctaacacaccccaacactgcatacaaagccagattaatgtgtgtcagcacacacgaattatccaacttccaatttcttgtcccagagcacactaacacgagcccaggtccagtgggacacaacatttcaatggcggacacacaacagggactagtgtagccgcacaaccaaaccatcagcaattgtgttctcgacagcggcgcccccatagaagtgtatacaccccattccgcacagcgcgtcatgtgattggcctacctagagctccaacgctgtgccaaattgccatactcgcggccaacgaa

SEQ ID NO: 574676 - DNA, 221 bp, Homo sapiens
ttttatcccatctgtatggcctttttaggattttttttttcttatagtccaaataattttcagatcccacctttggtaaatgtgttaattctcctttgtgaataaataaatgagtgttctgctaaaaatggcaattgtaaaattttgttgtatgtaatgtccatatggaaaaaaaatgttttttgttcctttttttaataaaatgttatatatggatgcta

SEQ ID NO: 574677 - DNA, 130 bp, Homo sapiens
ctgttcatatacgaacagctggaccttccattctagaatatgagaccaccttggagaaaggtgtgtggtacatgttatggaatcaggtgtatcaccgttccctatctgcctgactgtacactgtcgccgt

SEQ ID NO: 574678 - DNA, 381 bp, Homo sapiens
tgagacagagtcttgctctgtcatccagcctaaagtgcggtggcatcatcatggctcactgcagcttccacctcgtgggctcaggcgatcctgtcacctcagtctcccgagtggctgggactgtaggtgtgcgccaccatgcctggataactaaaaaaattttttttatagacgagctctcactatgttgcccgggatggtcttgaactcttggcctcaggcgatactcccacctctgccatccaaagtgtttgggattagagtgaagccacctcatccagcctataagaactcttgtaatttaataataaaaagacaaataacccaatttaaatttgggcaaatgactggaataagcatttctccaaagaagatatacaa

SEQ ID NO: 574679 - DNA, 279 bp, Homo sapiens
  misc_feature (89)..(89): n is a, c, g, or t
cagaagcaaggttcttaggtgcagtgactcatgcctgtaattccagcactttgggagtttgaggcaagaggatcacttgagctcagganttcaaaaccagcctgggcaatatggcaagaccccatctttgcagaatattagcctagcttggtagcacgagtatgtggtcctagctacttggaaggctgaggtgggaaggatcacttgagcctggtaggttgaagctgcagtgagctatattcacaccattgcactctagcttgaacaacaaagtgagat

SEQ ID NO: 574680 - DNA, 1418 bp, Homo sapiens
  misc_feature (649)..(649): n is a, c, g, or t
  misc_feature (748)..(748): n is a, c, g, or t
  misc_feature (922)..(922): n is a, c, g, or t
tgggcaacttcacaaatttatattgggggggccggggcttatatctcaaaaatactttctcccctgtgccccaaaaagggggcggggagggggcgcgcaaaaaattaaaaagacgtccctctcccttattgtgcactatgtggacccttattattaacagggcccccctgtggcttgaaggctgtgggggagacctctcttgtggcaccatctctctgtgtggatctcccctgtgctctcagagaggggacgagggtgtgcacggggggtgtggcgcctctctcacccctgtgtgtatagcagtgggcgcacctctcccagaagggcgggggcacacactctctgtggtcctccctgttgggctctcactgtgagactcccttgttgccactttctctgtgtggggcctccctcctcaaagtgtctcccttctcgctgttgaggtccccccccgtctccttctcctgttgtggcccccctgtgtgtctcccccctctctgttgggacaatgtgtgtccccccctgtgtttgtgtcggctctggggggcctctcccacaacctctcaccatatctctgtggggcctctgccggggtggtggccgcccctctggcggctctccctgtgggagacctctctgtggtctcccncctctccaccgaagtcctccgcggagagggtccccccccgagggggggggtggccaataagtgagggcttctctctctgtgagaagaaaattctccccncgcgggagaagacccactgtgtttaaaccttctggtgtgtctcaaccacgcgggcggtgggaacacggggtggtgtgccgtgttgtgttcgccccacaaaaacgccgagccgtgtgtttataaaaaaatcacgggggtgacgcgggggagaaaaaaagtctccccccctagganggggagcccactctttcgccgcaacacgtatctcgcccgtataattacagcccgccggacaatacaacaacaggccttggacaaatctctctcccaactccctcttttgaaagaggaagccgtgtgatttgatccaacccgccgggaaaggctgtccccaacaacagctgggcggccctttaaacgtgtctcctccctctacttccaaacgcgctctgctgcggggagcctcttgtgggcgttgcttctcccaatggggcccccgccgtgtcggggctctgaggaaactttctgtcctccacaggtgttccccccaggaggggggggggagggggcaccccctcttctaggggaaaagaacgcgctctcttgtggccctccctctggtgatggtgtgccgcccccgggctcctctgagctctcccccccttttagttggcctcgtctacaccaccccgctgcaggtagtgttgtgttgctctctctcgctagcacg

SEQ ID NO: 574681 - DNA, 155 bp, Homo sapiens
ccccgactagcccgacagccagctgtccccagataatcaggacacccggagcaacttggacataactgtcggctctcgtgcaacaagccacccaaggctggatcaacacataccccctgtcgggctagtcggggagacgctgtcgggctagtcgg

SEQ ID NO: 574682 - DNA, 322 bp, Homo sapiens
  misc_feature (303)..(303): n is a, c, g, or t
gagaatcttgatgacatgaatcatgaaggccactatcatcctccttctgcttgcacaagtttcctggtgctggacctgtttcaacagtagaggcttattatgactttatgcgtagaagatgagtgcttctgtggataggcccacgaagttcctagatgacctgcgacttcgagccctaccctaggcccacgtgtgcccacttccgctcgtcaatagccatcattcgacgtggtccatgtgttctcgatttagggtctaggacaacagtgccaacaggatcttccccctagacacaactctgcngtagacctgcaaaacaaca

SEQ ID NO: 574683 - DNA, 1188 bp, Homo sapiens
  misc_feature (995)..(995): n is a, c, g, or t
tctcgggggttttttgttggacaacacccacagtgttgtgttttgtcatatatattggggcttcgcccccttctttggggtgagaggcgtttttcttcgtcgcttctttgtggatggccgtttttgtcggcgaaacaaatcgtgcgtttcttgtagtgtatggtccattcaccccccacacttggggtgtgctcctggtgaggcctcactgaatgttgtttttcccaacacagtgggggtttgcctctgggaagcacccccgcgacacactattgttgtgggggcccaacaggggggggccttggtggtgaccacgagggaatgtgggctttggggggtttttcttcctcccctttgttggggcgcttttacaacgcagggggagtcttcgctcaccacccttctctctcggggctgtgtggttttttaaaaccactcagcgctcgtcttgggccacacactagtgtgtgttctctctctgggggtataactctgcgtcgcggccacagagaggagaccctttatagccttattaccccccccctcgagaaagagagcctcctgtgccacacatcggtgcaaatgtttgtccatcatacttgggccacttatagagtgattccccctattataggccccacaggggggcgcccctctctgagaggcgctcccaagagatttcaaagcgctctgcgcacacactctggtgtcgcctcgtgagagactccggagattttgggagattatgggcgccctctcggatatcgccgagagagagatatagcttacactctctctccctctttccccacactcctgtgaaggggagacccctgtggcgagagaagaatgtggggggccgcggggagaaaatggagaggtattgagaatttgtgggttataagaaggagaagtgaagaatcttctccgcttgcacaggtctaagcgccctgtcccttgtcacagggcgggctggcgtttagacttcacggccnctcgtgaagataagaggggcccacagcccacagccccaccccaccacgatgcccctcgcgttcctctgtttgtggtgttcttgttgtgaaatcacttttggcgagagagctgtattttagtaactgctgcctaacttccctgtgttctatcttgagaggcgcctgtctggataaagttgtcttgaaatttcca

SEQ ID NO: 574684 - DNA, 847 bp, Homo sapiens
  misc_feature (22)..(22): n is a, c, g, or t
caagctacctcgaaagggcccncttgtctaatgtgcagagccccccctctgggccccgctaaagacggttccggggagacctaatcccccggtctccggacagtgtaaatgcggcttctcctctcctcagggaggagctggtaaaggacacagcgccggtctcgaccccagccacgggaccccttggtcacccccccggacgaccgtgttgctggaagaaatcctgcgctgggtgcctccacgagggcacactcttgcctggcgccagcccaaacattcttgcggaacaccactttaataaggaccgccctgtgcttcccgcgtggtctccaaccaagcctggttcccccggagcaacccaccccgacccttctaagaggcgcaaaacacccaccaacccgcgaaagtgctcccaccgacgggcacaacatgagtgtcacagacagccccctcccaccaaggaggcaacacaccatttgtggcgacaccccaccctgtcagccagacgcccacattctggcgacacctagggtcccttcccagagcaccaggagaccgcgccgcgttccccggaggctcccgaactggcacggtggacacgatcgcaatccacacgggggcaaaccggagtcctcgccacgagacgaggaccccgaacctcgttcgaaaccagcactgtccctcggatgggggccttcccgcacaaatgctggccacaccccaacacccggcccacgactcttctcagggtcacaatcttgtcgcccccagacactcagtgcgggcccaacctccccatcaccaggaaacgcggggccccaaagagcacccgcgaccaaacaaaaca

SEQ ID NO: 574685 - DNA, 185 bp, Homo sapiens
tccctgccacaggctgatgctacagaaatatgtcagttaagccacagaaacagaacagcttaagaagggctgggcgcccagtctcgtcacgagcacttacagctctggcgtcatcagagagcctctatcatctccctctgcaaagactcattcaacacccgggtgcagagtctccttgagcaggg

SEQ ID NO: 574686 - DNA, 580 bp, Homo sapiens
ggggcttgcttgtttggttttggggcgacctcccccgctctcttatagcgccaggaaaatatggttgggcccgcccaaagaagcaccgagaaaaagtccgctggaggtctcgatctcaacttttagagctccccaactcgcttttatggaaaagatggggaagattacctccccctgtgggttcaccaacaccagaacttctgtaagaatggatccagaacccagggccaagacggaaatttggtcctattctcgcttaaccaacatgccccagctttggaggaaatcttgaaattaggagtacttatagcttatgttggcgtaaaacatggtgtcccatccactcaccagtgcgccacataaatatattgaactgggccccagccatgccgggaaatactaccagagtgtgcaccactggctatccattgatcccaggtgactctgacaatccattagaagccatgcccagaaccagactggtgaaaagtaaacccttttctcacctcaccaaaatttccacccgccaacaccctttaacctgccaaattttccctttaataaaatttgcttgttttta

SEQ ID NO: 574687 - DNA, 104 bp, Homo sapiens
gtatctagaggcgagcagagaactgcttgaaccaggagtagaggtgcagtcagccgaggtcgtacactgcacttcagcctaggtgacagagcatgctccatctc

SEQ ID NO: 574688 - DNA, 1099 bp, Homo sapiens
  misc_feature (21)..(21): n is a, c, g, or t
  misc_feature (62)..(62): n is a, c, g, or t
  misc_feature (110)..(110): n is a, c, g, or t
  misc_feature (129)..(129): n is a, c, g, or t
  misc_feature (131)..(131): n is a, c, g, or t
  misc_feature (143)..(143): n is a, c, g, or t
  misc_feature (172)..(172): n is a, c, g, or t
  misc_feature (174)..(174): n is a, c, g, or t
  misc_feature (182)..(182): n is a, c, g, or t
  misc_feature (196)..(196): n is a, c, g, or t
  misc_feature (200)..(200): n is a, c, g, or t
  misc_feature (206)..(208): n is a, c, g, or t
  misc_feature (210)..(211): n is a, c, g, or t
  misc_feature (284)..(284): n is a, c, g, or t
  misc_feature (300)..(300): n is a, c, g, or t
  misc_feature (345)..(345): n is a, c, g, or t
  misc_feature (370)..(370): n is a, c, g, or t
  misc_feature (423)..(423): n is a, c, g, or t
  misc_feature (484)..(484): n is a, c, g, or t
  misc_feature (494)..(494): n is a, c, g, or t
  misc_feature (510)..(510): n is a, c, g, or t
  misc_feature (536)..(536): n is a, c, g, or t
  misc_feature (551)..(551): n is a, c, g, or t
  misc_feature (595)..(595): n is a, c, g, or t
  misc_feature (597)..(597): n is a, c, g, or t
  misc_feature (630)..(630): n is a, c, g, or t
  misc_feature (640)..(640): n is a, c, g, or t
  misc_feature (646)..(646): n is a, c, g, or t
  misc_feature (671)..(671): n is a, c, g, or t
  misc_feature (721)..(721): n is a, c, g, or t
  misc_feature (741)..(741): n is a, c, g, or t
  misc_feature (808)..(808): n is a, c, g, or t
  misc_feature (854)..(855): n is a, c, g, or t
  misc_feature (885)..(885): n is a, c, g, or t
  misc_feature (887)..(888): n is a, c, g, or t
  misc_feature (892)..(892): n is a, c, g, or t
  misc_feature (904)..(904): n is a, c, g, or t
  misc_feature (917)..(917): n is a, c, g, or t
  misc_feature (948)..(948): n is a, c, g, or t
  misc_feature (960)..(960): n is a, c, g, or t
  misc_feature (983)..(983): n is a, c, g, or t
  misc_feature (1003)..(1003): n is a, c, g, or t
  misc_feature (1008)..(1008): n is a, c, g, or t
  misc_feature (1020)..(1020): n is a, c, g, or t
  misc_feature (1058)..(1058): n is a, c, g, or t
ggggacctcagcgagacgcanggactggcccgcacctctggccgccgcctcccgccgagaancgagttctagttggggaaacgtctgatatctggtcatcaaggtaagancctgatggagatattttantnggagcagttttntgccctcggagtgcgcccggacgcccggnantttcaggnacttcttgggagcntacnggaggnnngnncggctttgctccaagctgcgtccctacctgaggtctccacgggaggagcggtttggacgcgccccaccggatnggaggaggtgcttggngaagccgggccgtaccgccggtctgactcccggcttttctctgcnagtacaaccaccattacggcgtganccactccttttcctctaagaatgctgaacggtaccactctagaggcaggtgantaatgtgccaggatccttctgaagtactctgccccttgggccagtacgtataccatgtaantatatatacntatatatacaccttcntagggtggaacgaagaggagtgtgtntatgtattaaaaatnaaaccgcgcttcgtaggctcaaaaatacacatactctttcagantntcctgacaggactactgaaaccctccttttgcntttctctttnactgtntttgactttcctcaggatcagtgtncggggcgccaggcagaggtcctggttccactgaacctccagtcgtcagtngctccaggcacgcgctcctnaccctccggggagctgctgggggtcctctttcttggaagggatggaaggggggccgagaagacactntttctcacacgtgtaggggtaaactggaaactggcttcacccacanntttttgttgttgttcagtcctaacccagcncnncgtntctgcgccttanctcagcggacgcnttcggggacttctccctttatttctgcaganctgagggcaggnggcgcaacaaatctcaggtaaanagcataacaattcagaaganctgtntctagacttggngaggcccctcttggatccggggattccggccggtacancttcctttttttcaacttttctatattttactaaataggct

SEQ ID NO: 574689 - DNA, 270 bp, Homo sapiens
  misc_feature (254)..(254): n is a, c, g, or t
agtcaacagtgcctaatagctgacataacaccaattaaatttttaatgacactggagtaataaaagagcccttggcatacttctctttgcaaacatgactcaaagggtggttttccttttgcccttgcttcaatttccagatgccaggccacttataagccacttatctctttactcagagctggtattcgggggttatcattttataagaaaaggaccacaaattttagaattgcctactctaactccgaagntaatcccaatcttacc

SEQ ID NO: 574690 - DNA, 330 bp, Homo sapiens
ccggggccagctcctaagtgctgggacacaggcgtgtgcaccaccccggcgaatttttatatttttgaggtagagacaggattggccatgtgcccagactagtctctaattcctgacatcaagtgatccacccacctcggcctcccaaagtgttgggattacaggtgtgagccaccgcacctaacccaagcccgacccaagggttagaattattttttggttttgttttgtttttgagacaaagtcttgctcttgtcgccacccaggctgggcgtgcataggccactgcacgcccagccttgtcctaataaaattaagttgtatcatttc

SEQ ID NO: 574691 - DNA, 162 bp, Homo sapiens
agaactagcattaagaaatcttgtgaattcaaagaaaaggtctgattagaggtgctgttggaagcagaagcctcccaagttccggcatgagtaactagacagtatcagtgccataccctgaaccgtggaaccctgacaagtaggtttggaaagagaccgctc

SEQ ID NO: 574692 - DNA, 384 bp, Homo sapiens
  misc_feature (115)..(115): n is a, c, g, or t
tttttccttccccctcagctgaatggtaacctgtacctaaactggaagagacctggttaacagctgttagtgtgagtcgcagtccacaggtgatcctccacaagtgaggtcaccncctgaaggcagcaacagaaacactccacctttcctttttctctttgtaactcaggctgctctggaagccagggtccccctgccctcagcatcctaagtgctcaaaggtcggaagatgtgagtctgcatgcctcactccagtctcacaatctttacctgaaaaaaagcggagtgggtccttgacaccatatatttaaattaaataaaggccacctgggtgtgctgctctgatttaattccagcactcagaggcactgctaggctgatccc

SEQ ID NO: 574693 - DNA, 608 bp, Homo sapiens
ggcgggcatcacgatgtgggccacatggtgccaatgtcacaggatacttggggtgttgcttttccagacagaaacctctgtggctagtggtgcctttgcccaagttttgctcaggcctgctggttttgtttcgcccacttagcctgacaggctgtgctcagctcgtgctactggtgtggatcccatgcttgccaagggcaagccagccatggagcagcgagagctgtgtgagcaagcaagcatggggtctggccactgcacacagccaggcatgccagctgtggcagtgcaggcagctccaggtgccagcacgggcacagctgtggctggaccaggcgtaccacaggcaacttccaccgctggcactggggaatgcggtggcacctggaagcttagagacaccaggaaccgcagagccccaaagagggtatcataaccctggattggggtgctcctaggtctgggctccccaaagggctgcagcttttctctccttctctcttttctccttctctcttctctccttctcgttgcccacaacgtggcaagcaaggggtgtgtttcagtcctgtttgtgttcagatcttttagtgccccacttgtcagct

SEQ ID NO: 574694 - DNA, 124 bp, Homo sapiens
gagcgaggcagccgggtgcttcgagcggactcgatggctctgtagcacccagttggacccagtcgcccaggcaccgccgcgccccacggccgtctcctgcgcctcccagaggagggagtttgag

SEQ ID NO: 574695 - DNA, 113 bp, Homo sapiens
gggatttgaagataatggttcactcaaaggaacctattattttctctacttgaggacccaatgtagacttgcactgatatttttattactgccttatataactataggatcta

SEQ ID NO: 574696 - DNA, 1358 bp, Homo sapiens
gcaaaagcttcagctactggaaaagtcattggataagaaactaccaaaacctcttgttacacacaggtgacctatgctggctgccaggtgccatgctgtcgttgagaccagctgtccagcaggccaggaaccatgcagccatgtaaccgtgagacgctgttatagaagaacgaatacagacttatcgtccatggacgccatatattctgagttagtatacgtagcgcgtcatccaagcccgcaatggcaaacagatctggtatgtggccccgtgcagcaagatagaccgtgtggtccaggtcttcttctctggatcgtaagttccttgcaagatagagatgtactgtggattgcaccaaagatgcgaggctgttccaagagcgtgttgttgcagtgacatatgtgaacagatcattgtatgcgttatcatgagacacaacttggaggaaggagccacagcgagtcagacactaagaataccgtacatgggctcgggacacgtcgactggagaacagtgatcacgctcactcgcatacattgagcatggcttagttatcaggttcgacaatgcaaacttgcagagatatgtggcgagagagcattcatgttactaatgaactgttctcccatgattgatcgcgttcatgcgagaacttatattgctgtgtgccacgaaggacagcatgcgtgccagtccctgggtaagggagctcagctgccgatgataaaactagcaaagcctagcatagtgaagacaactgttaccactccatcaaaacttgtgtggactttgtgctttatgctgaaccttgaacaaacaagtttagtaacttaaaagcaaaccaagattcaagagcagactggaaaagtgaaagcaatccctaaggaagcatatgaaaagtctggagcacatggagatagggacatcattagcattttggcaccattatcctataacggaagaagacactttttagatgaattgggcacgaggggtggaatggtctagatcaattatcttgttagacgcgaaattacccgtgatgtgggcaacataagctagttgtttttggacactagtatgaccattgtgtggcaattgtcaccccaattctttcgaattgtcagacaatggaagccttttggcgataacacacgtgaatacacctttgtgcaactggtgacagtaggccaccagctcgttacacaaaaccgtcggacaataatcgggcggaaacatcgatcactatcaaatatgcatcggagtctagtaaagatgtacagctgcagcaacacggagatcaactgaccagctgtgtgtacacaccaactatctatgacacgtagattgagtcca

SEQ ID NO: 574697 - DNA, 454 bp, Homo sapiens
cctgcggtggtgacagtgaacagcttgccgtaagtattgccggacatgcagggcgctccgcgaatcgagtctagatcaagcgtggcagtatacgcgggctatccccgtagttcatcctcgaaccttatcctcgatgacgagtcgaaccgacactctgtagataatggcgtgataatgctgcgattgattctgatggccctgaccctgttcagcggttttgcccaagcctccgtgctgctacaacaaccgatcaccctggacaccggcagcggcgagctgttcggctcgttgctgctgccgcgctccgacgcaccggtacccgtggtgttgatcgtgtccggctcaggccccaccgatcgcgatggcaacaatcccgatggcggtcgcaccgacagcctcaagcgcctggccggggtactggccagtcacaatattgccagtgtgcgcttcgaca

SEQ ID NO: 574698 - DNA, 627 bp, Homo sapiens
agtgctagctgagctcgttgaccataataaacatcaagatttacgacaggataggagtcaggatggagactctgatcaacaggtataagagtctctacaggatgagggtgagtaagatgttaatgtttttgccacagagagcgtgtttttgcactcaggtttcagcagcttcgaagattaggtggtaccatggctctgacagctgctgccattaatcgggatcctgatatggccatataggccatgggcagacagacagagggggttatgcgtattcggtgaataaatagaacactggagctcagccttattgaacaacctagaatgtttactaggaccaatgctccaagatgtatgtgacaacagcccaaagatcaggcgagcagctgcttatggcctgggagtcacggtacataccaaggagagatatattatcgccctttctgagcataagcacttaccgctgttggaagagttattcagtgtgccgatactgagagcaaagaatatgtcaatggtacagagaactgcttttatgcagtggggatatacatgaagttcaaggcagactgggctaacctttgagaggtcctttcacactgtttggcttgggttcacaacatgaag

SEQ ID NO: 574699 - DNA, 1571 bp, Homo sapiens
  misc_feature (481)..(481): n is a, c, g, or t
  misc_feature (517)..(517): n is a, c, g, or t
  misc_feature (803)..(803): n is a, c, g, or t
  misc_feature (828)..(828): n is a, c, g, or t
tgggccaaatctcggggtgtttcgcaaaaaaaaatccaaaaaatttacaaatggcaggtggagttattctttttaaaatggcagattttacaaaacatattttttttcacagggtgggttctttttgggtggtctgggtctggctggagtggtaaaatgttggtgtatctgggaccagatctgggtgtctctctctctgggtctccacaaagagaactatcttgtggagagtgtgagagtgtgggacagagtcctctggggcgcacaggctctcgcgcgggagacccacctgtgtgtgtgtgtgacacataaaagggctctctctggggagtgtgtgtcgctctctctgatggtgataaacatgcgcgtgggggagtgattctcgagggcgttgttggtagtttatattctataagagaaacaatatatacacacaccgagacacatatatctctataacagaggaagggggtgctctttntaccacccttgggggagagcgcacaatcttgacacncaatatagcgcatacaaagtgtggttctgtgggggtataatctttaaaaagaagagagtgtgcaatatttatattctgtgggtggcgcggcctatgtgcgcgtcgcagagtgtgcagaacagccgcagacagcggcgcggcaccgccacagggggggtgtgttgtgttgcgccccctcttggtgggtgcaccccagaggatagtgtggcccccgcggggcggcttcttgagagaagatactggggcgtcgtgcgagaccaaattggcgtcttctctggagatctcncctcttggggtgacgaaaggcgtcncgcaccatgcgcacaagaggcgtgttttgtgtgagcggctctgagagcgggaggagggggccctcttgggtgttgggggagaaccctcttgggagtttcttgggggggcccccttctcaccatggtgatgtcccccagaaggggcgcacccattatggttgggccgccaaacactcttgggcgtgtttgtcagacaaccagcggtggagccttgttctccccgccccaaagagggcgcgcccgcggcttggtgttggctacaaccattttcacagcaggaaaacgcttgggggcggccccaatgtgcggacaacaaatggggcacaaaggggccactcagttgcccggggagagagagcccctctttgggtgcccaagaaaaatttcatttccccattcccacatctacttttcattccttggtgtggccccaggaacaccctcttggtggggtgttgcctccccgaaagaggggcaccaagaggggtggcgcgggaaaaaaactaccacacggcgccctaggggggacaccgcgtgtaaaaagacaagacaatgtctcccggggggcggcaacacacaaaaacaacaccccgtcgggggcgagacactactgaagcaatgatacaaacacagcaccaagacagtggggtggggtgctacaaaccttgcaatgacgcacaaacacaacaaaagaaaaacccccccagcaatgtggtggtgcaacaagaacacacagcaaacaa

SEQ ID NO: 574700 - DNA, 452 bp, Homo sapiens
gtaaaggaaatccgaagggtggtgctagaagacaagacctttgtgaatgattcacatccctttcaagtaggaggatggaggcctgcttcattaaaaagctgggggtaaggtgggggtggggagaacccccttacaacatggggccacgtcaggggaatcccccttatttctgttttgcatatgaggaaccctagagcagccaggtgaggctctttagtttaataaaaatcatggaaagacttttaaagcagactttttttaaggggtaatagggattttttcagcctattttgggtgcaggttcccatttttaaaaaaggtgagggaatctttccccccttccccaacctaatttttggaaaagcattaggggtgaaccaaagctttttcaagtttcaattttttggaaaagcctttttttcagatggatttaaccaaccaaaaccctttca

SEQ ID NO: 574701 - DNA, 288 bp, Homo sapiens
tggagagggagtctaattttggcccccaggctggagggaaggggcacaatctgggttaattgaaggctccgcctccaaggttaacgcggttttcttgcttgggcctcccaaggagtgggaattacaggccccggtggccatgccgggttaatttttggaattttaggaaaagacggggtttcaccgggtgggccaggagggcctgaatctcctgactttggggcccgcccgcctggccctccaaaagggctggaattgcaggcgtgaccccccgcccccggcctaatt

SEQ ID NO: 574702 - DNA, 160 bp, Homo sapiens
tactgggtcgcagcggggcggggtaacggcgacggttaccagaggcttgctaaaagtcatcgaaacagctattacgtggtgagttagacgctttgaacgtcctattacacgatggattattgatgccgactgtgacgtgcgattcgctaaatttcgacgt

SEQ ID NO: 574703 - DNA, 141 bp, Homo sapiens
aggagttcagcctccctagtagctgggactacaggttgagtcaccatgctcggccttatttacttttttgaaaaaagaacaggccagtcacggtggctcgtgtctccaatctcagcactttgggaagcatgaggtgggatg

SEQ ID NO: 574704 - DNA, 377 bp, Homo sapiens
agctttgagccgaatgtggtcatcagctatggtcagcacgcttctggcaaaaattttcatgtctccttggatacacaagggctcatttcccacgggcttctcgagtcagaagtcccatagtttctctgcttagcagaagtatggaaaagtgaggctgggtgcggtggcttacacctgcaatcccatcactttgggaggccgaggcgggcagatcatctgaggtcaggagttctaaaccagcctggccaacatggggaaatcccatctctactaaaatacaaaaattagctgggtatggtagtaggtgcctgtaatcccagctactcgggaggctgagacacgagaatcacttgaaccccaggaggcagaggttgtgg

SEQ ID NO: 574705 - DNA, 478 bp, Homo sapiens
tgttagggatatgagcattcaacacacgatggatgaatcaggcacatctacaggcactggtgtatctttaggtggtgtgatcttacagtccggtgctcacgacaggatataggccactcagtcagccacaccaaagtgcaacatcccaccagcaccaagacatgcttttgagatatacagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcc

SEQ ID NO: 574706 - DNA, 138 bp, Homo sapiens
  misc_feature (65)..(65): n is a, c, g, or t
  misc_feature (126)..(126): n is a, c, g, or t
ccagttttcatgtatactccggctgcattcccacgtattatttcgtttaaaaatgttggctgacncgttgaaacccgtcttcatcgcacacatacatacgaaaacaagcattccccttaattcggntaggcgctacgg

SEQ ID NO: 574707 - DNA, 117 bp, Homo sapiens
tgactatacacggctcatggcaacgcggatcgttacctactgagcaagggcaggatcaaacccgcaactcatggttcctagtcagattcgtcaaccactgcaccacgacgggaactc

SEQ ID NO: 574708 - DNA, 988 bp, Homo sapiens
  misc_feature (217)..(217): n is a, c, g, or t
  misc_feature (437)..(437): n is a, c, g, or t
  misc_feature (669)..(669): n is a, c, g, or t
agcggaaggtggtgcagtgtgactacaaactgccaggaatagagtctggttgccgacttcggttccggtctctgtaacagtcgttatcgcttagtgtgaatgaaatatcggtagtggggtccaggaatttgccggagatatcagacaattcttcgagccggcaggacctcgcgcgaccgaaagagcgttagtctcatcaagagaattgcttgatccngtcctgggtcgctggaagcgtagagctaagcggtggtgagcgtacaggtaatagtacaagtcatagccagcgtagacgctgtggtgtgagaatttggtgagacgtagtaagtgaagatgacgtgatgtctaactttggttaaccagaagtagtgcgtagagcggaagatcgagatggaacaatgtatagatgggaaagcattgccgatacgattgatatnaaatggcccttgcaaaaggattaagcatttcctaagctctacgccaggcgttgactggcccgtgccctacgcacaagtagcggttcgccctcttatgacccgggaaggcactaaagaagacgatatatgcagtgccgggacggccagaatactcccacgagcaatgactctgatatgactaaatactgctagacctgatagtcaggtgcccgtatcactatgtatcaagcantggagccttaacatgacgtttctcagggaatgcagggccctgtgcaacgagtaatccacgggatacgcaccaagttatgatactcgccagaaggccgagcgtgttcccttgaagatgtcgtgaattggggggacgaagttatgctccaaggagattgcgatggcaaactagcccctaataggcctcacccttgtttgccttgggtggacgacctcaggagacaatgtgatccccccacatttgggcaagaacaagcgcagaacctgtgggacactctggccttggatacgaataaaagaaacggcacgcaggggcacag

SEQ ID NO: 574709 - DNA, 316 bp, Homo sapiens
acccaggaaagcgggctgggactctaacaacagcttggatctttcaacctttgttcacagtctcaattggaatcaagcctcgccgttttcgcatattcaaggggtcttgccggtcgaatccacgtcactggaagcacttgagtctcgccttgttgatttctcatgcatctcgtataatcgaatgacggtatgcattattttatctatgataagttacaatcactaacctcacttcgaaaagaccgaaaacaatcgatcaacttctgtctggagaggcatctcttcgccagatatctctgagaacatctcagatgtg

SEQ ID NO: 574710 - DNA, 1078 bp, Homo sapiens
ccgggtgcagcgggggggcccggaggccctggatggccctgggatggggaaccgcggtggcttccggcggaggtttggggcagtggcattcggggccggggtcgcgggcgtggacggtggccggtggcctgaggcctgtggagttcgcgtgaggaatggccggaggatagaggagtggatagcccgttgtagccaatgttgggccgctctgtgtcaggggactttgcaaggatcaagtccgctggagggagatctatctcttctccctggcccgattagggagtcagacgatcatggatttcttcctggggggcctctctacaaggatgaggtttagagagattatgccatgtgcataagcagagccggtgtccggccagggcaccaggttcaagggcattagtcgctatcggggactacagtggccacgtcgagtcatgggtgtaaagtgctccagggatggtggacaacggcatccagtggggccatcatcctggctaagctctccatggtccccgtgcgtcaagaggctacgtgggggaacagagatcggcaaagccctagaatggtcccttgcgaaggtgacaggccgctgcggtctgtgcgggaacagctcatcccttgacccaggggcaactggtatcgtctccgacctgtgctaagaagctgtcatgatggcgggatcatgactggtacacctcagccggggctgatggcaccctggggattggccaggcactttgatcgcattcaagactagggtactgacccgacttctggagagcacgttttacccaggttcctaaaagagcgtcactgaacactcttgagaccacacgaaattctggacgaacaaggccaaggggtacacacacggcggtattagaaaaaaggggatatggtgtaaaaaaaagggcggggaagaaaatagggggggaacgacaaccttaaaagtagcaaggagcaaaaaagaagcgacagatgaaatgatgagaatttatgaacacaatttaggttttatttgtttttttttttttttttctgatctatactgctgtataagaaaaaagaaggagag

SEQ ID NO: 574711 - DNA, 716 bp, Homo sapiens
ccagcctgggcaacagagcaagaccccatctgctgaaataaatgttttataaatagagatgaaatgttttggatttaaccccatattaataatcaagtattttacattattatctggcatagactgttatatatagcatattattgttgataatacaatacaatatgctatccgtatctgtatgtgatatagtgtccattttcagtaacctgctgtacatcacagcaactcagatgaaactcaaggaaattagttcagagcaaaaagcagccaatcttgaaaacatacatgtagcaggattccatttatgtaacatctggtcgaaactaatgtaattatagagatggaaaacagattaaaggttaaccaggggtttacggttacgggactggctcgacgtggggtaggtttcatatcgaagggtagtcctgtgtgtgttcgaaaaccatctgtcagcctgactcggtggtctacatcaggggctatacatgaagttaaaagttgtgtacgagtctaggtacacacaaggagtacagatgtaactggggaaactgagtatgttctgtagactgtaccaatgtcaatttctgcgtcctgatgctgtgctgtagtgtataaggtgtttacattggtggaggctggggtcaggtacccaggacctccctagacaacctctatgcacctctacgactctatatactgtcagataagctttc

SEQ ID NO: 574712 - DNA, 299 bp, Homo sapiens
ttagaggatcccgtctagctcgaagtggaggtgttgtgaggagtaggtcatctgcggagactgcgtgagtagggtatgggctaataggcattgtgagtatgagttgctgtagaggtgatgagaagtctggctgagaggtgcggagtaggagatatgtagaatcagtggcgtgttagcttgtttcctgaactggatggtcccacctgagcgtgatgggaggaagtgacagatcaataggtattagactctcatagaacgcaccctgttgtgaaccgtgcatgtgagggatctaggttgcg

SEQ ID NO: 574713 - DNA, 129 bp, Homo sapiens
  misc_feature (129)..(129): n is a, c, g, or t
gctacccactccacctactaccagacaaccttagccaaaccatttacccatatctagtataggcgatagacattgatacctggcgcattagatatagtaccgcaagggtaagatgataaattataaccn

SEQ ID NO: 574714 - DNA, 233 bp, Homo sapiens
tgttgctggggtgctctagaggatccttcatgtcagggctttcatccacccaatcatccgccagatccgccaggctgtgctcagccttttgaggccttcgaggagtgtcttcgccagaacgaggcagctgtgggcaactgtgcagagcttttgcgccgtttcctgcagtgcgctgagcaggtgcagccgccacgctcaactgcaactgtggaggcacaggccacttcctgggg

SEQ ID NO: 574715 - DNA, 113 bp, Homo sapiens
cacagcatccccagcctgggaactgtggagttcttgtttgcctgtcaccatctgtaatgcctgagtcacagatgctctggatcagtggtgatcctactagatgtctgaacctg

SEQ ID NO: 574716 - DNA, 268 bp, Homo sapiens
gatgtctgaggtgatgcagccgctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagtggcctcctgtgagggttgtggagaggtgagtgcccgcccagtgt

SEQ ID NO: 574717 - DNA, 872 bp, Homo sapiens
ccagcccatggcccctaacaggggcctctcagccctcctaatgaccgtccggcctagccatgtgatgtcacttgcactccataacgctcctcatactacggctctactaagcaacacactaaccatataccaatgatggcgcgatgtaacgacgagaaagcgcatacccaaggcatgcacagcaccacctgtcgcaaaagaggcgcttcgatgacgggataatcctatttattgacctcagaagttttcttcttcgctaggattttttctggagcctcataaccacttccagcctagtcccgtaccccctacaataaggagggcgactggacccacaataggaatccacccacgctaaatccgccgtagaagtccccacatctatagaacacatcccagtaagttacgttcggcacatcgagggacgttactccaagtgcccactgacgcgtcccacgcagtagttctagatgagacaaaacaaaacgggtggaccacacgtcaatttccagggcgaagccatcactataacataggctaacgtggggccctacttaatctaagccgctgccctaaaagagcgtcctccaggagtaaaattacggaaatggtcacacgtcacacacatttgctgaccgggcaatactgacagagcaatcgagaccgttgagaggtcagccaaccagggactatgccacgagaactactgcgtcacatggatgggctcaactttgtccatcagaatctggtgtccataacgacacatgtaaattgttcaggttgtacattccaagaccattcaatataggggcaattcccaaggcgccgccctgaacacggggatatggtgacatccgggtgcacatatgcgg

SEQ ID NO: 574718 - DNA, 625 bp, Homo sapiens
acaccgcttcgttgtttatcaaccacgtcgtagagccactcttggttgaccccaaagggggtgcaccatgcctctgcagcgaaagtaatttttgcgggctcatgtattatatcaagatcgaattgtgttctcgcaatgatagaggtgctcgggacattgcataacaaattggctaaggaaaggccaaagctgtcagaaacgataaggcgggttttaatcaagcattgacaaggtgtgatttactcttctactctcggggaaacgcgtgcaaatgtactaacagttgcaagaatgcgggctaatcgcaggacttaagaatgttttgcctcacgttttaatacgttgggtaaaatatatccactgccagggtacccattgcatataatgttggttaaaagctttattgtggtgtaaaaaatgcgaaaggtcggttgaactttagaaattgtcttatggaacaacattatgtccctagattgggcgttcatcttgaccgccacgtatgtttgtggcagaagatgtatcttggcggttcttaagaacagaaacatctttggtgatgtgtgcggaacccttccccttttacactccgaaattcaaccttttttctgtccaaaaaagacag

SEQ ID NO: 574719 - DNA, 105 bp, Homo sapiens
cctcgaggatttactctaccacggactactacagttttttcccagccgctctgctctcagaacctaatacaacactcttcggaggaacgaccataacgtgtgcta

SEQ ID NO: 574720 - DNA, 757 bp, Homo sapiens
gccctggtgtgattccgtcctgcgcggatgtactctggagtcagcgtagcttttatctccggccgactgtctctcctactctaagtgcgtgccgcacccgatggaagattcgatgggcatggatatgagacccctgagggccctagaactatcttgttacgggggtgaacttaaatggccgatcaatagattagtcatctgtgaaggtggataagtgatgaccaagtgatgcaccgagatgtatctttaagaacggctacagaacaggggctggttgtaaagggatgagttgcacatggttgagaggagaggcaatgaattacgattggctgtggcatattaaagtagactaccttggcaactttgataaattgtctggtagcggccacacctgtgatatgacccgttggagggcatttgagagtaacagccgaccagtggtcttaaggggttcgaagtgtggttcatgggccatgtgcatatggaagtgagacaagcatctgtagtagcttgtggcaggaaggatgctaggagtcaggatatgatgagaggaggaggggaggagtgttgaggactcttaaagtatatctggaaagccggtcttgccccctggagggggagtagccaaggtttccactgaagaaaagtgaaggttgcgctgggtgaagatgatgacgattgatgcatgaagagggcttgtgttggaagatgattggatgatgatgaatttgatgagaagggaaggtgagaaaagggc

SEQ ID NO: 574721 - DNA, 141 bp, Homo sapiens
gtgtatgggtgacagagcacaaagactgaagatcaaggaagagagtgaggcattttctggaagcacttaaagaagaaactgagtttcattcctactttatattcacatgggtgacaggattttggcttcttgagagaagca

SEQ ID NO: 574722 - DNA, 801 bp, Homo sapiens
agcggggggtgcggcgccgcgccgaagatgcaggccaatcagagcccgggggcggggcctgggcagtcacgccctcccctcgtgtggcttcatttgagagttcatatccaagcaaattccagttccagcagcagcaggcagcagggagcaaggcagagcaggggcagcaggggcaagagcagagcagggcagagcacgcgaggccggaacaggagcgcctcagagtctctgaaagcacgcgaagagataaccgattaggaactttttccgggcaactgtcacccggcatagctgtcagagaatcatcatcaccgcaactctgacgtttcctacaagaagttagagacttaacgcagtattggcatcggatggacaactggtatgcatgctgctgtggaaaaatatccctgagctgaagaagtgcaactatgtgttgtgtgtgctaaatgcccagaagaaaccagagccagtgggtaagagagacgaaatgtggagagaatgactaaagacaaatccgtgaataagtactctggagttgctaatttggacagccgaagcaaacattttacaaggaggaaacattatgctgcttctgatttaatacgcaaagatggtggtacagatgcatggcttactatgtgtcggaacaacatgcattcctatactggacagcatagtgggcaaaggggcagaggtgagagaattaagcggtaggtctcaacataagtgatgagatataaatgatgcctgacagtgcatgaacagtactattggcaatttgagcatcatacctaaatggaa

SEQ ID NO: 574723 - DNA, 160 bp, Homo sapiens
  misc_feature (21)..(21): n is a, c, g, or t
  misc_feature (136)..(136): n is a, c, g, or t
  misc_feature (160)..(160): n is a, c, g, or t
caccctgtatttatggggtanatgtgatatttggtacgtgcattaaagttcattgctttttctccttgggaggttgaggtgggaggattgcttgagcccaggagtgttgaggttgcagtgagctgtgattgtgccnacactttccagcttaggtgacagn

SEQ ID NO: 574724 - DNA, 456 bp, Homo sapiens
  misc_feature (1)..(1): n is a, c, g, or t
  misc_feature (26)..(26): n is a, c, g, or t
naatacaaaaattagcctgagtatgnatgcatatgccaagactcttagctactctggaggctgaggtggggggatcacttgagttcaagagttcaaagttatggtgagctctgatgtgccaccacactccagcctgggtgacagagcgagaccctgtctctttaaaaaatttttttggctgtgcacggtggctcacacctgtaatcccagcactttgggaggccgaggtgggtggatcatgaggtcaggagatggagaccatcctggctaacacgatgaaaccccatctctactaaaaaatacaaaaaattagccagacatggtggtatgcgcccgtagtcctagctacttgggaggctggggcaggagaatggcatgaacctgggaggcggagcttgcagtgagccaagatttgccactgcactccagcctgggtgacagagtggactctgtctc

SEQ ID NO: 574725 - DNA, 204 bp, Homo sapiens
aactctacatgtatccccgttgggccacgcaccgtggggcttggtgttaaataggcggacggtgtagacaaaggggacattgtggtgtatactggatgcgcattatgtagcacagggtaggtggtatatcatggggtatgtggtgcctggtgtacgacaggaggacggtgcatcacataacgaggcgacacttgtcggtgttca

SEQ ID NO: 574726 - DNA, 106 bp, Homo sapiens
taagtccacgagtgcttctcagccatcgtggagggtgacagctttgaggagatttaccacaatggtgaaagcgtgtcatatgagtgtactatctgagagcacgtac

SEQ ID NO: 574727 - DNA, 163 bp, Homo sapiens
  misc_feature (159)..(159): n is a, c, g, or t
tttggggcttccataaaggaatgatgtccagaatctgctagcaagcatccaggtggcactatagtggaatcaaacacaagctaaaatttattttccattcctggcatagatgtatttgtaaaacctggattaaatccaagtggaaattcaacactcagncaga

SEQ ID NO: 574728 - DNA, 574 bp, Homo sapiens
ggtgtaggcacgagggccggtctcaaaataggatcctctttctctatccctaggtgaagtttggtattggatgtgctggcgccgttatcttttgaaatggaatgtgctttgtactcaatgggcctgctaggtatgtggactcatgatttgtagtgctgggaagtgttctttattagctctttgaaaaggtcctgtattcatttctcttcatacttgcttgggaactgctatatgagatgctgatccttccagattcttccactaacccattaaatgtcccaaccattacactctttcgtactgccttcctcctacttcaacctcccaagtaactaagactagaggggtatgctactgaacctacctaatatataaagttgggtagagataatgcgtgtgcggtgctgcttaggctgatctcaaagtcctggcctcaagcagtcgtcctgcctggccctcccgaagtgctgagatgacgggaaggagccactatccctagtcctcctaatacgtcgggtccactgatatcttctgaagcgtttagatctgatgtgttcttcttcacccttgtact

SEQ ID NO: 574729 - DNA, 167 bp, Homo sapiens
agcgactcactgaattactttgcaaaggcttgaagagccagagcgaccttcctggcatcctgggcggagcataaagttgcagactagatccagctcatcaataatatgctggacagagtcaatgagattattattggttgtggacatggcgcgatagggagatcctc

SEQ ID NO: 574730 - DNA, 1288 bp, Homo sapiens
tggaagcaagtttcccatggttctccagccggggcagcaaagtgagaccccgactcttaataaaaaaaaaaaaagaaacccaaagaaagtgtgttgagttcccgggaaatccccgagggaacagttgggccggggtctccaagaagattgagtgctgaagtaagggtagagggtggctatccagaaagagctacttgtcggattgggtatcccatattagtcgatcagggcccttaaaaattagcccaatacttttttttatgagggtccatagtatacctccaatttggtatgaggagtgggttccctaaaagaagaaataatttgcggccattattccaggggacttttcttttcacaagagaaatatcacattagagcgcggccatttctattttttgatagtatcccaacaagcttttattaaatgtgcgtctcataaacccccagagaagactcacaccagagcgcataggggcttactacacaaggggagacaaaggagaggcgccaatacgcggggagacataacactctccaatattgggcgctcctaaaacccccctgggacaggcgagataacccccggcggtaactcattcagacggggtacaacggagcgatcatgaggcataaactcctcgtggacctattgagggaccaagaggtttactcttttttgaaaggcgaattatcgaggtgttactacgttctagagaacgccagggggatggggtaacatgagttgcctatctccccgccaaaaaaatttaaaccccccttgtggagggaaacattcgagggggggggaattgtttattgacgaacgttacaataaggtggcttcgtgttaacaacgaatttattgattaaggaagcatgtggggagtacccattagaacccaatggggcaacagaaacggttttagaaccaacgtccttctgtgtggcacccttgtgtgtcacaccaacaccaaaaaaattgtgtgaaataccagtgggggcccaatgctttttttgtgaaccctgctaaaaatccgccttgccactttgtattactgcgcgttgcgcagttcatcaatagttaaaagaggaggacgcccgtagcaacatatgtgtggtactatgttgggtcataacagcaagtgtgtggtttctgtccgagcgagaaaaacagataacgtgtcctagtccagaatgatgtcgatgagaagatagggcggtcaggcctcctggtgtaaagtatagaaaggtgcagttattccagtgtggcttctgacaagaagta

SEQ ID NO: 574731 - DNA, 1048 bp, Homo sapiens
cacgcgtcggtatatcttagtagagatggggcttcaccatgttggccaggctggtctcgaactcctgatgtcaagtgatccatctgcctcaacctcccatagtgctcagattgcaaggtgtgatccaccacgcccagtgcccaactgatatggatagtggtgcaaaagcaattcagtggaggaaggatcgcctttccagaaatggtgttggaacaatgaacagccataagccccaagaaacgaaccttgatctaaacctgataccttatacaacaattaatgcagaatgaatcatagacttaacatgtaaaggattaaactatgtaacttttaggacataacggaacaagaaggcgaatcgggggtggggtgcgatacacaaagaattctcagactcaatacccaagaacagaattcataagcaggagaagattgattaattggtccccttaagagtaaagtttgctttgataaaaggcccatgataaaaatcttgtgaccaacgacagagttacgctacacattatgactataagacagaaatagcaggtgagaatcacgaaggggtcacacgccgatggggcaagtctctgtatcgtgactatcatactgagcagttatgcaagatccacgacatgcgatgaatttaggcaataaagctaacaaatcagacacacaaaacaagatacaagcacaaagtgtagggctcattaaaacgggtggaaatctgactagagccctgggctcaaggataacgtgcacactcgtgtaacccacagtaaccgaaccaaactagtaaacgccagaacaggaaacacaaagcagggggggcacccgaggcacaaggactagaaatcacgccaagtggagacatatgcacagacagcacaaacaaacaacacatactaaaaacatgaaccgcgaagacacagaaaaacaaagcggagacaaggcaacgcacgaacagaaaatagaagagaaaaacgaaaagagaacgccgcaacaaaaatacacaacaagacacaacgagcaaaaggatcaaccgcac

SEQ ID NO: 574732 - DNA, 974 bp, Homo sapiens
gatgaactctccctgtcggtatcttcgaggcgaaaactgtcacaagtgtccggaccccttgcatgtcctgtcaataaaggaccgaagatgttcttgagagttaccttggctgcccggacctcccgacttcaacgtggtgaccacatgttgatgttccactatgcccagcagctaacatactactacatagacggaaacacgtgactgagcactttaattgtcagtacagagtcatcaaagcacagagaccctgtggattaaccagctatctagcgttgcgagctcggtgcatagatatgttcgccaccttgaaatatcccatggtcgatgtctggtagtgactattcactcacagtagatatctgtaccataagaggcgaggccgcctagaaggtatatcgctcgctcgtacactaggaagaccaaaatcacaactatggcttgacctgcttcactgctctggagacctttcattaaccaggatccatcgacatgccttccgggagatccctcggagtttcctctgtcgtgttactcgaccaccaagggtcttgaccaccgacgttctcatcatcggacggacatcttcatgctctaaatcctacccttaaaccaatttggccgctcgatgtgataccacaggattttctccctcatgactggcgtaatgctcgggacctagttgtcgcaatccactccatgtcgaagcgacatcataaggagaagcgtgctagcattcagattggcgctcttgaaatgctaggttagccagtcctggcgcgtcagcggcccccattgcatgcggggcactcccgatgccgggacaccaatctcttccagttagacccgacctccttgtgaacgtgtgctactgcctggactcatggatcgctttcgtccccttgatgaatcccgggccaggatatcagatcaaaagtacctaactggttctagatagttgtctacgcgggaag

SEQ ID NO: 574733 - DNA, 223 bp, Homo sapiens
ggaaaccgtaattacgcaatgctttgtctgtatctatagagctgaacatgtggcttttctttagcactgatgatatgatgaattatttggctgaactttgaatgttaaaccagtcttagagtcccacaataaaacccgcttaattatgagatgtcatatttttctattttcatttaaatttgctgatgttaaggaatttctacgtttatgttcatgaagtatc

SEQ ID NO: 574734 - DNA, 117 bp, Homo sapiens
aggtatggaggtccaggctaggggtcgaatcacgagctgcagctgcagcctacaccacagccacagcacaccagatccgagctgagcacgccttgtgacctacaccacaggttacct

SEQ ID NO: 574735 - DNA, 129 bp, Homo sapiens
acacccatagcgtccgggccccgctttccttttcaaggggcgggttgtagatcgcagcgcgcaccctgtagagcccgctggtttgtgtacaggccctggacactgtggatagcagaacactctgtctcg

SEQ ID NO: 574736 - DNA, 454 bp, Homo sapiens
tgaacttgggaggcggacgttgcagggagccgatatcatgccactgcactccagcctgtgcgacagcgagactccatctcataaaaaaataatactcaatgtctactgtttgacaagtgtctcagaccttaatgtatcctagattaagaaactttatcctatggtctcatgaaaaattcgccggtaaggatgtaagaagtcctcaatcctatactaaaagcaatgtcttttggatggtgctaatgtccatttggtagtggtgacaagtatgaggagagagtggctggaattacaggcgtgagtcactgcacctggccgaacttttctttataaatgaatatcttcttaattaagtaagtgctgcaaactgtgtctcacatggctgttgtggggctttaaagagtacaccttctaaaatggcctaatgggatgcttgtactcattaaataatgga

SEQ ID NO: 574737 - DNA, 421 bp, Homo sapiens
ccgtgcgcatgttgttctccttctcgctcacacgtgcttgagggcctcgtgctggtgcgagacttctccctgggggttcttccagcctagagcacaactccctccttcacttccttcagtctctgcttgcctggtcacttgtccaggaggccttcttcggccactattgacactaggccccggacatcctctaatcctatcccctgccttattaccttagatatagtgttcgtatgtatgtatcagctatcttacagactagaatataagctacataacattagggacttctctttgatttaccactgcaatccctagggcccagaacaagcctgcgccacattatgttgaatacctatttgtagagcaattcaagtagactcaggtgacattacagatcacacatggtgtcctaatacac

SEQ ID NO: 574738 - DNA, 148 bp, Homo sapiens
tttaccatatcattactggtggtcttcaaggctcggactggctttgctcttcgacacatttgcttgtgacatgaccaattctatgttcttaacttataaatctgtttcatcgatcccttactcttcactctcctcttggtgggagctt

SEQ ID NO: 574739 - DNA, 141 bp, Homo sapiens
tagaatctctcctctgaataagtctttgaatatttatagcacagcagtctaagaaaattgagggaaaactcttcttgaaataaccaggtcgatatctattgttttgtatatatatgtagatatctgtgtactaacatataa

SEQ ID NO: 574740 - DNA, 165 bp, Homo sapiens
ccacatctcatggctcaagtagcgtgggaatacaggcgcatacaccacacctggctaaatgtttgtagtctctattaatttaagacgacaggatcctgttgcctaggctggaagcttgtgtagtctgacaatgataaagatgatagttaattatttagcacatga

SEQ ID NO: 574741 - DNA, 305 bp, Homo sapiens
agactgtcgacaggttgagcatgaggagaaaatcagcaatagatcgcttagagaatgccagcagctctgcaagtctggggacgtgatggagacgtggttccggggttttgtggtcgtggctctaagtgtgatcacgatgcacgaagcacttacacgagtggcctggctttctttactcagacccctgggtgtagatttccacgcccctccattgtttcgtcccttgtgctggtccctgcgtagagtggatgctggtctgatgtactctgtaggatggaggccgcgtacgaaggacgcgtcgcccc

SEQ ID NO: 574742 - DNA, 710 bp, Homo sapiens
ggtcgagcaccccatcgtcatcggtgtgtggtgagagcggcgaggcgggaagagcacacaggtgcctcaggtttctctatgaagcaggcattcgagcaggtgagagagcagcatcatcgggtgtcacggagcccgcgccagcagtggccgcacgtgggccatgtccctagcgatgtggtcgaaggtaggatgagatcttgtccctagcgcggtccgtcgtccctacgcgagcatccgggcttattgacacgcgagataccgttgtaccaagaggcacggacccagcaagtctaacgttacattcgaacggcctcggctcgttgctttgcgtctagaaggacagagttccgacagaacggcgactatcgcaatgcgtgcatagggtgcggtagcgagaccgcgactcgcgatctgagatccagcttcgcgacccgcacagagccgccaacggaacggaactgggcatgcgcgctccggtaacgcaccctggggaaccagttcccatacaactttcagaggcccattatcgctggtataccccccagaccaccctttcgggtcggacccgcttccttcctcggagcaggccttcaaagtaaggggacaaccgcctcggcgccaacctttccaaaacggtccttcggccttccaacttccactcggttccgagccgccaaccgctccttgcccgcggggctcggcaccgcgac

SEQ ID NO: 574743 - DNA, 468 bp, Homo sapiens
aagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttggtctggtcctgtttcttcagaagcatgtcatctttgctctgccttctgccctttgaagcatgtgatctttgtgacctactccctgttcatacacccttccccttttaaaatccctaataaaaacttgctggttttgtggctcaggggggcatcatggacacccccacacgtgatgtcacccccggtggaacagatgtaaa

SEQ ID NO: 574744 - DNA, 160 bp, Homo sapiens
ctacggcactctggcatacctggaccttctggcatacctggaccttctggcatacctggaccttctggcatacctggagcttctggcatacctggagcttctggcatacctggagcttctggcataccgtggagcttctggcatgcgtggagcttctggt

SEQ ID NO: 574745 - DNA, 1031 bp, Homo sapiens
  misc_feature (521)..(521): n is a, c, g, or t
agtcccctatgaccgttgctggctggcggaattgtccacgaggcaatgcctctgacggctatccatgacagtggcacaggttctgcctgtgacctgccgccataagctttactggtaattcagggtatagtacgactgagatgcgtgttcgttattgttccacttatctgtcttgtcagctgggcgacttctctgtgattggtatttgttaagttgccgggtgaagttttggacctctggagtgtgcaggcaagtttattatgcaactaaagcgcttccatttcaggtctcataaaagctccttgctcgtgactctgtggtttaacactgtgctgggctgtggagctcctgagagtatgctgaaccccgtaccgcagtcccgctgcatcgctcccgtacgtctcccttgcctgaggcgtcgccatagcctttccctaatagatagttttatcagggacactccatggggtggctatgtctctggcccagacagggtcgttcacgttctaacgtgcagtgcntgagactggttactagcgtaaagcttgatcaaggttgacccacgttcaccttgatcatgagtgtcatttgatataaaccacatcattccttggtcgcatccgggggacgatattctttcctgtttcccagaagagagacaattacagtcctaaaataaacttaagaatggatcacgggggagccgtttgtgcatttgttaccggtgagggcaaggtcactccattacaggaccgagagtcgtggccggttctacataatactaaccttatcggggagaaccgttccatggggacactaggaccgcgcgcattttcaaccccgaaggttggagagtgaaaccctcccagataggtgtctttaagaatttacccggcaggataaattaacccagcgagagatgccaacatctcttgcgtattttatgggagcccacaatttggcgtgacggtgcagggtcacgacaatgggagcacccacgtcaatcccagtcgatcttaaagccacaaaga

SEQ ID NO: 574746 - DNA, 166 bp, Homo sapiens
tgtgaacagcacagagaggccatccagaagaagctgacaggtatcaagcatgaattgcgatgcaaagctgctacagagtagtgtcaaaggaccgctgaagcctggacagagaattctgccggtgcactgtcgtcatctcgcctggagtgcgaaactctttgtggga

SEQ ID NO: 574747 - DNA, 290 bp, Homo sapiens
agtgccaagaatgacaagatattaaaaaaaaaaaaggaaagaaaaaaaaaaaaacaccttacttttaaaggaaaatcaccttaacaggattttataattataggtaatctctaccacgtttcttttctagtttctggattttcaggctcagggcgggcattctaactcatacgggtggaagacaaggggtggtgtttgggattccaggaatattattatggaaatccggggtataagtccttaaattgggtgaaaaatataaaggaaatattcccttaaacctttaaaaa

SEQ ID NO: 574748 - DNA, 88 bp, Homo sapiens
gacagcagcttctacatctgcagtgccatccatccaggacagggaagggacattcagtacttcggcgccgggacccggctctcagtgc

SEQ ID NO: 574749 - DNA, 122 bp, Homo sapiens
tacacaaatgttagaactgcggtcactctcgtactgagcaggattacatggcacaacaatacatcagtagggtaaaactaacctgtctcacgacggtctaaacccagctcaggaggaggagg

SEQ ID NO: 574750 - DNA, 1114 bp, Homo sapiens
  misc_feature (319)..(319): n is a, c, g, or t
gatcttatggaaaacttgtttggagaggctggtatttaagttagatctgatggggctactcatgtccgtgtagccgggttcatcctcataataagaatgggcaggatctcttgttctctcgctgagtgtgctttctatctctcgctgagacgtctttctgctctccgttatccgtgttctcgttagtccttatcccctccagtcgtctgccgtaatttgtagtgtttaataacaaccgaatggtctagtaaatgactctcctctgagctgtagataagataaaatggtagtaatgaatggcagatccagggtattacgncgcaaaataaaacgaaattgtgagtgaagttcattttaacataaataacattatatagaagataaattgttgaaataaaaaggaacaaaaaatataagaacatataagaaaaaggagaaatgaaagaatatacatatacacctaagatggtacagaaaaaagaagatagaaaaaaaccaggtacaaaattgagagaccaagatagaacaatactataagactcatatagataccatcatgcaaagcgttctggacgtgaatcagagattccgtcctactttaacaaaccagaggttgtgaacatgttcgtccagttgttcaaagctggaagaaagtgagcagagtatggagtgcaggagcctgtgaagggcaaggacacaattacagcagcctaatggagccatgccatggtggacatgacaagactaacaaagtaactggaaaccctgaggacagtgaggataacatagaacaagaaactggatgggcaatggacaacgtgaagaggatagcagatcaaataaactacacgacaatatcactaacacaaggccaacacgccaaacaaggaatagggagaaaacaggactaatgctaaccacaaacagaaccggccatagcagaaaaggtcggacttaggaaccaaacgggcgacaggaatatggaggcaacatatgaacacacgaacggtacgaacaggacacacacagaaaaaagtgacagagagcgcagcgaaaagcacaaacccaaaaataacgagacacccagacaagaacagcacaaacaagggtgtga

SEQ ID NO: 574751 - DNA, 823 bp, Homo sapiens
  misc_feature (551)..(551): n is a, c, g, or t
gcagcccgagtcctcgaaatgcagaacgagcgccgtgcgagttcgtggacctgtacgtgcctgggaaatgctccggtagacaactcggatcatcggtgccaaggaccagcgcactcatccagagtgaactggtagcccaggaaggttgacaaggtacacagggccagagttctaaaattggcgcgaggtttcaacaacgtttattgcgtatcataggcgggggccgatatccggtagggatgggggttggaagtccagcattgatttcccatttctaccggaatttgtgccccaagtggtccggaagtgtggctaagtggttcttcaaaaggagaacctttattgagctaggaagaacgaaattcagcaatgaactggttggggaaaatagtttgggtccagtaagaaagtatatcactaaagcttgagatagagcgcttagatgaacatagaaaaaagaataaagaggaaacaaagaaaacaaaagaacagagaagacacacagtaccactcacacagaaacacaccaccaaaacaaaccaaaatagacncagcacaccaacagcacccggagagcgaagagaaagcaaattacatatgaaatgcagaggggtaagggtagggtcggaggcgaaactctaaaatatattcataaaggaggagaagaggaagaagatatgtacgtagtagcggaagaaaaggatgctacatacagataggagggatactaatatatgggaggggacaatgtcaagaaagtagagtaggagagaaatttaagacatataaagtgtaacacatggtggacagaaaaaagagagag

SEQ ID NO: 574752 - DNA, 208 bp, Homo sapiens
cacgcgtccggttaagttatttatggtttttgtgtatcaactttgattctgactctcttcccttctatcaacaagttaattctcaaattgcaagggtttttttctgtagtattgaacgttacatttattaagggtgggagattggttatgaggggatatttctaaaacccagtggaaaccacatttttgaataatcctccccccaaaa

SEQ ID NO: 574753 - DNA, 326 bp, Homo sapiens
attggtgcacactccagccgaggggaagatcttgtggcgcgaattaagcactcgttgtaattaagccgtgtaattgagaacaggccattagcaggagcaggtagcggcccctggagaaagtctgccagatctcgttctgcgcggccttcacagccggtcggttcctcgcaatgaccattgccagggcgaagaggaacatgagcaggccgttgtccacattcccgaacatcacagcaaacaggaaggggaaggtgatgatggtgtagggagcggggttgactcctggtagcggaccacgccgtaggcatccacgattccctggaagc

SEQ ID NO: 574754 - DNA, 301 bp, Homo sapiens
gacacaactctctgcttctatcttctgaacaagattgtagaaaataggtatattaccttccttaaatgtttggaacaattcatcagtgaacccatgtgggctttgtgctttcatgctttggaaggaacactatgtttaggtgttctctaatgtttcctgagatctgtgagtttatctcctcgactttaatattggggaaattctcagatcatagaatgcttcgaatacatgcttcatgctccttttgcatttctcctacttctaggtactcccaatacatcgtatatgacgacccagcaag

SEQ ID NO: 574755 - DNA, 535 bp, Homo sapiens
  misc_feature (196)..(196): n is a, c, g, or t
  misc_feature (209)..(209): n is a, c, g, or t
  misc_feature (217)..(217): n is a, c, g, or t
  misc_feature (240)..(240): n is a, c, g, or t
  misc_feature (257)..(257): n is a, c, g, or t
  misc_feature (275)..(275): n is a, c, g, or t
  misc_feature (280)..(280): n is a, c, g, or t
  misc_feature (284)..(284): n is a, c, g, or t
  misc_feature (308)..(308): n is a, c, g, or t
  misc_feature (339)..(339): n is a, c, g, or t
  misc_feature (343)..(343): n is a, c, g, or t
  misc_feature (347)..(347): n is a, c, g, or t
  misc_feature (354)..(355): n is a, c, g, or t
  misc_feature (364)..(365): n is a, c, g, or t
  misc_feature (375)..(377): n is a, c, g, or t
  misc_feature (423)..(424): n is a, c, g, or t
  misc_feature (426)..(426): n is a, c, g, or t
  misc_feature (432)..(432): n is a, c, g, or t
  misc_feature (448)..(448): n is a, c, g, or t
  misc_feature (528)..(528): n is a, c, g, or t
  misc_feature (530)..(530): n is a, c, g, or t
  misc_feature (535)..(535): n is a, c, g, or t
gtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggangagccgcagacanggcccacngaccacagggcccagcagggcgngcagaggcagggggtgncctacagcgtgcaggccnacacnggcnagccggccccacgggggctccacncggagaacagggaggatgagggggggcaggnggancgcnggggcgnnagggaggcnnaccatggacnnncaacagtggttatgcctctcagaggacggggaggacaagtagaggnngnttgacngccgggaggcgggggncgcggacttcaggaggcgagtggaccgggagcgggagtgcgggggcctgcagctagggctagttatgcatgaagagtatnancgggn

SEQ ID NO: 574756 - DNA, 173 bp, Homo sapiens
cggctttatactagtacagttagaaagcaaagtgttaaatggagaagatacttgtatttattaaacatatttagagattaagataaaactacattattaactgaatagtctaaatgtgattatcttttatccccccaaagttaagtcattcaaatacttattgggtttgacat

SEQ ID NO: 574757 - DNA, 206 bp, Homo sapiens
cgtcaacatttgactgcatgacacctggcatggtgtggctcagggagtgttcaagaatgttttttcctttgcctgtcatgataacatagtctttctagtgttgtcctatgcaacaatgcaaaggaatctgatgcattggccatcaatctctgagccttagttttctcatctattaagttcctgttgtctcaacagatggaagtcag

SEQ ID NO: 574758 - DNA, 504 bp, Homo sapiens
cagtcctattctatgcggccagccggcatggcccaggtgaagctgcagcagtaaggaactgaagtggtaaagcctggggcttcagtgaagttgtcctgcaaggcttctggctacatcttcacaagttatgatatagactgggtgaggcagacgcctgaacagggacttgagtggattggatggatttttcctggagaggggagtactgaatacaatgagaagttcaagggcagggccacactgagtgtagacaagtcctccagcacagcctaatatggagctcactaaggctgacatctgaggactctgctgtctatttctgtgctagaggggactactataggcgctactttgacttgtggggccaagggaccccggtcaccgggctcctcatgtggagcgcggttccaggcggaggttggctcctggcggtgggggatctgaccttgagctcacccaggttccagcaatcattgtctgcgtctccaggggcgagggtcccca

SEQ ID NO: 574759 - DNA, 256 bp, Homo sapiens
  misc_feature (69)..(69): n is a, c, g, or t
  misc_feature (120)..(120): n is a, c, g, or t
  misc_feature (174)..(174): n is a, c, g, or t
  misc_feature (213)..(214): n is a, c, g, or t
ctccagtttcagcttcccgagtatctgggattacaggcaagagccactgtccctgaccattttagccanttttaagtgtgtagttcagtggcattaagaacattcacattgtagtaccgnctaggcatggtgcctcacgaccataaacctggtactttgggaggccgtggtggnaggattgcttgagctcaggagttcaaaaccagcttgggnnacttagtgagaccttgtctctattaaaaataaataaataagt

SEQ ID NO: 574760 - DNA, 80 bp, Homo sapiens
gactggcggctcgtgatcacagttgcgtcattgtgtattaaatacttggaataaatcaagcaggtctcaacgcctccact

SEQ ID NO: 574761 - DNA, 102 bp, Homo sapiens
  misc_feature (23)..(23): n is a, c, g, or t
  misc_feature (81)..(81): n is a, c, g, or t
cagatatccccagagtccttcanatgctatcattccctttgtatattggaccatactgcatagataccgatgaaatctagntgcgagggctaccggaggctc

SEQ ID NO: 574762 - DNA, 1052 bp, Homo sapiens
cgcgggcgaatcaacgagatgccggcgctcaatctatgtgtgcgctgatagcgttcgcgccagcgaatcgtatcatcacaacacatcatgctcccaccagacggctgctccacatacactgatggtcctctgttctgtgcttcttaaacatctgggcagctgcaactcggcgaaatctacccgggcgcttggtaatctgactcggcccatatcattcgtccatgcggaatacaacggccaacagcccgagcgcttcccgacgttggcaactgcgcctccggccggcgggtgaatcaaacattgggcggctttttaccttttggtgcaatcaatgcccaattcccggggagggaagtcgccaaccagtcggcgcttcgggcggtatggaatctcctgcggctggtgtaactgcccttggtcaacgcacaagcctacttgtatctgtctcttactgtttgctgtccttggcacgtatccactgcttctatacatgggtatggcctacggtatggtgccggcgcgtatacgtgaagtcaccgtggggcgcgcacggtccagggatatgatctatcaatggtgccagatatgactgagtaatgatcactccaatgcccagtccatggggcatacagacagaagccctttgaggtgcagctggatggaaagcagcatccctgtgcctatgttggatcgttctggtcagctgggagagtgcagcatgccagacggatcaacgcagtcacatcacctagaaacagtatgtgctcatgtgatgggggcctcagcactaggacaggatgtggactgattggcagcatcgcatgcagacttgaataaatcctgaaagtcactacgctgcgtaatgagaagccctaatataatagcgcatgcgtgtgtagcagagggtgtcgagaatgcctcctacgtgacggaaagcagatccgtggttaccggcagactggcaggagcagattccaaaggcacaggaagaaggacatgcaggtagaatgtgttcatacattctgcataacccaccacagaggctggatacc

SEQ ID NO: 574763 - DNA, 101 bp, Homo sapiens
gaggtcttgtgtatgtgcactgccccatcaacatcattatccaggagaactggtctgctgttgaaatctgaaatttcttgggtgaaaaatacatctgccgg

SEQ ID NO: 574764 - DNA, 190 bp, Homo sapiens
ttgccaggtctctacctttggcaggctctctcctccgtggaaaccagtacggtgagcctcaccacccaggctttagccagactcacagtcagtctcctacttcagtgggcacagacgggataatgagctccggggatgggaaaagcaggccacttgggggtttccaggaggagagagcgtggcagggata

SEQ ID NO: 574765 - DNA, 208 bp, Homo sapiens
gggtcaggagaccagccttggccaacatggcgaaactctgtctctactaaaaatacaaaaattagctggggatggtgatgtgtgcctgtaatcccagctgctcaggaggcttaggcagaagaatcgccttaagttgggaggcaaaggttccagttacctgagattgtcccactccactcagcctggccacaaaataagactccgtctc

SEQ ID NO: 574766 - DNA, 349 bp, Homo sapiens
tttttccttttttggccccggtttcccctttttttaaaggggggggtttacccaacccatttggaatttccccccttttgggggggggccggccccccggtaggggccggtttttttaaagggggcgggaaaaagggttggggttttttgccatattagccaaatttttttttccaaaaggcccccggggggggggggggccaaaaaattttttagggggtttaaacccaatggggacccttttttccgggggcttttttttacccgggggaacgggcccccatttgggggcccgggtttacccctccctttcccccctggaaaaaccctttttttttttaaaacccca

SEQ ID NO: 574767 - DNA, 211 bp, Homo sapiens
  misc_feature (69)..(69): n is a, c, g, or t
  misc_feature (90)..(90): n is a, c, g, or t
  misc_feature (93)..(93): n is a, c, g, or t
  misc_feature (114)..(114): n is a, c, g, or t
  misc_feature (120)..(120): n is a, c, g, or t
  misc_feature (162)..(162): n is a, c, g, or t
  misc_feature (178)..(178): n is a, c, g, or t
agtcttacaaccactggagtcgattccatagggggtaatattggacttggaatcggtttaccttgtctnagaggtagcagcagcaacagngcncaccttctgggcagcttcttncttggnatgatgagcctgtagaactgctacagcttcatccaccttggngcggagagactcgggngactctaacatgtgcagcagctcagagttgtct

SEQ ID NO: 574768 - DNA, 403 bp, Homo sapiens
  misc_feature (3)..(3): n is a, c, g, or t
  misc_feature (8)..(8): n is a, c, g, or t
  misc_feature (14)..(14): n is a, c, g, or t
  misc_feature (16)..(16): n is a, c, g, or t
  misc_feature (29)..(29): n is a, c, g, or t
  misc_feature (31)..(31): n is a, c, g, or t
  misc_feature (51)..(51): n is a, c, g, or t
  misc_feature (58)..(59): n is a, c, g, or t
  misc_feature (64)..(64): n is a, c, g, or t
  misc_feature (68)..(68): n is a, c, g, or t
  misc_feature (74)..(74): n is a, c, g, or t
  misc_feature (78)..(78): n is a, c, g, or t
  misc_feature (84)..(84): n is a, c, g, or t
  misc_feature (87)..(87): n is a, c, g, or t
  misc_feature (89)..(89): n is a, c, g, or t
  misc_feature (91)..(92): n is a, c, g, or t
  misc_feature (97)..(97): n is a, c, g, or t
  misc_feature (100)..(101): n is a, c, g, or t
  misc_feature (103)..(106): n is a, c, g, or t
  misc_feature (108)..(108): n is a, c, g, or t
  misc_feature (111)..(111): n is a, c, g, or t
  misc_feature (116)..(116): n is a, c, g, or t
  misc_feature (118)..(119): n is a, c, g, or t
  misc_feature (145)..(145): n is a, c, g, or t
  misc_feature (177)..(177): n is a, c, g, or t
  misc_feature (183)..(183): n is a, c, g, or t
  misc_feature (241)..(241): n is a, c, g, or t
  misc_feature (334)..(334): n is a, c, g, or t
  misc_feature (383)..(383): n is a, c, g, or t
ccnctccncgcacnanaccgttctcgccngnttggaatagcgctcccgctncttttcnnatgtnattncaccancggntgtccntcncngnnttccnatnncnnnncnccnccctncnnccatccctcgccccccccccctcccnccccccctcccccccctccccccccccccccncccccnccccccccccgcccccccccctctcccccccccccccccccccccccccccccccccnccccccccccccccccccccccccccaccccccccccccccccctccccccccctccccccccccccgccccccgccccccccccccccgggncccccccccccccccccccccccccgccccccccccccccccccccccnccccccccgccccccccccc

SEQ ID NO: 574769 - DNA, 704 bp, Homo sapiens
attccgggggcgcaccaatcaccttgggcagcgactagcccccccacccaggggtgtccccggggaggcccaccgacaccggagacagagggtggcggcggccacacgggccacgcccgggcgttttaaagccccctcgggagagagagagcctccaacaggggtgtggccccgcgcgaatatacaccccaaaggagaagggtggcgcccggagccacaaaatctcggcgaactatttctctcggtggagatctcgacgggaaggcccggggaaacaacagtcccaccgcgaggtgcccctcgcacgagccacaacgtggcacgcgggctgagaaggaggtaaccgcctgccacaaactcactcctcctgttcccccacaggagaagccctccggccccccaaggaaagggagagaccacagtttctgcttgagagagactgagaactgggccaacccacgctgagccggagccggtcactgcccggtccgggacgtctataagaaaggaggaaagctcgaggtcatcacctcgaggagagagaagaatttcacaagccttcgctaagttctccgtatggcccgtgccacaacgcccggcttcttcggcatacgggccaaaagagccacaggaagccgcagaacaggatgttgaaaagaaaaaattaagccctcctggggacttgggatcagtcggccagtcca

SEQ ID NO: 574770 - DNA, 239 bp, Homo sapiens
atttttttacaagatacctgactgggatgagagacttgaggctttattctctaccaatacttaggtttatgaatattctgaataaaagctcaggatagaattaaacttttgattatcaaacatgtttttattactttgaaaattcaagcaaaaccctaaaatttttgtttgtttattttcttttagtttcagtaatggtctgtactgaattttagatagtcctctttaatagtaacttt

SEQ ID NO: 574771 - DNA, 424 bp, Homo sapiens
gctgtctctgactgccagagccctgatggaggagcccatgttcttacaagggtctgcacctgctgtggtttgaatgtgttccccgtatttcatgtgttggagactgaatgcccaacttagcagtattgaaagatggggcctttaagaggtgattggatcctaaggcctctgccctcatgaattgattaatccacgtgtggactaatagattaatgggttattatgagagcaggactggtggctttataagaggaagagagacctgagctagcacacccagcccccttgtcacatgatgccatgtgccgcctcaggtctctgtagagtccccaccttcaagaaggctgtgcccccaccagatgtgccccctcgaccttgtattcctccataacagtaagaaataaactccttttctttataaatt

SEQ ID NO: 574772 - DNA, 359 bp, Homo sapiens
  misc_feature (23)..(23): n is a, c, g, or t
  misc_feature (64)..(64): n is a, c, g, or t
gagcttcacagccaggatttgancttgtccagtatgactctatatcctaatgctttaaccactntgtgtaataggttaaaagtgggggaatcaggccagcccgcagtggctcatgcttgtaatcccaggctaagcaggtggattgcctgagctcaggggttcgagaccagcctgggcgaaaccctttctctaccaaagatataaaacaattggccaggcatggtggcacactcctgtagtcccagctactggagaggctgaggtgggagaatcgcttgggccttggaggcagaggttgcagtgagccaagatcgtgccactgaactccaacctggatgacagagtgagaccctgtctca

SEQ ID NO: 574773 - DNA, 357 bp, Homo sapiens
  misc_feature (47)..(47): n is a, c, g, or t
ccccaagccgtcggggccggggaagccggcgggctcccaagactccnagaaccgcgggcccatcttgtactcatcccaccccagccggcttgggactcagacaccgaagtctttttttttttcctctccgatccttggacacctcctctgtctgcccatttattagcccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttccctttaaaaaaaa

SEQ ID NO: 574774 - DNA, 1712 bp, Homo sapiens
ggtactctacgttgaatccagtcgcgcagaccggcgccctctgatgccgtgcccgtgcaataaccaggcactcgtctccgtgtgaccagtgaacttatgcttacttgaccgagccactcgatgctcctgactcgaattatcctaactacgtggaccccagagcatggaggacacggacatcgtagctcgtcgtgcatagtcgcatccaaccggactcagtggagcgagctcataggcctagatggtgcaactctcatggagccttggccaggaagtagaggttgcgcagcattgcgcgtaggactagttttggcctacaagactgggcctagtcaaggttgcacaagtattgggacaacacagcaccgaaaagaaacctggcaagtggcaagcatagcccggggacggccatattcattaactcaggcgcagagacgtagtactatgagctagtaaggtatgtcattggtaaccagaaagccgggtccgctagaaagaaccccacacggtaggcccaaataatgcatgttgcgctgggtatcatgtagcacttacttatccgcacatgtgcagagcaccactacacgttaaacccacaagagtacaagaggcacgtgtccatggccaatagcgaggcctggatcatctctgttaggacaactcgaccaccagatagagacttaacactaccccaccacaactcccccattcaagtgcagttccaggtgggtgggattcacggcacttgggtgaaggcctctaaattcccaatcaggtaggacatagactaggaaccccttcatagcgaggagacagtccgcggaatttggaagaagaaacaaccaccccccacaatattgtaggaactacacggaccggagcacgcaccaacacagtagcactttgggaagccacgggacatggagacaccttaaacacatcccaaacgaacgcaccagatccacaggggcgcatgcatatggtcgggcaagcacaacttgggtgataggccgcatatgggttaccaccataggacttgtgcggcgggccccaatatggatcatggcggaccacacaccgatgaataggcgatcagaagggaaacaagcggcaggaaaccccggagcggacaacgtccagttgtgggacagcccagtatccagcattggagcatcccgaaaaaaaggactgtcgccagtcggggaacaccggggcatcggagtccgcgccccatgttggacaaccacggaaagtatccggagcagcgcgataaggacatcaacaacaaaaggcagcgacacccacttcaaatatccaaacggggcagcaccaccgagtccagggcacaaccacgaggagagtcaccaacgcgagtgcgagctaacgacacaacacaagacggctaggcgcaccgccaccaacaaaactgggtaatacggcgccttgagggacggagtccgcatcacgaggagaggaattaaaaccatagtgcaccctggaaaggtagaaacagatatacagcatatgcgcgctcccaaaaggtagtcgcacaggccaacaaactactagaagcgcgcccgaccctgttattgtcgcagaggggcgacccccaaaaaagaactatcagcagactacggatcgcaaccaccccgccacacatctcggaccgatgcgagaagaatcaaccacacgctgacaacgccgcgtatggg

SEQ ID NO: 574775 - DNA, 177 bp, Homo sapiens
tgttgaaaatacataggatcaaaccaactcaagcggtataatattatacatggatgtacattattgtaagggtaccagtaaccattattattaaggaataaccgttagatgattgagttcgctccttattgtgataattgtgggggaaggggtagatcacctatctggcaatgtgtc

SEQ ID NO: 574776 - DNA, 881 bp, Homo sapiens
tatattaaaatgtgcatcaatcttttattttattttattttatttttttttatggatcattctggggtgttctcgcagagggggatttggcagggtcataggacaacagcggagggaaggtcagcaggcaaacaagtgaacaaaggtctctggttttcctaggccgagtgttggtgtccctaggtacttgagatgggggagtggtgatgactctcaacgagcatgctgccttcaagcatctgttaccaaagcacatcttgcaccgcccttaatccatttaaccctgagtggacacagcacatgttctcagagagcacagggtgggggtaaggtcatagatcaacaggatcccaaggaagaagaatatttccttagtacagaacacaatctgaaaagttctcccatgtctactactttctacaacagaccacagaaccatccaatctctcaatcttttccccacctggcacccctttttattcacaacaaaaccgcatggtcataatggccgttctcaatgagctgtgggtacttcctaccccaaaggggtgttggttgggcaagaggggtcctccattccccagtaggggcgcacgggaagagggggcccttcacttcgtggaggggcgtttgtccgaggggggtttagcccaaaaatacccccagagcgggaaagacaggagggggatacaccccacaccatccgaagggagatacgacaaaggacaacatcacagaggtggaccgaaagacccaacataaatgaacgacgggaaaagctacccgagtgaacagatcgaaccgtgaaagatagaaaaaaggaacggttaagaaacccacagacacctcaaatacagggagcgaccagcagacgaaagagg

SEQ ID NO: 574777 - DNA, 251 bp, Homo sapiens
acgccataatcctgtacacctgcttgtcattcaactcacaagtctagcacggggagtagctacaaatctaagtatacacagatgtgtcttaggcttggttgtaacaatctagaagcaatctgtttacaaaagtgacaacaaagcattttaaagaaaccaatttaatgccaccaaacataagcctgctatacctaggggacaaaaaatctcacacctaaattctagcagagtatacgattccaactagaatg

SEQ ID NO: 574778 - DNA, 891 bp, Homo sapiens
ggacagcgcgcggggcgagccagtcgagagggcgcgagcggcggcgctgcctgcagcctgagcctccggcggccggcgaccagtgcgcgtgcgcggggcggcctccggagcgaccgggcagcggactggccggcgtgtaggactaagcgagccaggcggtgtgagggcgcagagggagaagcgccgagcccgagaaggcagaacatgggggggaaccggggcaccaggcttggtttgacaagcggggccgccggttttggcccgaaacagggcgggagccgctacggaagaaacttgtgggccctcccggttatttggaaggggcgggggtgacacaagacctgcttgatgtgaacccctttcttcttcccaatttgaaggactcggaaagatttctcctcttctggtggggccctacaacagcaatttgtgctttgagggcgccccgagggcggaatccttccccgtggagaggggtccattaaggcaaggcatttggagcaagaaacacctcagtgggtttgattgggagaccaccgaaaaaagagcaccttggggacgaaggggtaaaacgggctacccggcggacgaaggcattggacaacggcgacggctggaacaaccatgtttggggcaagtgatttgttcccgtgttgctcgttgctttggaacgaaggttccccgtgaatcagagaatcgtgtgcaagtgatttccccagttatgagcagccagggttgttttcccttgaaaaagtgagcgggtgattactacgggctactttaacaagaaggtcggctctgggggcagcacgcacacaccggctgtgggtccgaagcttctgaaagcttcctaaaaggaccctttggactcagcaagagcggttgcacccg

SEQ ID NO: 574779 - DNA, 159 bp, Homo sapiens
cactcccccatctctcttccgtatgctcctccctctatcaccttctgccaagattgtaatgtttcctgaggccttctcagccatggtgtacagcctgtggaaggtatgccaattaaacctctattctttataaattacccagtctcaggtaattctttt

SEQ ID NO: 574780 - DNA, 202 bp, Homo sapiens
atcccgaagtgttctcaagaggcggtggtggctgccgcttctgtagatctgccaccaaacacatcaaggatactttctcagggaaaaggatacacatatgtgtttgcaggagcagctagctggttggtttgcaggcatcctgaatggtagacagcaagcttagctgtccaaggttttctaatcttcatgtttcttttagtgg

SEQ ID NO: 574781 - DNA, 595 bp, Homo sapiens
ggcgagtccttccttaagactggtcctgataactacccgatggcagaggactgaatttggaatagccacctttccaattattccagaagtcgtgggtcctatcttgaaacagcaatgaattctgctgggttaaaatgaagggatttcagaccaggcgcggtggctcacgcctgtaatcccagcactttgggaggccaaggcgggcagatcacttgaggtcaggagttcaagatcagcctggccaacatggtgaaacctcatctctactaaaaatacaaaaattagctaggcatgttggtgtgtacctgtaatcccagctactagggaggctaagacaggagaatcgcttgaacccagcaggcgaaggttgcagtgagggtcgcctgaggtcagaagttcgagaccagcctggcgaacatggcgaaaccccgtctctactaaaaatacaaaaatagccgggaaaggtggctcacgcctattatcccagcactttgggaggctgaagtgggcagatcacctgaggtccagggttagagaccaggctgggcagcatggtgaaacctgtctctctggaagtccaaaattaccgatttgt

SEQ ID NO: 574782 - DNA, 696 bp, Homo sapiens
  misc_feature (1)..(1): n is a, c, g, or t
  misc_feature (92)..(92): n is a, c, g, or t
  misc_feature (106)..(106): n is a, c, g, or t
  misc_feature (111)..(111): n is a, c, g, or t
  misc_feature (115)..(115): n is a, c, g, or t
  misc_feature (119)..(119): n is a, c, g, or t
  misc_feature (128)..(129): n is a, c, g, or t
  misc_feature (133)..(134): n is a, c, g, or t
  misc_feature (136)..(136): n is a, c, g, or t
  misc_feature (165)..(165): n is a, c, g, or t
  misc_feature (170)..(171): n is a, c, g, or t
  misc_feature (174)..(174): n is a, c, g, or t
  misc_feature (177)..(177): n is a, c, g, or t
  misc_feature (179)..(181): n is a, c, g, or t
  misc_feature (187)..(187): n is a, c, g, or t
  misc_feature (343)..(343): n is a, c, g, or t
  misc_feature (681)..(681): n is a, c, g, or t
ngtatctccgccatgctatagttctaataaaaatttaccgcgaaagaaaattatataaaagaaagagaagaaatagcacacgcaggaaagcnacgggaatgcacanagcantcanctcngcaattccnnttcnnanagctgtcttatcctgtagtcatccttccnggtgnnctnttntnnnctgccnttgatgttcctggaaaactggaaacctaaaagtcttggttattcaaccagaatgttaaataaacaacacatccatatgatggaatattacttaaccattacaaagtatgatcgttatgtaccaattgcaataagcccttagactgaaaagtcagtnagtcagcccaggaggtatacagcactaccctctgtagcagcaagcgtgcatagccacaggctctctctggaacgacacaggagaaagtggtggcattctggcctgcaggctcacgctctccccttaggggatgttatctgtggccacatccagtctgcctgccagaacatgctcttcccgagggtctacggagcctggtgccagtagtcttagttcagtctccaagtgaatgattcgcaatagtctgtagcttacaaattgccatccctctgactgcgggcagggccagaatcagggggtttggcgacgaccacagactgtctgtccatctgggagangggctagatgtgcgc

SEQ ID NO: 574783 - DNA, 289 bp, Homo sapiens
gactctgcgcggctacaaatgtcaatattgaatgaagcattaaaagacaaacataaagtaacttcagcttttatctagccatgccgaatgaatactaaaattagtggccaaaaaaccaaccaccaaccaccaaccaaacaaaccaaccaaccaaaaatcccacccatctttatgggtaaactttcctgctcaaggatggaagctgactctagaccatcttgcgggtcctgcggatagcacaacacaagaacatactggagataatgcccaatatcatgaccaccgcaat

SEQ ID NO: 574784 - DNA, 485 bp, Homo sapiens
gcacacacacacacacgccagtgagcaggggagctttcgggccacactcccagacgcctccctgagccctggaacccggactcgttgctcctgtgccttccataccccctggcagatcatccctgctggtcccacgcactcagatcccacttcacatctcgtcgcgcatccctattgctagcctccactcgctcgcacccatgcggtacacgaagatgtgtgacagacagtgtatgggcgagacgagggggctttaaaggccgcttgggccagggggcttcggggatcaggggcaagctgtagcagaagggtgagctgatgcttgcttgcgaactcggcgttcttggaagggctcggaacagggatgagtgaccagaagccgctctgtgacaaatgtagacaagactgatatagggatgatggagataaaggtgcgtagtattgatgggtagagaaggactgagaagacaggcaagaagaatact

SEQ ID NO: 574785 - DNA, 1480 bp, Homo sapiens
  misc_feature (1007)..(1007): n is a, c, g, or t
cacaataggtgtgatctggaaccggccaccgggagctttcgtaggagagaacgagaagagattgagcaaggtcagcaagtgcgaaggatgagcggttacatgaaaagtgcacttggtgccgggaagacagaacaagtccaaggagctgacctggcccgtgggtggcgcatcaatccggaaacagaccgaggtagtgaggcattgaccgtgaaggaatggaagatgcataacgagaattcttaagacagattgccacaattggtcagtgaaaatcgatagtagctggacgacttctttccctagagattacaggtagagcttgacgagtcccgtcggtgacgagcagatgacccgtgtggtacccatgagagcccgttgcattgtctagagacacttcttgtcatagtggtactacgaacataaccacatagtggcacactaggacgtcgcgtttaacagaacgagttccctggtaccttgagcacaatgagagtcacctctcgcaatgggtcgcgttgtcggtggcactttcgcatccgtctcgacttcatgtaggtgcatcgaggaagacattacggtatctagtgggagcatttggaaagagggggtgggagaccttccgagaggcaagcattggagacgctaccagcttgggcataacttcgtgttttgcagcaatcatcggaacactgcattcgccacgatgacccaggacatattgtccaggtagttagtgcaactcgctttattggagaatttgtgggaaaagccgctagtagatagtaagaaacaatgtctcaagcaagccgctgtatagtctccgcgaagcgggacgtccagaccattggtaggaacgactcttgcgacgggttcaccattaaaccagacatgggttatctaacacttttcttggttctttggacgttttgcacttaacgaaggttaatgaccagatctagcacaatacacgaagcggaaagattaggggaactaagaatcgcactagnacatgaactgtggcagtgcgatgtaggttagaacacagcaagttgtgcaagcacaagcaccaaatccagtaagtcccacaagagagaagctatagtgaggtatagcggacgctagggaggaacgcacatccacgtgtcaatacagaggaacgttgggtgcgtataatgataaataatcgcaggaacgagctgtggtgtaacagccacacgatatttgagttccacctccaaagaaggtcatcagtgatgagatatagttgtcaccactttgagagataatagagccatgatcgcaaggatagctgtgaaccatttcagagtgagtacgatcaaacgtacgtaatgtaatcgatgtaccctgttacgtgcggtgcactgacgaaacagacgtgagtgatgaggaggatagccgaatgcaaacgaaattagtcatgagaactaaaagcactaggagttagatatgcttaagaaaa

SEQ ID NO: 574786 - DNA, 275 bp, Homo sapiens
ggtcgacctgagttcttggctcagttagttcagtagagatctagttatttaaaagactgggggcctggtgcggtggctcacacctgtaatcccagcactttgggaggccaaggtgggcgggtcacctcaggttgggagttcaagaccagcccgaccaacatggagaaacgccatctctactaagaatacgaaatcagctgggcattgtggtgcatgcgtatattcccagctactcaggaggctgaggcaggagaattgcttgaacctgggaggtt

SEQ ID NO: 574787 - DNA, 351 bp, Homo sapiens
cagtcatcctctgcagcataattacacctggtggatgcgtgaggctaaggaacatatacggaactactactttcataacgctccgcagctgaggggaaggataggactggacagacaattagttcagctgaactgaaagtaggatagccttcacttcctcttctggtgactcaggcacagtgggcaacacagttttgctcggcaggtaggaaaaggccatcaacatatcgtcctctatagtgatggaacagcgcagtttaatttttgacatcctgttggctgatatttcccaataacaaggaaatttcactgcgttttttatcactctccatgtgccgaaacctgcacacc

SEQ ID NO: 574788 - DNA, 1148 bp, Homo sapiens
  misc_feature (463)..(463): n is a, c, g, or t
cattgaagaagacaatatatttttctttattcagtaatattttatattcgagtaatgtggggagaacactagaattatatattggattcagtttttgtttatatttttttttcctattggttacccaagaactgttatttaaaaaaaatgcaagctaattttcagtctttcaaccaaaaacttttttattttgttgggcttctaagatcttaaattccactctaatggtctatgggatggtcacgaggacttaaatctgggggagaaagccctgggcattgtgtgggagagcaatggggagtatatgggaaggcagaaatctcatggtctggatcaacaaggagttaatttcagagtttctggatataaaccctattgggtatgggtttataaacacctattaagaatgttggtgcgaagaataactctcgaggaaattgggaacttttcgggctattttccnaaagggcaagggggttaatttggggggaaacatttagagagaattcaatctgcgctacaagtacattggagaaacaatatgaggttgtaaataacccaaacttggagggtgtgtactgggttctggggtccccggggcctaatttccgcttgtgtatcccctcttatttccctccattctgggggacagacatgggggggagattaatacccgcgagatttgggacaggcccggtttcaaacccaaaatgggtggtgacgttaaagtgtaacgcctgggggggtaggtattggcgaagatgattcgtgggtttgacagataagggggttcacgaagtatgagatcacagtgttgataataggggaagtagaatttggggatgtgggcagaaacacattgtgggaaatattaatgtttcaaaaagattttgggacttacgctattgtggctgcgtccaaggaagatatttacgaaacgaagagagaaagaggttttgggggacaatggtgggtaacagggagaagggggaaccttttaagagtgttctcctcaaaaggggagaaacaatgagtttcgtccggagaggacactttcctgttgaaagaacaaagtgatatgtgataaacttagacagcgagagactttcacaggggacgtgactaataaatgtaccaaatagagtggg

SEQ ID NO: 574789 - DNA, 1028 bp, Homo sapiens
  misc_feature (36)..(36): n is a, c, g, or t
  misc_feature (98)..(98): n is a, c, g, or t
aactggagcacgtgggtcagcatgcattagcaaggnagatagaagaaaatcgcttccagtgtgacatctgcaagaagacctttaaaaatgcttgtagngtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagttaggcaaaagtatttgatttgactttatagttttccacagcacaatga

SEQ ID NO: 574790 - DNA, 335 bp, Homo sapiens
ctatggtcatagctgactcttgagtataaacagagccccggtcaagaacgaagtaattgtcatatctagtgccttacttgaaacatatctcttctacccaacctgtgagctttggggaaggaaatgagtctttttttgtttggttatttttctgagacagtgtctcgttctgttccccaggctgcagggcagtggtgtgatctcggctcactgcaacaggtagcctcctgagcagctgggattacaggcgcccaccgcctcacccggctaactttttgtatttttagtggagccggggtttcaccatgttggccaggctggtctggaactcctga

SEQ ID NO: 574791 - DNA, 409 bp, Homo sapiens
  misc_feature (33)..(33): n is a, c, g, or t
  misc_feature (36)..(36): n is a, c, g, or t
  misc_feature (49)..(49): n is a, c, g, or t
  misc_feature (366)..(366): n is a, c, g, or t
  misc_feature (398)..(398): n is a, c, g, or t
tataaagtggccaggtgcagtggctaatgcctntgntgcatgcctgtgntcacagcactttgggaggccgaggtgggaggatcacttgagcccaggagtttgaaaccagctagggcaacatagtgagaacctgtctctacaaaaggtaaaagactggcctggcatgttggcacatgcgtgtagtcccagctactcgggaggctgaggtgggagaactgcttgaacccgggagattgggctgcagtaaactgtgcttgggccactgcactccagcttgtgtgacagagcaagaccttgtctcaaaaataaaagcaaaaaccagggtacaaatttgcagttagttcaggaggattaagttttttgagntctattggcacagcattgtggacttgttagtnaaatgaaaaat

SEQ ID NO: 574792 - DNA, 1299 bp, Homo sapiens
  misc_feature (381)..(381): n is a, c, g, or t
cgaggggcaggaattgaaggacatagagtcgcctgcgactatcctattaacggtttccaggcgcctgagtgctgacagccctgttgtgtggggctggggatgtcagcggggctgcctctgggggcgcatcccggcagaatgctctctgactcattgcgcggttatgtctgcctagcccgtcaccggcttttcaagtcattctagaccgtcttgtatcgtacttgagcaattcgaagggctgctatggttagacccacaaggttttctgggcccttaggtcaatcgcttggaggggggagagacgtcagggtcgaagtccggaatttactgacatttattgttacgtggggcacgagagctcgacacctcgtcgtgtagtcntgttgttctgttctgtacgtatctaatatattttcctgatgacacgtgacgaatgcgcggtgccttcactcaggcttgggtcctccatcaaccatggacccatgtaggatggaatggagagctaggaagcttcagagggacatgatccgctcacttggtgcatgggttggcttgggatcgcatatggggcttcacaaggattggcgtgcattacgtccgtgggtttgatggcccatcctggggctgcagcatgggagcgccgggtcctttccgaaacgtatacgtattgggattatcatacgtactattgactgcgtggtatttggcctatgcgtttcgcctagggcccggtttcgtggggcaccggtggggccctgtgggtgccacctttacacccattaccgagtcgcgtgtccacgtgccacccatggttactcttgcttggaggacccaaccgctgtccacggaggcccttgtggtgtttggcgcgcatggtggccctactggtttcgatcctggacactactagtgcacactagggcttcactggtggtttacctaaccagtctttgcccggtggaggggccgaaacctttccaccataggaagagaacaaccaacctttttcgcgggaaacacgcaaattcccgttttcttggagcgccccaaaggaaagatgggcctggggagcctttggaaggaaccccaagtccgtccgtaacaggggcccaacaagggggcgggaagcaacgttgtgctggcgtggagtctggcgggtagggaagagggggtaatgggggtcgccagctcgattgccaccaaaggtaattccttgggggaagaagcctcccatcagatggggcactggcgccttgggtcccttgggcccatggcggggaggtgttaccaccctggctg

SEQ ID NO: 574793 - DNA, 719 bp, Homo sapiens
  misc_feature (157)..(157): n is a, c, g, or t
tactttattaaaatactggagttttatttcacatggtatattttgggtgccccccacctatttccagtgtctggacccccggctactactaatgtcctatcataacatcccataacataacttaaaaccaagccaagagggggggagtcccatcttnaaacaaacaaaagcgggcattgtggggacacacactattcgtgagggcaatagacaaccggggacaaccattatatacaaaccagccgtggtaggggaagagtatctacacgtcgtggctataactaaaagaggcacagcccagaatatacaagcgggttacagaatatgaaatacagacgggagaaatttatttacacaaatgggtgtataaactatttttctttaaaagagactatcctccattggcgcagagactctggcaaaagcctcttgggtacagtcatccgggaagcaattcttcacataatggatgaattgggcttccacttggggaagagaaccacctttaatctatactggctggcatataggcttaaaggtctacaacagaactaggtccttagggggggtaaggagctaacccggaactggaaaggatccaggcccttggaccatggggtagagaacggtaagagtctaaaccattctgaattgactttggagacataagggcgggagaaccgaaaagaattccacacggggcctacatagatcccaaa

SEQ ID NO: 574794 - DNA, 950 bp, Homo sapiens
  misc_feature (244)..(244): n is a, c, g, or t
ggaccgtaagacgggcatgaggagtcgagacaagcctgggcaactggtgaaaccctgtctctacaaaaaatacgaagtgctgggattacaggcgtgagccaccacacccggccctaacttttgtttttaaccattaattatactaatgcgaatttggcagaaccatagaatttagtcttggatgggtgacgggccatcatggtcactagccagccttccacccaacatggagataagctctccngaagcatccttcgcagatggtcatccgccctttctattgtgaacctaattggagtcactgtgagttctctgtcatgttagactgaaatcttgtatctgctgctgcccattgccccatgtgtaccttcaggagcaagacagaaaagtgatccaagggccctttatctgaaatctgtggtcttatcttcctataatctctgctgctgctaaaaacaggtatcatcatgcacttctcaggtgacgtgctgtccataccttacagttcccttagctgagacaataacccatggggtttatagtacagactttcctcggaaatgttacgctgattgaaagaagccagtcgcggccgggcgcggtggctcacgcctgtaatcccagcactttgggaggccaagtcgggtggatcacgaggtcaggggatcgataccacggtgaaaccccgtctctactaaaaatacaaagaaaattggccgggcgcggtggcgggcgcctgtggtcccagcaactcgggaggctgaggcaggagaatggcgtgaacccgggaggcggagcttgcagtgagccgagatcgcgccactgcactccagcctgggcgacagagcaagactccgtctttaaaaaaaacaacaacaaaaaaacgccggaaaaaatattcgcggttttccctggggaaaccccaaaggggaatttcgcaaaatggggcc

SEQ ID NO: 574795 - DNA, 696 bp, Homo sapiens
aatacatgaacgtgtaagatcttggaggaagacagcagagagagagagagagagcagagatcccaggggttaagagttggcagaaatttcacaggtacatcagtccaataagaggagtccatgactggagcgcagaggtaaacgttggagaggacaggaagatgtcaccccaagcgcagtagctaaaagaaggtccccccgcgaggagagtgccatgccccaaaagcaatgaaggtgaaggtctcacaaaggtcccacagcacagaacccggcttggtgctgacactaggcctaggacgacggtgtgccagcggggggctgagtaaagaatgtgatggagaggaagaagccgggcctggtcaatccattccggaggcatgttgtgcaggctgaggctgggggcatgcacaccgtgtgtctaagcaagaagtggcaggtctataccttcggctgcacatgatgagggtgccctgggtaagggacacatcagtggagggctcgagagatggtccctgggaagacgtggagctcgcaacgagaaggtggtacaggctgtcagccggagacaagtcgaaaaacagccctcacagatgatggccgtgtcttctctggggcaccttccgggacaaaaacggtgggatcggactggtgggccaatgaagaagacctggtgctgggcaggtgagctgaagtgcg

SEQ ID NO: 574796 - DNA, 161 bp, Homo sapiens
tacacgttagtaacactcatctctacaaaaaaacacaaaaattagccaggtgcggtggcgcacacctgtggcccagctactcgggaggcgtgggggagcatggcttcagccctggtgggcagaggctgagcgagcctgttgccggtgcgggtacctaagtt

SEQ ID NO: 574797 - DNA, 223 bp, Homo sapiens
tccatcgagcgtcaccactgtccttccgagtcaacgagcgtcaccactatccttccgagccatcgagcgtcaccactgtccttccgagccatcgagcgtcaccagtgtccaaccgagccatcgagcgtcaccagtgtaccttccgagccatcgagcgtcaccactgtccattccgagccatcgagcgtcaccaggtggtccttccgagccatcgagcgtcacc

SEQ ID NO: 574798 - DNA, 355 bp, Homo sapiens
cgcagggggagagcgcgcgccgcgcgcgcgcgaagcgaagaggcgcgcgggccagcgaggagcgcggagagcgccgccaccgagccgccgctgtgctcactgagccggcttcaggggcaccggcatggcgagccgcggtgggaagaagaagtccaccaagacgttcaggtctggcaaagcaggagtcatcttttccgtggggcggatgctgcggtacataaaggggcaccccaagtacaggattggagtgggggcacccgtgtacatgggcgccgtgctggaatacctgacagcggagaatctggagctggctggcaatgcaccgagagacaacacggggaccggtcacccccgg

SEQ ID NO: 574799 - DNA, 270 bp, Homo sapiens
acgtggggagaacctgcagaatagttaacttagaagtatgtctcaaattaatcatcgggtcatgatcccttaatgaaggatctcgttcagaagcacagcaacttttgtctgtcttctgaacgtaggtacagctgtggctgtagaacagaccatgtaattttcatctagattccttacaaccacaaggactattattacaatgaaagccagagaactagctcagttttgattttattactaggataaatccagccaggtagtgtggtggct

SEQ ID NO: 574800 - DNA, 158 bp, Homo sapiens
ggggctaccggtatcgatatcagtgagctgaacatggggtggtgtccactggggcgctcaggttgtgggtgtgacctgagtgaacttcaggtcagttgggtgcaggaatagtggttacggcagtctggaaccagaaggctgactctctcgcgcttgga

SEQ ID NO: 574801 - DNA, 194 bp, Homo sapiens
  misc_feature (49)..(49): n is a, c, g, or t
  misc_feature (125)..(125): n is a, c, g, or t
tggtctagcatgcatcttgtagaaacaaggcatgctggcagatgcaggnttgagatgtgtttatctgtttatattttaaaagattctgcagaaaataaaaccagaccttgttctaaagcccaggnttatggaccaactcagtgcttcaggtcttaatgtctccatacctcttcctcaccaactttacgagtagc

SEQ ID NO: 574802 - DNA, 202 bp, Homo sapiens
ttttggtggtttcctctttattgtgtgcctcctaccttcccccacaatttcagtcccttccaacaccccaaaaagaaggagtgaaaggaagggattgctggggttctgagcccttggcagtcagaaggacagaaccaaacatcactggatgtgacacagctgcatcaagaagtctacagcagtatgggaagcggcagagaag

SEQ ID NO: 574803 - DNA, 124 bp, Homo sapiens
ctattcatcggcaccccgctattcatcggcacttcgctattcatcggcaccccgctattcatcggcacttcgctagtcatcggcacctataattcacaagccaccaggtgccgatgaatagcga

SEQ ID NO: 574804 - DNA, 103 bp, Homo sapiens
acgtatatccatggctgtatctagagtatcctggtcatcctgctacactagccagatcagtaaaattttacaagggataaatgcaaaaccttacacttaagtt

SEQ ID NO: 574805 - DNA, 431 bp, Homo sapiens
  misc_feature (12)..(12): n is a, c, g, or t
  misc_feature (17)..(17): n is a, c, g, or t
  misc_feature (176)..(176): n is a, c, g, or t
gacactcggacngaccnttgatcatctgttgaatagatgactgtaagagtgctgtagacccttgcctaatgctgaggattaatcccttacacagctgtcctctgggtttggctattttcttctccaaagttaagttagaaaagttctgtgttagggccgggcgcggtagtcacgcntgtaatcccgcatttgggaggccgaggcgggtggatcacgaggtcaggagttcgagaccagcctggccaagatggtgaaaccccgtctctactaaaatacaaagaattagctgggcgtggtggcgggcgcctgtaatcccagctactcgggaagctgaggcaagagatcgcttgaacccaggaggtggaggttgcagtgagccaagatcgcgccactgcactccagcctgggcgacagagtgagattccatctcc

SEQ ID NO: 574806 - DNA, 83 bp, Homo sapiens
cgcaaatatcttttcttgtattcccatatttctagacaatgatttttgtaagacaataaatttattcattatagataaaaaaa

SEQ ID NO: 574807 - DNA, 299 bp, Homo sapiens
gtcgacgtggcgcgatctcggcccactgcaacctctgcctcctgggttcaagcgattctcctgcctcagcctcccgagcggctgggattacaggcgcgcaccaccacgccgggcttttcgtatttttagtagaaaagaggtttcaccatgttagccaggctggtctcgaactcccgacctcaggtgatccgcccaccttggcctctcaaagtgctgggattacaggtgtgaggcaccatgcctggacgatcatgaagtttaaaaattctaggtggagcatcttcgtcgacgcggccgcg

SEQ ID NO: 574808 - DNA, 322 bp, Homo sapiens
  misc_feature (134)..(134): n is a, c, g, or t
  misc_feature (152)..(152): n is a, c, g, or t
  misc_feature (162)..(162): n is a, c, g, or t
  misc_feature (168)..(169): n is a, c, g, or t
  misc_feature (173)..(173): n is a, c, g, or t
  misc_feature (186)..(186): n is a, c, g, or t
  misc_feature (197)..(197): n is a, c, g, or t
  misc_feature (201)..(201): n is a, c, g, or t
  misc_feature (215)..(215): n is a, c, g, or t
  misc_feature (236)..(236): n is a, c, g, or t
  misc_feature (271)..(271): n is a, c, g, or t
  misc_feature (286)..(286): n is a, c, g, or t
  misc_feature (294)..(294): n is a, c, g, or t
  misc_feature (296)..(296): n is a, c, g, or t
  misc_feature (298)..(298): n is a, c, g, or t
  misc_feature (311)..(311): n is a, c, g, or t
tgaaggggcctcccaagggtcatccccccccccccggttttccctgagagggatcacctccctggggtcaaccaagggaaatgtgcacgcaagggccccggcccccctggcagggggggggtttttataagggngggggccaaaacccttgngggggggccncccctnngccngtttgggggggcngcccttagggntttnagggtaagggcccngggggggggggccccccctgntcctttggggggggggccccccccccccccggggncccggggttgggacnccccccgntngncccggaaaagccnttttgcggcca

SEQ ID NO: 574809 - DNA, 736 bp, Homo sapiens
  misc_feature (45)..(45): n is a, c, g, or t
  misc_feature (63)..(63): n is a, c, g, or t
  misc_feature (108)..(108): n is a, c, g, or t
  misc_feature (121)..(121): n is a, c, g, or t
  misc_feature (123)..(123): n is a, c, g, or t
  misc_feature (137)..(137): n is a, c, g, or t
  misc_feature (142)..(142): n is a, c, g, or t
  misc_feature (146)..(146): n is a, c, g, or t
  misc_feature (149)..(149): n is a, c, g, or t
  misc_feature (157)..(157): n is a, c, g, or t
  misc_feature (179)..(179): n is a, c, g, or t
  misc_feature (185)..(185): n is a, c, g, or t
  misc_feature (187)..(187): n is a, c, g, or t
  misc_feature (197)..(197): n is a, c, g, or t
  misc_feature (208)..(208): n is a, c, g, or t
  misc_feature (210)..(211): n is a, c, g, or t
  misc_feature (224)..(224): n is a, c, g, or t
  misc_feature (249)..(249): n is a, c, g, or t
  misc_feature (266)..(266): n is a, c, g, or t
  misc_feature (284)..(284): n is a, c, g, or t
  misc_feature (287)..(287): n is a, c, g, or t
  misc_feature (290)..(290): n is a, c, g, or t
  misc_feature (296)..(296): n is a, c, g, or t
  misc_feature (302)..(303): n is a, c, g, or t
  misc_feature (323)..(323): n is a, c, g, or t
  misc_feature (342)..(342): n is a, c, g, or t
  misc_feature (354)..(354): n is a, c, g, or t
  misc_feature (358)..(358): n is a, c, g, or t
  misc_feature (373)..(373): n is a, c, g, or t
  misc_feature (377)..(377): n is a, c, g, or t
  misc_feature (440)..(440): n is a, c, g, or t
  misc_feature (458)..(458): n is a, c, g, or t
tcctgctgtcctgcgcccgcggcccgctgaggcccctcgtgttcnctgtcacgcctggcgtcncttcgcctcgggtgctaactttgagtacatcatcgcagaaaaaanagggaagaataanancgtggggttgatcnaactnaacngcnccaaggcnctcaatgcactttgcgatggcntgattnangagctcaacnaggccctgaanannttcgaggaggacncggccgtgggggccattgtcctcancggcggggtataaggcntttgcagctggagctganatnaangaaatntagaanntgagtttccaggactgttantccagaaagttcttgaagnactgggaccacntcanccaggtcaagaagcnagtnatcgctgctgtcaatggctatgcctttggcgggggctgtgagcttgccatgatgtgtgatatnatctatgcaggtgagaangcccagtttgcacagcaggagatcttaatagagaacaattacaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaa

SEQ ID NO: 574810 - DNA, 276 bp, Homo sapiens
ttcatagcatgagaatgtggctagaacattatttgaaatagagaatagagcatcttggtcaaccatacatctttcctttccctataagcctagcatgtcacaggtttaaaatgagtatcacaaaattaaaaatgaaaattcagaaagacatgaatccttgaagtcattttctaatgatacaagatagaattatccagagaaaagtcaggaaggatatcatgctttcctttacttgaatatttaaaagcaggtgctattgaaacttctaaaactagg

SEQ ID NO: 574811 - DNA, 355 bp, Homo sapiens
gaagcttaatagtggctaaaagaatcaaaaccttctattctctactcctgttgccactgtgaacgtatacaaaaagccttattaaacaacttagatttgttccttcaatccctcttcaagtttatatttggtgactaaatattctacccacactacttctttgatcaatttcttgctactgaagtgtgctcccgttagatgctgaatctcctttgcagcattgccttatttatattttgaggatttgacagtaagaactttaacacgagtcgcttggatgtgcatctatcacataatccagcaggaacttctgttcaacacatgttccattggacccaggctgttaagtctggga

SEQ ID NO: 574812 - DNA, 776 bp, Homo sapiens
tggtatctcaatccccgacaagtcttcgaactgagaccagggagggtccaaggaggcgctggagatgtacctggaaagatgcacaaactgcggatcctggcgtgcgggggcgacggacggtgggctggatcctctccaccctggagcagctacgccgtgaagcctgacaccccctgtttgccatccctgccccatgggtactggcaagcgacttggcccgaaccctcgaactggggtgggggctacactagatgagcctgtgtccaagatcctctcccacgtggaggagcgggaacgtggtacagctgggaccggctgggacctccacggctgagcccaaatccccgaggccagggccttgaggaccgatgactgacaggcgccagcggaccggatttgccgacctgggaatgtcttcaacagaataacttcaagatccttgggcatttgacggcccaccgttcaaccccttggggaggttcccaagagaatctcgaagagggaccaaacacatgaagaaacttcaaacagccggctattacgggaataaggatcgtatctacgccggttgaacaagcgtttacttcgtggactttcccttgactgggggaaggcttccaacgtggaaccctggccaagacacgcattccagaagtgagttgatcgctgacatggggcacatgggacactttggattccccccaaaggaattccgaggggacccgttgaacaacccacacagaggtcgctcacgaatccatcggaaacaatttccc

SEQ ID NO: 574813 - DNA, 340 bp, Homo sapiens
gcgtacatgtatgatatgagttggagaatataatatttgtgtatcaatacatgcatatgactgtattagtccattttcatgctgctgataaagacgtacccgagactgggcgggcaatttatgaaagaaaccagtttaatgaatttacaattctatgtgactggggaagcctcataatcatggtggaaggcaaggaggagcaagtcacatcttacgtagatggcaacaggcaaagaaaagagagcttgtgcggggaaactctcccctttttaaaaccatgagacttacttcactgtcacgagaacagcattggaaagacctgcccccatgattcagttaa

SEQ ID NO: 574814 - DNA, 1384 bp, Homo sapiens
gatcagcccctaaaggtactagccagtaccgtccaccaaaggagaatgcttgaggtgaagcgaagttctaaccctcctgactcgatctcagagctcagacacagagcagcagtcccctacgaagtggtagggggaaaagtagcatccagctcaaccatctgaggaaggaccaggacggcacaagcatgaaaataaagtagatgggatgcaatgcccctaaaaggccaaactggcgaactctagcccgtggtccagcgcgcacggagggaacagagcacacaggacacgcagtcagcatacgcgacaagatggcaaaaaggatcaacgactccaagcatctagcaccatgagccaacagaaacacagagcgaaaatccacgctatctaagattacagatatctagcaaagacaaagtatgcctgctcatctactgctaagatggctagacaggatgacaacatcgcagggacgcaagattcattggccgaactccgcacctccttacatacatgatgacatattaatcccatagcttacctctccacaccgtggcaacaatcacgcagcagccagagtcacaacagactcatactgcaggaccacgaccacctcttacaactaccacagtcttccctgcaagaaccatattctttagcacatttcctcgtaccacagcacatgacatgcagcctaataacaggcatagcatggatggaaccaccctacaacgcacacgcagctaacgtggacaaaatcgccaaacacgccaggagagcaacgggaccacccgacaaccaaagaggcaaaactagacacagcagatacacagacaccagccacacacccagggcccaacacagaccaaagggccccccaccaccccaccactggacaaaacaaggactaacacgcaagcaaccggcacagaccaacagcacagacacccacaacgacccccgccagccacaacacagaaagaagaaacccaccgcaaaaccaaacacacaacgcgcccacaacacacggagaaaatcaaaagcatcccaaccaacagacagaacacacaccagaacgcccgaggtgcacggaagtagaatatgactgacacgatggtcttgtactcataagctcaatatccgactagggcggcgcacctaccgggatcgagagcacgcgcgctacggaaggaggtaaggagagcgagagctgaagagggaactgcgcgcggccggcggagcgtgcaggaggcagcgacgcggagggcgcgatgacagcgggcgaagacggcggtgagatgacgtcgccgagcagaggtggcaggccgatgagcggcgacgcagcgacgggaggtgaaacgaggatgaggacgggcggcaaggggct

SEQ ID NO: 574815 - DNA, 191 bp, Homo sapiens
agctgtgatcatgccattgcactctagcctggattacagagcatgaccctgtctcatatgaaatataaacagaggaaaacaaagccggaatttttgacttttgtaaaaatgcttttccaaaattttgtttaatttgtggggaaacaaaactttggggaaataaagggcaaattttgttggaaaaaaaaccc

SEQ ID NO: 574816 - DNA, 269 bp, Homo sapiens
agtaggtgggaccggggtgagtctcaagccagtggatcagtgaggggtgagtggcactgtcgtccgaatggagcatggtgtggcatccctcgcccagtgggccttagccatgaatgcactaagtggccggccccgtcagacaggctcagggtgaggtccgcccacaggggcttttgggcccctcccatcatgtaagacgccaccccctgccatgtgggtcctgttgcccttagctgtcacattctgccttgtgttgatctcagtggagg

SEQ ID NO: 574817 - DNA, 219 bp, Homo sapiens
tgctggcttcaagaggtggggtcctccccaacatcctggcacccagtaggttactcaccagcactggtcaaaggaatgattttaatccaaagtgctgggattacaggcgtgagccaccgggcccggcctggactagtttcttaacctctctgagcccatttcctcatctgtaaaatggggtcatgtattggcagtccctcccctaaatggttcctagaa

SEQ ID NO: 574818 - DNA, 1889 bp, Homo sapiens
tggcggacacaatgaggataggtcacctggagatcccaattccatggaacagagggctgagactgaatggccaacatttagacaagaagtctgccaaggctcaatccaggtgacctaatcctcattggtggcttgatgtttgctggtatcttccaaactcagttcccagactagattgatacctggagcccagctgcctactcagcatttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtggtggccccgaatgtctggctgcgctgatgtttgctggatgcagagcaaggggggcggggtggggagtgtgagtcatctccggtgattgatggggtcacgcgggtcgcgtttccaccggacggggggcccctccctgtttggcggcccaggtggagagagagaggaggcggcttatgccattgtttctgcatttcggagacttttggtgcttttactgattttgctgctgctgtctggagggcggggccgggtgtacagagtggagcaggagggtgaaatgggggcgtggccgctgaagcacagcatcgcggggagccggttaggcctccggataactgcgggccagcttggctggtgtcgggccttccacaagaggtggaggagcagagtcttctctggactcccgcggggaaggggagactccctttcctggtccgctgggtggcgggtgtttttccttgacactggggctgccgctggaccatggtccacttggcggcgggcgtcttcccggatgctggcgttgccgctggaccaaggagcccttctgctggccctgtccgggcatgacaggggcctcgcactcttgtcttgtggtcacttctcactgtgtctcctcggctcctatctctgtgtggcctggtttttcctgggttgtggttgtggagcgaggattattgtagtgttgggatggagagtggttgctgcagactaatgattgatgatattaatatataatcatatct

SEQ ID NO: 574819 - DNA, 124 bp, Homo sapiens
tattccttcagttgacaacgcagcaagctgcccaggcattccccatttatccaattgcacccaggcacaggcagcatcatttcacgttgactctcagcccgttggacccgagcacagacacaca

SEQ ID NO: 574820 - DNA, 1216 bp, Homo sapiens
caggctgtaccggtcggagagtgtatggatcgactgcggcgcatggcggtgagcggtgtggagaagacgcgcgggtggctgggccttgcattgttggcggctctcggtgaccctcgtgctacccccctttctccaggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcaagggcgggcttcggtcgggaagggtggaatccacgggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagtttaggttcaatttcttttagcgtctccccgaacctgaaacaatccccctcccttggggtggtgtaggggtttgttttgagtgcagagcctttccaggacttctgttgtcagagaaccctggagttggtctgtccctggctggtccaaggatttgtagctgttgtgaaggtgtgagaccatcagataggcaaaagaccccgttcgttttctgatgaaatgttctctctttcagaagagagagagaggtgcatttagaaaatatgcaataaattgaagtgagtgttcaaagtattgtagaagggaagataaagagaaaaaaaggggggggggcaaaaatcccgggggccaatttagcgacgttttgtaagggcccttgg

SEQ ID NO: 574821 - DNA, 573 bp, Homo sapiens
  misc_feature (15)..(15): n is a, c, g, or t
  misc_feature (481)..(481): n is a, c, g, or t
  misc_feature (486)..(486): n is a, c, g, or t
  misc_feature (499)..(499): n is a, c, g, or t
  misc_feature (523)..(523): n is a, c, g, or t
tgttacacagtattnttagttattgtacaccacaaaacttaagaacgtgagcataggttaatatttatcttcagggaaaagagtttcctttagaaggttttagaattaggaactgctgcacgcatattcactcaggaatgcttgtgtgtgcagtcataaaggtaggctgagagaaacgttgcggagctgagtgcagatggccccagggaatgatgccgagataacgcagccctgggcaggcaaaggcactttgtggaaggcactctgtcttttgtttcttaggacaaaacctggatctctgcatgccccaacccgaatgggatggggagcactttcaggtgtccactctacaccagcctgaagggaaagggcagcatctggcaggagccaaggcgaaatggttcccaggggatatagcagaccaggttgtcctgagagaatgcggacttcaccttgcgaggtgggatccgatagagcaggntgtgnggggacaggctgngcctgcagaaggtctccaagtctngcatggatgcttagcccagtaacatgtggataatctccacattaagaggg

SEQ ID NO: 574822 - DNA, 107 bp, Homo sapiens
ccctgctaggtctctctattcgtgttgaccacccaagccagcgggacaaccctgtgtgtgccatggaatgcagggccccctagccacataataggcaagggcaatga

SEQ ID NO: 574823 - DNA, 2596 bp, Homo sapiens
caggctgtaccggtcggagagtgtatggatcgactgcggcgcatggcggtgagcggtgtggagaagacgcgcgggtggctgggccttgcattgttggcggctctcggtgaccctcgtgctacccccctttctccaggccctgggacatcttgctggggaggcagcggcggccccaggcccgggtactccctgcgcgtcccgcggagcccggcttcccggcccagtttccagcgcccggaatccttccactgtctgtctctgcccagagcaacctacgtgcagtaacgctgactccagagcgcacccgttgggcgatgaaggcggcacagcgtcgaaaaaacaaaagaataagaagaaaacgcggaacagggcctctgtggcaaatggaggcgagaaggcctcagagaaactcgccccagaagaagttcccctaagcgctgaggcccaggcacaacagttggcccaggaattggcttggtgtgtggagcaactggagctgggcctcaagaggcagaaacccaccccgaaacagaaagagcaggctattggagcaatccgaaccctgcgcagcaaaagaacgcccttgccccggaagaggcagctgatgcactccttgtttggagactatagggctcagatggaagccgaatggcgtgaggccctgcgggctctcagagctgctgcttattcagcccaggtgcaacctgtagatggagccaccagaaagaagagccaaagggtctgcaggcctcgctctatatggagagccaaagccactctggacatgcctgatgaagagatccagttcttgtacgagaaacggaggttttggtagcacagattatcaaggactttgaaaaatttgcttcgttgttccagcccttaacaacatcactcctgcagcacgttaccattggaaagtcctacctcaagtctgcagatgcctccaagaagtccaaaaacaagtccgaagtccgacgagcaatggtggcgatggcgattctagttaataaaaaggggggagatgctggcgcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacaatcataacctaggaaaaaccaggccatacagagataggagccgaggggacatagtgcgaagtggccagaagacaagagtgtgagccttctcttatgcctggacagggccaccagagggcttggtctagcagtaacaccagtgtctgggaagatgcctgttgcaaagtggaccatggtctagcagtagcatcagtgtcaaggaaaaacacccactacttagcagactgggaaaaggagcctccctttccccgggggagtttagagaagactactcctccacctcttgtggagggcctgacatcagtcaggcccgcccgcagttatccagaggcctgtctccctgtgatgctgtgcttcagtggtcacgctcctagtccgctttcatgttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacatgacccatgtgaccttacctattattggagatggttcacattccttaccctgcccctttgtcttatatccaataaatatcagtggtggccccgaatgtctggctgcgctgatgtttgctggatgcagagcaaggggggcggggtggggagtgtgagtcatctccggtgattgatggggtcacgcgggtcgcgtttccaccggacggggggcccctccctgtttggcggcccaggtggagagagagaggaggcggcttatgccattgtttctgcatttcggagacttttggtgcttttactgattttgctgctgctgtctggagggcggggccgggtgtacagagtggagcaggagggtgaaatgggggcgtggccgctgaagcacagcatcgcggggagccggttaggcctccggataactgcgggccagcttggctggtgtcgggccttccacaagaggtggaggagcagagtcttctctggactcccgcggggaaggggagactccctttcctggtccgctgggtggcgggtgtttttccttgacactggggctgccgctggaccatggtccacttggcggcgggcgtcttcccggatgctggcgttgccgctggaccaaggagcccttctgctggccctgtccgggcatgacaggggcctcgcactcttgtcttgtggtcacttctcactgtgtctcctcggctcctatctctgtgtggcctggtttttcctgggttgtggttgtggagcgaggattattgtagtgttgggatggagagtggttgctgcagactaatgattgatgatattaatatataatcatatct

SEQ ID NO: 574824 - DNA, 259 bp, Homo sapiens
  misc_feature (214)..(214): n is a, c, g, or t
tcccccttaccttttcccctttttttccccaaaaaaaaaccccgggaaaagcccaaaaaagccccaattttccccggggaaaaaggaaaaaatcccccccaaaggtccccgggttttttttttccgggttttaaaaaaaaaaaggaaaaaaaagcctggccccttaattaaaaaaaaaaggggaagggggggaccggggggaaaaattttgtgnaacccccccccgggggggacccccccaaaataaaaaaaaataaaa

SEQ ID NO: 574825 - DNA, 896 bp, Homo sapiens
aatttttgtatgggcacggctcatttttgttactaggaaagggtgtttggtcgtgagagcccgtgtaccaagccctggtttgtgtaggtaccgaaaaggggggcgcgacatgtgtatcttattagaaaattggattataaatttgggaggaccttccagcgtgttgctttcaagcttaaaggctggccaagccctttgtcaacgacttcggaaggtattcccccttggaaatagttaatggaattggctaacttgagggacatgatgacatcacgtgttaagaattgttgaagagtcccagtgaaaatttagagagccatgacgattctatgcaccctatagactgctctgggagaaagccttctgattatataatagtggttcagctcccctgtgggggtcatagtcttctaggcaccagataaacttgagtgattccagtcactcttggccatttttctttaaaataggctttttagcctatattttgggaaactgcttttcttctgaggaccctattctggatgtcatccaacgttacccaaccttctaagtcccgagcgtaacttagtactgtttaaggtactattgactggattttctcattttctgtttagtcccgtgttacccaggtaagctgggggatgaagtgatacccacttctttcagagccattttaggaccattatggcagctttagaaggctgtcttgtttctagcccagggagagcccgcgcaggttttggataactagagaaagatcatttgcttgtactattgcccttttaggaagctttgatgtggattcaaattttacctctgttacttaaagcccaccattttaaggccgtagttttactggccctttaagctctttgtacagtgtccaatttgta

SEQ ID NO: 574826 - DNA, 162 bp, Homo sapiens
agcacaagcctggctcccacccggccctgtttttatgatattgatttggaccctaaacagaacaggtgaatggattattctaaacagatcaccatccatcttcaagaagctactttgaaagtctggccggaattccgcaaagatccctttgtccccatgcac

SEQ ID NO: 574827 - DNA, 414 bp, Homo sapiens
  misc_feature (10)..(10): n is a, c, g, or t
  misc_feature (121)..(121): n is a, c, g, or t
  misc_feature (281)..(281): n is a, c, g, or t
aaaaaaaagncatttatagataaacaccagactaagagtttccaatttaagtgatctatgctaaaggattttcctaaagttctgtatgtatttcaagaagaagaaaaatcaggctgggcgnagtggctcatgcctgttatcccagcactttgggaggtcaaggcaggcggatcacgaggtcaggagatcgagaccatcctggctaacacagtgaaaccccgtctctactaaacacacacacacacacacacacacacacacacaaatagccaggcatggtnacaggcgcctgcagtcccagctacttgggaggcggaggcaggagaatggtgtgaacccaggaggcagagcttgcagtgagcccagatagcgccactgcactccagcctgggtgacagagcgagactccatctc

SEQ ID NO: 574828 - DNA, 940 bp, Homo sapiens
agcgggctgagacagaaggccgcctaccggggagtgccggctagtcgcggactcgggcgaactccaccctcgcgatctgtcgaggtcatgtcccgcaagggcgtaggtcccacgtttcgggtaggaaggttcttgaagggggagtttcgtcaagaagtcacctcccgtcggcttcctttctacatcgctttctctctaggagcctggtagtcgctgcatgggaacgcattgtcgtgcagggatgacaggcgaagcggccaccgacagagggaccgagggtggtaaaactccttggaagctagcaatcgttcataacagaggatcgaccaaaggcagcacgcggtagtgtcacaaccatcgactggttgccctacaattcgacgggtcggaggacgaggggccgctatgtgcctcgagggagtgaggagccccagagagatggggttgtaagcgggcgtccgtgggcgaaaccggtgcgccggccgcatcgaaagaaagggctcgtgggcgcacatccaggaggtggcatgaatcccgcttcaacaaggacctatagaggaccgagtgtggcaacgggctcattggaacatggcggttgccaccatctcgattcgaaaggggccccatctgcgttgataattgcgtctttctctgcccctgcgtctccaagcgcggcaaagctttgggttaggtgcggggtgtttatgtgccaatggcgcatacaagttgtaacggtaatgggtattcccgaatgtagtctttaaagcggtgggttcccatgggctttggtttgtaaacaacaagggcggttgtggtcaatatgttatttttgttccttatacaatttgttaccaattaagatttcaaaggaaaaatacgcaacacattgagaccataattgaagcggagtggctttattggtagttatcttttacttggg

SEQ ID NO: 574829 - DNA, 204 bp, Homo sapiens
  misc_feature (45)..(45): n is a, c, g, or t
  misc_feature (63)..(63): n is a, c, g, or t
  misc_feature (66)..(66): n is a, c, g, or t
  misc_feature (138)..(138): n is a, c, g, or t
  misc_feature (152)..(152): n is a, c, g, or t
  misc_feature (160)..(160): n is a, c, g, or t
  misc_feature (178)..(179): n is a, c, g, or t
  misc_feature (184)..(186): n is a, c, g, or t
  misc_feature (189)..(191): n is a, c, g, or t
taaactatttattaaaaataagaaaaagacaactgtacaggattnaaatcccagctcccgggngtnaactaagtactagccctagatatgtatatatacacaaacacacacatgcacacagatctagctctgtaaaantacttagcaaatcnttagtcgnctgcagtaagtcttactnnccttnnnttnnncactccccctccc

SEQ ID NO: 574830 - DNA, 322 bp, Homo sapiens
caattgggggggggggggggcctccccccccctttttccaaacccctttccctttgcccggggcccccagatttttcccttttacccaagccccggctttttcccccccccccttttccggggcccctttttttaattttcccccccccccccgggcccccgtttttaaatttttgtggggggagggggaaaggggtgggccccccccccccccccccctttaaggggcccccctttttgggcccccccccttaaggggggggggggggggggggtcccccccttttttttttttttggtccttaaaggttttttgccccca

SEQ ID NO: 574831 - DNA, 148 bp, Homo sapiens
cacctaaacctgatctgccctgcaatgatctggcgtgccgccttcaaacttccaatggagctctttccatgttgattcataaatggccgacaaaatcaatcatttctccgccaaattcgacagtgctccatctgttcgagcaacgccc

SEQ ID NO: 574832 - DNA, 707 bp, Homo sapiens
tgatcctaagcaggggcgaacttacaagctgaggatgcgcaggaagtcaccgtcagcgtcaattgctcgacagccgatcacctttggcaaagcgccaggtgcgaatgatttccagacggtcgatgtcgttcaagtccccggtaaacggcgcaaaaggcgccgccaggcgcacgatgcgttgcgccgcctggtccagcagcggttggccggaggactccagcacctgcacttcgtacaaggtgccgtcgcggttgatcgacaccagcagtcgcaaattgccgtagatctgctggcggcgggcttcgtccgggtagttcaggttgccgatgcgctcgaccttcttgcgccactcgtccttataccaggcgcctttgtcgcgcatggtggaggcagcattcaggcggtagatccgcgggcgcttggcgtacagctgttgttcgtgggccagttcggcttccaggctggaaatttcactggagagttgcgagctatcaaacgtcggggccggcggggcaggcgtgggttcggtcttggccttttcccgttgagtgggcgctttttgcggtttgggtgcgacggtagtgacagcggccttgggtgcagcctgtttcacctccggcttgggcgctggcggtggcgtgaccttattgaccttgttgtcttgaccggcgccacttcggtgtgcttataactcggccggaccgacc

SEQ ID NO: 574833 - DNA, 247 bp, Homo sapiens
  misc_feature (5)..(5): n is a, c, g, or t
  misc_feature (207)..(207): n is a, c, g, or t
cccanggatgccacaggtaccaagcgttaccagtaccagctcacattcctttccttatttggaaagaggactaactttctagctcattacagacaccccttccccttcctctccactttcttttacatgcccaccctatctaaaaaaaaatcaaatgttcagtcaactgggattagtttagattgtatgaccccgggccagtggggnaaagggtacagggggcagggacttgcattcagggaattaa

SEQ ID NO: 574834 - DNA, 357 bp, Homo sapiens
taacattgccgcaaacgcctgcggtcacccaggtgacggataccatcgacaccaccacggctaccctgactgcgtcgcctagcgtgaccgaaggtggcgtgatcacctacaccgtgaccctgagcaaccctgcccagactccggtaaccgtgaccctgtccaacggccagaccatcaccgttgaagcgggcaagacccagggcagtgtcgacttccagaccccggcgaacgacgtctacaataacggctcgaccgtcagcgtcaccatcgagaccgccacgggcggtaacttcgagcagctgaccccgaatccgaccccggctcagaccacgatcaacgattcggtcgacaccacta

SEQ ID NO: 574835 - DNA, 124 bp, Homo sapiens
tgctctggtgtgatgatggagaactgactcctcgtgcctatggagtctgaggcaaagctttctggttctggggaagagtcacattctgcttctccctactagatgtgcgttctagtgtatatct

SEQ ID NO: 574836 - DNA, 117 bp, Homo sapiens
gtacagcacgcgctaacaattaggttcatagtaggtgcctgccagtaatgttagcggttaggcgtacggccagggccatatagattgaatgagtacggctgatggtttcgactaata

SEQ ID NO: 574837 - DNA, 303 bp, Homo sapiens
tgagacagagttttttttcgttgccaggctggagtgcagagaggctggacttctgtggtgacgggcagacaggactggtggtgttagtcctgatggtctcttaagaggaggtgggtaggccgggaacattgggtcatgcctgttatctcaccactttgggaggccgaggcggccgaatcatttgtggtgaggagttcaggaccaacctgggtccactccgccgcgaatttagttgttattagggccgctctttaggatgcaagcttaccttcgctggcttgcaacgtgatagctcttatatag

SEQ ID NO: 574838 - DNA, 581 bp, Homo sapiens
  misc_feature (581)..(581): n is a, c, g, or t
agtagttcaaccccttttgcatgttgtgcaaagaaaactggctaagatggtggcttactggggaattggcacagacaccaacacccatattcttaaccaaattctccaacattttcttggatttaaccttagctggggcttcagcaacaaatctagcaattgtggcggaatgaacctcaggcagcatggcttcaaaagccaatgtgtcaaccaatgaagacccggcactttcaagcagagggaatgattaaacaccttactcaaacaaatcaagacatagttgtacccgcttttaaatcgatgtgggacggctgcaccaagagggtaacaaactggcggacagaagcgtgagaaactcggagaccatcttcacataaaccaatcgcaatgtgttagccgagaggatccctgtgtaactgacacttaaggagaattggaagctggagggggctttgggctcctaaaggaggacggcggatttttgacaattttaggaaagagggggtccctaaatgcccaactggaggtggcctgacaaaaaaccaaatgtaggaatatcaagggggccctcgcggaattcn

SEQ ID NO: 574839 - DNA, 306 bp, Homo sapiens
atttttttcctgtagacagcaaacacttcaactataaaagcttagaaatgtcttccgaggaaaattttcgttagaatccttggcagtgtaaacctctttgccctctggataaaatgtgttaccttacgtattgtcatgggaacaattatttttatctctagtttggctatgcctctaaatctctaaacttctcacatttacattagttttttatgcttacagagtaaaatagatacacatactgagtttcacatgtctagagattttccaatacatgctaatatccgatcactaataccaactcgc

SEQ ID NO: 574840 - DNA, 696 bp, Homo sapiens
  misc_feature (127)..(127): n is a, c, g, or t
  misc_feature (195)..(195): n is a, c, g, or t
tcgggtaccattattatcgctattccccacggggggtaaggtatttagttgcctcgcccccctcccgggaagcaatataaaatgatttgtcgcagtgctctgagccctaggattctctttcttttcnccgtaggtgggcctggcggcattgtattagcaactcattccctagacttggtactacacgcaccgtantacgttgtagctccctcccactatgtcctatcaataggggctgtgtttgccatcataggagggttcattcactgatttcccctattttcagggtacaccctagaccaaacctccgccaaaatccatttccctatcatattcatggggggaaatttaacttttttcccccaaccctttttcggcctatccggaatgccccgaggtttctggggctaccccgatgcataccccccatgaaacatcctttcatttggggggtccttcctttttttaacagccggaatattaataattttcatggtttgaggagccctcgcttccaagcggaaaagtcctaatagtagaagaaccccccctaaacctgggggggctatatggatgccccccccccccccccccctttgaagaacccggatacataaaatttagccaaaaaaggaagggatcggccccccccaagggggtttcaagccccccccctggcccccctggctttttcca

SEQ ID NO: 574841 - DNA, 129 bp, Homo sapiens
tttgtttaaaaccttcagctttcgttccattactcttttaggcttaagacactcgtgttaaataccctgctgaaggtatacacaagtagctttccctcttgagacaaaagccagtattccctatagcct

SEQ ID NO: 574842 - DNA, 190 bp, Homo sapiens
agaggaggggaaggcaagctctggagccgctccctcagggaatcaaggagtctctaaacaattcttcccctggggattaagaggaagttgtcaagaatggaacctgaagatgctacagaggaaatcagtggattcctttgagctaggagaaataagagtcgtggagacggagagccttcacttcggcctc

SEQ ID NO: 574843 - DNA, 199 bp, Homo sapiens
  misc_feature (21)..(21): n is a, c, g, or t
  misc_feature (42)..(42): n is a, c, g, or t
  misc_feature (68)..(68): n is a, c, g, or t
  misc_feature (123)..(123): n is a, c, g, or t
  misc_feature (166)..(166): n is a, c, g, or t
  misc_feature (195)..(195): n is a, c, g, or t
tctcttcaagataagttgtantttaccatggaaaaatacagnatctaacattaccattcacgttaaangaagtttcctcataacatttatctctagttttatgaagtcatcgtgaccaatgtnacagtaatttctgttagctgattgtggtaaacaatgtttaatntgaaaagaaattaaaactttcttcatctnttgt

SEQ ID NO: 574844 - DNA, 129 bp, Homo sapiens
tgagagaccgtgttgcaatgtgtccaggctgctcttgaactcctggcctcaagcgatcctcttgctttgcgctcccagagtgtatggaattacagtgtgtgagccactgtgcctgccgctcaatttatt

SEQ ID NO: 574845 - DNA, 125 bp, Homo sapiens
tactacaggttgggtatgtggctcacacctgtataccagctactcaagaggctagtaggaggatctctgagcccaggagtttgagacgatgttgggcaacatagcgagaccccatttcgttttgt

SEQ ID NO: 574846 - DNA, 102 bp, Homo sapiens
aaattgggaaaaggaagttttgaatgaggatgctagagtctgagcaattccaaatgaggaagcttctttttcccagatttctgatgatagaaggaatcctca

SEQ ID NO: 574847 - DNA, 479 bp, Homo sapiens
gctcgtatggggggacatttcagggctggcagcaaaggatgggtgggcacagtgcccagaggccggtgagggtgctcttgtccagcatcctggatggggatatgatgtcgcctcgtccatagtcctgagctgaggtgtgtctgctgggcctttgagctgggagaagcctgtagcatggtctccctgaggacactgttgtttgtgggcttggagccctcctctggagggctgccggatggggtgggtcccctcgagggtgcttgtttctctggtggtggggcccggccgtgccggcagctctgctctgagctggccctccctcgtcttccttccctggggcgaagaccaggagtcgccctccagggtctgtactcacagccaccctggctctgtggagatgggtacgctgcttgccttagagtgccctgttctcccccgctatcctttggtggggtctcccggccccacagagagagcgt

SEQ ID NO: 574848 - DNA, 331 bp, Homo sapiens
  misc_feature (61)..(61): n is a, c, g, or t
tgcatattttgctggtttataaagttcgttaatataaaaagtaccatgggtaaacatatcntacatgtaaatctttgatgatatgtattattattttaggatgtgctttcaggatatgcagtggttaaggcacttgatatctactgatgtctttacacccataaaaggtatacttttctataggaattgttgtttaagtgtatgctcatcacaatggagtattttcatttttaattagtacgtaaattagatctcataattatgttaccaattttttaattaaagtaagacaattgcatagatttcttattgccatcactcctcaccaatg

SEQ ID NO: 574849 - DNA, 967 bp, Homo sapiens
atttcgtgtggaattggttttcttgtgcccggatatgatgattgttgttacgtagagttttgtccccgcacgtgattaatttcttgaggacacttgttgttacccccctagttatcctttttgagtgcggtggttttaggtgacgcccctaacggataatgtgttatctggagacaacaacagtggctaaagtatcttgtttaggtggccatgagtctgtcagcacaagcgaggctgaaattcctgaacacagtgcattctggccctccctattctccctcctcataatccaccaggtgcccacccattttaacctgtgttgcaacttcgcgttaattatctgtggccccttctgggtgatctaacaacataacacttgagtatggaactgagggagttaccactgatatagagactgagcacaccctaaataattgatggaatcaccatctaagacctacaagagagtgtacacatagagtgcttttttgaaagcgtcattagttgatcggaatcatcagaatattgaggtggtgacaacctcgggatgatctgtaatctccccacaatttactgttcttgaatgacattctcaacagctactttatttaatgagtgagtctcatccctgctttctgtgtcctctctctgcagtcttctcttggcatacggaaagtttatatttactcagtagcgtgtgtgtgtttaaataagcgttacacaaaaagatgcattcccttccctgttcacactcttaccatgtgtttgttcttccttaagaatgattgtgtgtgtgtgtgtgtcgtgtgtgtaagtgtgtaagtgtaacatcatgggttttctttcgttcacttgtaaagttttatctagaaatactttttacaggttatgttgaggtacaccgcaagataatggttctaagattgtgtattggatttggatttgtgtgtgtgtgtgtgtgtgtgtt

SEQ ID NO: 574850 - DNA, 106 bp, Homo sapiens
cacgagggggatccgtttgcttaaattatctttctgatacttcattattagtgtgtagaaatgcaacagattggtgcatgtagacttttagtatttgtgcaaagtt

SEQ ID NO: 574851 - DNA, 159 bp, Homo sapiens
  misc_feature (11)..(11): n is a, c, g, or t
  misc_feature (20)..(20): n is a, c, g, or t
gccaccacagntgctcctgntgctggcagccccagctaaggttgaagccaggaagagtcggaggagtcggacgaggatatgggaggtctctgactaatcaccaaaaagcaaccaacttagccagatttgcaaaacaaggaaataaaggcttacttcttt

SEQ ID NO: 574852 - DNA, 261 bp, Homo sapiens
gaatgaggcggaacagcagccatcgttacagccagaaggggaggtcttcgtgggggcagtgcccttgctttgcctgccctgtgggggcctccttgcgggggggaggctggcctcagcggggccaccagcagggccaggaagccagtctctagcagcaggccagtcccattgggaaataaagggaacacctgggcccacctgggcaggggttgccaggttaggttcaagcccgggtacgagagcttcgaattcggtagtcat

SEQ ID NO: 574853 - DNA, 399 bp, Homo sapiens
gtcttaagcatcctaaccagtcgtcaaaaaactttagattgattccatttagatgaaatatccagaaaaggtctagagagacagaaagtaattagtgattgtctagggatgggggaggaagaaatggggagttaactgctaatgggcatggagctttttgggggtgatgaaaatattcagaggctgggcagggtagttcatgcctataatcccagaactttgggaggccaaggtgggcagatcacttgaggtcaggagttcaagactctagcccgggcaacatggcaaaaccctgtctctaccaaagacacaaaaaattagccaggcatggtgtgtgcctgtagtcctagctatttgggaggctgaggtgggagcttgagcctgggaggtagatgctgt

SEQ ID NO: 574854 - DNA, 372 bp, Homo sapiens
  misc_feature (21)..(21): n is a, c, g, or t
  misc_feature (84)..(84): n is a, c, g, or t
  misc_feature (103)..(103): n is a, c, g, or t
  misc_feature (114)..(114): n is a, c, g, or t
  misc_feature (122)..(122): n is a, c, g, or t
agatccgcctcgctgtatgantaaagatctaggatgtggaatgacctgggctcatatggtagcatgttgcattcaactttttantacaccgtctgacagtttnccacagtggtngtaccgtnttgcttacggtttttatgggccaggggtttgtttcattccctgtggctcaacttactgtgctaccccttgagatttccacttaaagccatccaattgggttgtagtgatttcacagggtgtttgcactttgtcttgtctcgatcataactcatgtaagtcttttttttatcccccaattgcccacttgttttattctccttaataacgtgtctgtccaaatctttcgctcaatctaaatggcataatcat

SEQ ID NO: 574855 - DNA, 438 bp, Homo sapiens
  misc_feature (44)..(44): n is a, c, g, or t
  misc_feature (92)..(92): n is a, c, g, or t
  misc_feature (105)..(105): n is a, c, g, or t
  misc_feature (205)..(205): n is a, c, g, or t
  misc_feature (231)..(231): n is a, c, g, or t
  misc_feature (249)..(249): n is a, c, g, or t
  misc_feature (284)..(284): n is a, c, g, or t
  misc_feature (347)..(347): n is a, c, g, or t
tcttctaaatctagacaaccggatattgaacgtgtgctttatancatatctgtggagagggcaactcattttgatcattagtgatactgggntgaatttaatagnagacacaatccacgcagataagaataaaaaggaaaatgatcatctccttctatagcatgtgcagattcaaggcggagacgtagatgctgagatcaaaatnacagtttttacttatttgtccaggtnctggtagtataaacattntgtcctcttcacccctgctaactacctctgtaaantagttctaccagagtggagacccaatctcaggggaagaaattaaaaagtaatataaattcgcnatatattaagaacaatattgtaatatgttataatttcagaccaggaattttctggtctttacctacaagggttttcattatcaaaaaaaaa

SEQ ID NO: 574856 - DNA, 664 bp, Homo sapiens
ccggagacacaggtttttctccattttttctaaaggggcacgttcgggggctaaattgggtggttctaatttgacccccatgaggcccccctaaatgaagataccacgtgtgattaagatcaaaaggagaaatttcttcattatgtacaaacctatgtgtgtataataaatgctgtctaaggtaaacacacatgtcttgccatgaaacttcacattgaagttgaataataaaccctgagtaaatatgacgaaaatcaaatcaggtcaattaatctaaacacattacatgttttatagaatatcagtggtaaaagtaatgatagctgtgcgtgggtcacaagagatagggacggcatccttacgaactcaggggcgtactttattcctatatgataaaagatgatatattaataggcatcttggtaacaaaatataatatattactgtacgctgatttatttgaaatgactgctcttgcaaccttattaattttagccagcactttgatcgttttaataatttcaaagctcagctaccttacaatcattggcaaagtctctcatataattacaaatggcgcgaactctttttgttacttacaccgatacctctacacctcattttcgcgaccgctatttatatccattccgttctccctgccccc

SEQ ID NO: 574857 - DNA, 124 bp, Homo sapiens
tgctatacgagctcccgaccagcggggtgtccccgcgattttgacacgcaacagcggctgtacgcttccacgacacccccttaccaccacgtactcaccacgcacggggccgaccacgacgtcc

SEQ ID NO: 574858 - DNA, 352 bp, Homo sapiens
ccgtatattctgtaggggaaacctccgggagtatcctatcgggggagactagacaaggtgagctttgatattgatgataagcctcaaaaattctgtattagtagtaatactatgcgaagtctagtgtatcaaaatgaagaattcagatggtaggaggttctatagtccttttaaagctgactcttgagtagtcagttgaatatccattagataggatttggaaataacctgaggaaaagtattatgataaagatctgcacagatgcctcttagctgataggtggcaggcctgtgggtttgggttctccctcttttctctggaacatatgacaattccagattaaagaaaaat

SEQ ID NO: 574859 - DNA, 105 bp, Homo sapiens
tactttcacaggtacttttccgggctcactcctgagacaatctccatggctacccaggactgagtttgctattgcccgtaacaatagggtcctgatccctctcac

SEQ ID NO: 574860 - DNA, 181 bp, Homo sapiens
ccccccaaaaaagttctgggaaaaggctttccccgaaaaaaaccaaagaagggaaaaaaaagttggaagggggaaggggctttaaaggtacctcccggaaaggaaataaccagccaatccggcccaatttcgaaaaagaaatccggggggaaagggtaaaaaaaaagggctaacccccata

SEQ ID NO: 574861 - DNA, 327 bp, Homo sapiens
aaaagccatttctactagaaacacaaaaattagccgggcatggtggcacacacctgtaatcccagctacttaggaggctgaggcaggagaatcgctggaacccatgaggcagaggttgcagtgagcctagatcgtgccactgcactccagcttgacgacagagtgagactctgtctcaaaaaaaaaaaaaaaaaatggcagtatagtttaatgtgtatggaagggttaagaaatatttacatagcgaacaatatggcccttttaccttggcaaaaaataccgtggagaagaccttggcctatggacggggggatatcaagaagaggg

SEQ ID NO: 574862 - DNA, 682 bp, Homo sapiens
  misc_feature (682)..(682): n is a, c, g, or t
aaggagtttcaccatgttggctaggctggtctcgaactccttgcctcatgtgatctcccccgccttgtcccaaagtgctaggattacaggtgtgagccaccacaccggccttgatcatcattatcaatgcaattatttgtgacgtacttcctagccctccagagcttttaaaagaaatggaatctgactttaacttctagtgtttgaaagttttagtcccttgccatcttgcttttgagaaaccgtattagcgctgtatgttttgataggagtacagttgcttaattatggtagcaacctgaattaacttctgtgtagctctttgtggcttaccattttcatatacattaactcatttctactccacaggaagcctgccattactgattactcagccaagccgcaactgtactataatttcgaacctagtccctttgttcacataccctccttctattctgggagctcgtaatattgaacagacgcaaatgacaccggtggggccattcatcatctccttttctgacacctgctgcttaacatcactgctcactcttctttcatggtccctttagaccctcccttatacatcttggtccttcatgtgccctggtctcttcttaacctttttcttttttttctcctttaatctgctgggtcactttgccgcaacatatcctcn

SEQ ID NO: 574863 - DNA, 655 bp, Homo sapiens
gaccttcgagtggccgaagcactccacaaactaaagtcacggagtggatgaggtagacaaaaggaagagaggcagaatgcatcagtccagtccacaccccaagcaccactccgcatctcgttgcacctaagcagaggcccaggggctggttcagttctggttcttccaaagccttacctggtccaaatccttagcagcagtggactctggaaggtggggatagggacagaaacttgctcagataagtggagcctctgtggaccgagatcccttcagaagtacgattctggaagtttgtacacccaggtcgctaccgaggagcccagaagcccgtctccattggaactggatacgtgcccaaggccaaccagaatggctgaggatcgcagcagacttgaagccctccctagagatggacatcccagtgatgggaggaatacaaacgaggcgaccatggggcccataagcgtcaaatcccgtgagctgaatgtgctcacagcccatgtggctgtctagagccctctttccaggattcgtggtaaaggtggttctgtgcatcccaggtccccttttaccttggcttttgacataggaaaggtatatgtgaacaaacttaaatcagctgggcgtggtggctcagcctgtgatacccagc

SEQ ID NO: 574864 - DNA, 282 bp, Homo sapiens
ttttgactgtgtactgcgtactgtctatgattcacaggcttgcgtgccctactggtgtccctcttttatagtgactgcttaatacggagggtcataaaatactttgatgactagataaatattaataggtcctagctgttaactcttaaaacgcctagggaagcacactctctgtatgtacttcattcttctgaagtattagtgagcactaactgggcgtagaagctgtgtattagagggtatgctctagcactccattagaaaattcattctcagtcttag

SEQ ID NO: 574865 - DNA, 179 bp, Homo sapiens
tgaacagattaggaatataagcctcaagagagctcccagaaagctgagatctaaacacaaattgtctctgtatgaaacatagagaaacggaagatgcgtataacaaggtatgacgcacttttgtaaatactataaatgaagaatgatctagtaaggtagcctacttggcaagtcattaa

SEQ ID NO: 574866 - DNA, 160 bp, Homo sapiens
  misc_feature (138)..(138): n is a, c, g, or t
ctgtcgtctcgtgatagtagcagtctcacgagatctgatgcttaaagtgtgtgtcatctctttctaccatcccatcttccgctggtgagatgtctcggctctctcgtcttcaccatgatgtaagttctgagtctcttncccactctgccagggggggtac

SEQ ID NO: 574867 - DNA, 1069 bp, Homo sapiens
  misc_feature (915)..(915): n is a, c, g, or t
  misc_feature (948)..(948): n is a, c, g, or t
  misc_feature (1048)..(1048): n is a, c, g, or t
ctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatntcctgcatcgggatattaagtgtctaacatttngctgaataacagtgggcaaatcaaactagcagattttggactttgctcgggtctataactctgaagagagtcgcccttaaaagaacaaagtcattacttngtggtaccgaccctccaaacc

SEQ ID NO: 574868 - DNA, 817 bp, Homo sapiens
gccgcatcggcgagctgcgtctcccgggtgtcggccccggcggctccccgaccgtgcccggctgtggcgaggcggctccaggcccagtcctgtggcagccggcgaaccccggggcgctccggagcccactgcgcggcagcgcgtgccaggcgtgcctgcgatggacgcgggcactgaagtcggagccgcttcggaggagccagccgaaatcctgccggccgtgcccgggacgaggaggagggaggacggaagcaggggactggcagcagggggctggacggaggaaagaaagaaggtggatccccggatccatgggagacctggacgaacgtgaaactcaggtccactggcatggaatactcaaacacgaacgtgggatgacctgagacttgacggactgctcgtgcacgaaagattcgcggtcgtgtgtcatgggttgagacgcagacgggtgcaaaacgtggcatgagcctgggtgaaggaatagcaatttggcagaaggctgttcggaagagctccaaggcccctaactgggagggcgacggaggggtgcgcgacggccaggcctccagcgtgggaacgctccagacaacgccagcgacagggactttgccatgagggggccacaagcacgtgtgcctcccgttgactcgagccaacggagagccagtctccccgtggacacgacgcacgccggactgcctggagaggcatgacaaagccgtgcaaagttcgaccatccgggctgggcacggaggattgcttgcaatcgacgccacctcaggaggcgtcattggacggctggaaccaagaccaa

SEQ ID NO: 574869 - DNA, 892 bp, Homo sapiens
  misc_feature (738)..(738): n is a, c, g, or t
  misc_feature (771)..(771): n is a, c, g, or t
  misc_feature (871)..(871): n is a, c, g, or t
ctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatntcctgcatcgggatattaagtgtctaacatttngctgaataacagtgggcaaatcaaactagcagattttggactttgctcgggtctataactctgaagagagtcgcccttaaaagaacaaagtcattacttngtggtaccgaccctccaaacc

SEQ ID NO: 574870 - DNA, 252 bp, Homo sapiens
tctggagaccctcttgtgtgtaacaaagtggcccagggcattgtatcctatggacgaaccaatggcatgccaccacgagcctgcaccaaattcacaagcgttagacattggataaagaaaaccatgaaacgctactaactacaggaagcaaagtaagccaccaatataatgaaacacattctatggagccaagtccagatttacgctgggagaggtcccagcaactgaataaatacctcttagctgagtgga

SEQ ID NO: 574871 - DNA, 559 bp, Homo sapiens
  misc_feature (288)..(288): n is a, c, g, or t
  misc_feature (305)..(305): n is a, c, g, or t
  misc_feature (444)..(444): n is a, c, g, or t
atccatatggggtaggtcactgagaatgacagacaaagggcatttcttccatttagaactgggatttaagattcttctagtagccttatcatctaatttttttaagacagcggagcagtcacaaaatacattcatgtataaagttgccttaagatctgaagcctccacgtccatctgaggagcctggcctttgtctcaagccccagaaggtcaactgaagtattgtgcaaataaggtaacaagaagcttcaatgccactcccagtatcagaaaaagaggtcagatggntactttggtaaatatgnatccaaagccttctatgcagttgaagaactttaaaaactgatgcgtcctgttttggaaaggatggatagagattttaaaggctccagccattgaaatttcaatatgcagtgtctaacgtaacaaaattaagcagagcanaaagtaggcaattacagccatctagcttcgtccaagttcatttattccaatgaaattctaatcattctcacggagacctgcagtcaggaaatacacagagctgcccgaaggcagc

SEQ ID NO: 574872 - DNA, 325 bp, Homo sapiens
atgcgagaaacctcaaagatatctaaaaaggccaatcttaagttcagcaatagtgatgttatctgcaggagtaattaaggaagttgtctatattatgacctccagagtaatggctggcagtccttttatgtcaacaccttagcagaattcaggctcctttcctcctcctagcctggtggtctctttttaactctacaaaggcagttgagttttggggaagggctatatgtaaaccataaactaaatgtctcccaaagtcagcttgtctcaagcccaggataattaatatcagcatgaaggttaaaggcaaagaagagggaggttg

SEQ ID NO: 574873 - DNA, 222 bp, Homo sapiens
ccaacctgcccagggcacccacacaagggcagattttttacaccttttgcaaaaaggaggtgacctggagggcacaataatgaatggatttgattgcagaatagggggcgaggttaaaaagaaaatggggtgagattgaagattccattcaaaaaacttagctgtacagagaaaacatcaaggctttggtgtgaatatcaaattcaaattttttcacagatt

SEQ ID NO: 574874 - DNA, 384 bp, Homo sapiens
caggagcaagtaatatgacctgagttttagtttcttcatgtgagaggtgatagtgaaagtactggcttcatagggtggttgggaggcttaggtaagctaatccatgtaaaatgcttagctcagtactattggttttagagaagctgttactcaagaatttgttaccagccaggcgcagtggctcatacctgtaatcccagcactttgggaggccaaggtgggtgaatcgcctgacgtcaggagtttgagactggcctgaccaacacagtaaaaccctgtctctactaaaaatacagctacccgggaggctgaggcaggaggttgcagtgagctgagatcacaccactgcactccagcctgggcaacagagcgagactctgtctc

SEQ ID NO: 574875 - DNA, 865 bp, Homo sapiens
gccgcttccggaagtgggtctcgtctcctcccaatcggatgcttttgtgcctgaagctgtccggtgtctgctacggcaccgtcggtgtgctgcatgaaatccctgcgtgggccaagggctgggctgtttgccgctatggcatggcaagtcagtgacactattcgaatgccatcgatgatggcgtgactagaggtttcatggggaagggtactcggagaaggctagtgaagaaggcagatagattgtggggtgtgatcgcgagaggaacggcagcatggcacgctgcatggagccgtagaaatcgtgagtctgacgcgaggaagagcatgagaggtcttcagaatccattgattggacatgatcccagtaaattcccttatgatgaccctacttacgataaactctcatggaagactttagactagagatcgatgaggaccaatttaatagcagattgttgttgcgtgtactcaatcttcaggccagactttagaattagtgcagaaggttccggactttcattttgaggaggatggatgaacagagaccgaacgtcgaggaacagatgtgtgtgtgacgtgtttagaaatgcggtgaacgggccagacggtgctgggaagagcacgttgctccattgcccagggtgagggtaccgggttcggcccatgggcacggccttgcttccctgagggatttgctgactgtgtcacctagatagcgcgtacttggggcgcctatggccagacattgcctttgtagaggctgaaagccgtccctggcaagagcactcgtgcctttgagtttgacaggcttttccggtaggcacagtggctagctggggtctgggattgggagttgggtccgg

SEQ ID NO: 574876 - DNA, 487 bp, Homo sapiens
taccccgggctgtaggaatactgcacgagacgcctttctgtgctctcgcctgtaggacctgtgcagaatattgcgccgtgccgaccgcgcacacgcgcccatatgtgaacctcaaggacgagctgtgtgttttccaactgtggagagcgtctgtgtctcaagctctgtagggtccggtgaagcccggggcacgcatcttcttctttgacgggaaggacgtgctgagagcaccccacactggccccacaagaacgtgtggcatggcttggaccccaacgggcgcacgctgaccgagagctactgtgagacatggcggacagaggcttcctctggcacagggcaaggcttcttgctgttggggggcaagctctctggggcacagagccgcgagctgtcataacaccttagtgctctggattgagaacaggcttatgacatggcttcaagtaaccaccgcctggatgcacataggccgagggccgcggct

SEQ ID NO: 574877 - DNA, 152 bp, Homo sapiens
cggtaccatcggcgcggtgcagtctagcatcccattgcagcacaagctctagcaagtagcatgcagtcccacaactcattcagggggggagaatcatcatcatccatgtggcctgggctccatcctaacaatccccatcaccacgcagcatg

SEQ ID NO: 574878 - DNA, 447 bp, Homo sapiens
  misc_feature (104)..(104): n is a, c, g, or t
  misc_feature (309)..(309): n is a, c, g, or t
  misc_feature (312)..(312): n is a, c, g, or t
  misc_feature (362)..(362): n is a, c, g, or t
  misc_feature (368)..(368): n is a, c, g, or t
  misc_feature (401)..(401): n is a, c, g, or t
  misc_feature (415)..(415): n is a, c, g, or t
  misc_feature (439)..(439): n is a, c, g, or t
ttcgggctggatttgctaggatgggcacacaccggatcagtagaatggagctccggatcccgttcccctgtctcccatctccgatttagtcctacagtcactgngtcaacatcataatgttctccatcccaactccagagctctgtgttatgtgctgctctcatttctccacagatctccacagctcctcactattctccctacatacatagagtcctggccccagtccatctctcagctctgcgcaacaatctcaaaaattaatctggatcatgttgctcctttcacaaaaccccgatggctccccgngtntagaggataaagtcaaagtgggtacacaaggccccacaatcccactctcnaagctnaggtgtctccaggctccccctgaccctgggccnggagagtccccagnacacagcttctgagtagattcagnttggctta

SEQ ID NO: 574879 - DNA, 136 bp, Homo sapiens
tactgcaggctgtcggacatacttctggtgggcacgtgcggaaacttgaggataaatcagtgagctgcatgcacttaaaggcatggcctgtctcctcacttgagtgcaatgtccactcgaccaaagccctgttctg

SEQ ID NO: 574880 - DNA, 267 bp, Homo sapiens
atgagcatagctgtcatgggcgtgcgtcctccaaaccgagtggcagcttcagttgctccctcaaatgggcgacgtgcgcgtacacacccggcttgtcatagcgccagtgagccagccggcgaccattgctgctggcttcctgcttgcgggcctccagcgtctggcaggcgtgcccataccgagcttcccggaacgccattattaggctcgctttcagttctacaacgcggtcggtattgcgggacaacgacagcaggaaaaacgctt

SEQ ID NO: 574881 - DNA, 976 bp, Homo sapiens
tgtctcttcgtgccctgtcgttctgtccgacgcggacccccatctctgtgacttgctggagactcacttcctaatatgaggaagtgaagtcttatcaggaagatggatgaccacctgactcgagcgctccagcgaaggctgagtctgtgcccggagtggcgtgaggtctggggccgatgtagtcttcattcgaggaggactcatactactcaaggccacagacgtaagagtgccttctgaggtccgcggacgactttctgaagggggccccttggctgatagctacataagggcttctctgtggctaaaggccctctgcccgtccagtgcaaatcaagggtcgagctttatgcgtataagctagttctcgtgacaccatagctcctttgggaaccccaatatcgggacatagttacaccaggcatctcttgtcgagtcgttaaagaaacatattatagagagaggccaaacattccactcattgataactttctcctatcggcgaccgcacgcctgagatgcgcgctcttaacaacaaggttggtctatctgatgaaacgccctttgttttttgggagcgcttggcgggggggacttccccaggaagggcgcaatgaaatttggaaccaaagctgacgtggaaagacccccttgagctaatttgcacaagggagtgcgccctttggccgagacgtcgaacgttcattatagaaagttcgagccgaagggttgccttggtacactgggggggaaccaaaccacatgggcgcggggagaggtgccaactccaggtcagggctttgtggctccagatcgaagatctgctcggacaggatgccatcaaatcccaagggagagattcacgttggcacagaggggatcctctggcacgaacgacgatagtgggagggctcgaaaattgttagagctgcgagcacactatcccacaggtggaacgcaccccgcggtcgaggtg

SEQ ID NO: 574882 - DNA, 462 bp, Homo sapiens
gatccgtgtgtgtggctcagtactggggtggggattgtactagggtggtcgagagtgccgggccgatgatttataagcggccgaccggggatataggtgtacttggtggtcatccggaggccgtgctatacagggtggcaggagcagagagcagagacactacctgggacacaacgatgacatcaaatgcttggccatccacccagatatggtcaccatcgccacgggacaggtgtgcgggaaccactaaggaatgggaatgccgatgccgccccacgtgcgcatctgggactcagtttccctctccaccttacacgtgctgggcatgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtgga

SEQ ID NO: 574883 - DNA, 1485 bp, Homo sapiens
  misc_feature (253)..(253): n is a, c, g, or t
gccgtaaccaacgataacgggggcgacggagaaacctcggagtcgtcgcagggcggcgggcgaaggcccagggccttggagatggagaatctctcagttgtgtaagcgtgtctcatcggctggccttcaattgatgctagacagagtgagttcgggccgtgcgactggccaacatgttgagtgacattgggggacgtcgtggactggactgcgttggtcggtggtggtgaactgccgccgcgaattctaatgnatgcattccacgatagcatatcgggcgtttcaggtgcacccttaatctcgcgaactgtgtggcacggcaggcgggagcagccgcgccgcgactgggcccctgcgccgtcggacctcctattggactcagatgcgtaccgtgggcgacagaatcattgttaggggaagtcttggacatgtcggtgagcggggtaagtgaacccgagagaagggaattccggtgctggctcggcttcactggggtaggttctcaagagggaacgagatgaggtttcagaaggagatggctccttatctcgatacgagagagaagcccatttgagaagatgggaaggaggggtagagtctaggagggtggcgaacccttagcagtcaagcaaagcgcatgtcccttcggacaacatatggggcatacccggatggagtacacaacggggcacacgcggcactgcactgggcccagacccacaacgccaaggtcccagggtcccacagaaacgcccgctggcgcatgtctagcgcttgcatccgacggctacctattacgccaaggacattcagacggaaccagcgctgtggcaaacaatcaacaacgggggccgagacgcgggggaactcagaaggattacccacttcgcggaacatccacgggggcaccagtcaggggattgggcaggggggggcacacgacaccacggcaagattgcgccgacagggaacggactaatcgaacatcccggacggcgaggcatgagacggcctaacatcccacgaggccagcaccggagcggaaaccgaagagcgaaaccgtacggaacccatggagacacagccgaaaaacccgtacggagccatagaccaaggagcagaaaacgcaaggctacacaccaacaacggcggcgaacccccacgacagacaaaaacgcagcacgaacccagcccagcaccgaacacgtccctgcacccccaacgatgaaaaggaacccagacaaggctccgccgaccccaacatcaacagcccacaccccaacaagagaagaaacgcgcagcccagccaggcaacaagcccggagagaagaaaagaaacagccaaaaaggagaagaacggaacgcatacccaccgcggcagagaggacacacacaagcggcaaccacaacagcaaacagaccgcccacgacgagcgaaatccaaaagcagcacacaccagcccggcccgcccccactcagcaccg

SEQ ID NO: 574884 - DNA, 774 bp, Homo sapiens
  misc_feature (13)..(13): n is a, c, g, or t
  misc_feature (63)..(63): n is a, c, g, or t
  misc_feature (80)..(80): n is a, c, g, or t
  misc_feature (106)..(106): n is a, c, g, or t
  misc_feature (108)..(108): n is a, c, g, or t
  misc_feature (115)..(115): n is a, c, g, or t
  misc_feature (122)..(122): n is a, c, g, or t
  misc_feature (125)..(125): n is a, c, g, or t
  misc_feature (129)..(129): n is a, c, g, or t
  misc_feature (136)..(138): n is a, c, g, or t
  misc_feature (142)..(142): n is a, c, g, or t
  misc_feature (145)..(145): n is a, c, g, or t
  misc_feature (150)..(150): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (165)..(165): n is a, c, g, or t
  misc_feature (174)..(175): n is a, c, g, or t
  misc_feature (183)..(184): n is a, c, g, or t
  misc_feature (189)..(189): n is a, c, g, or t
  misc_feature (214)..(214): n is a, c, g, or t
  misc_feature (217)..(217): n is a, c, g, or t
  misc_feature (229)..(229): n is a, c, g, or t
  misc_feature (242)..(242): n is a, c, g, or t
  misc_feature (248)..(248): n is a, c, g, or t
  misc_feature (275)..(275): n is a, c, g, or t
  misc_feature (302)..(302): n is a, c, g, or t
  misc_feature (327)..(327): n is a, c, g, or t
  misc_feature (335)..(335): n is a, c, g, or t
  misc_feature (340)..(340): n is a, c, g, or t
  misc_feature (342)..(342): n is a, c, g, or t
  misc_feature (344)..(345): n is a, c, g, or t
  misc_feature (355)..(355): n is a, c, g, or t
  misc_feature (376)..(376): n is a, c, g, or t
  misc_feature (380)..(380): n is a, c, g, or t
  misc_feature (396)..(396): n is a, c, g, or t
  misc_feature (413)..(413): n is a, c, g, or t
  misc_feature (417)..(417): n is a, c, g, or t
  misc_feature (419)..(420): n is a, c, g, or t
  misc_feature (444)..(444): n is a, c, g, or t
  misc_feature (553)..(553): n is a, c, g, or t
  misc_feature (627)..(627): n is a, c, g, or t
  misc_feature (634)..(634): n is a, c, g, or t
  misc_feature (651)..(651): n is a, c, g, or t
  misc_feature (655)..(655): n is a, c, g, or t
  misc_feature (773)..(773): n is a, c, g, or t
ctgttaagatacngacagccagtatcatcctgagcactgaggtatgctttccatggccgaganccagccctactcattgngatggtctggatgttcactacttgangngccatcnggggggngtnaggntggaatnnncccngcnaaggnaacactngcngangngcaactttnnggctaagnnaagtnttctcaaaataatcagcagtaagcnggngattggggactngcatgaggggtcnagaatnagggagttcttgtaccctctccttgtnctcttcaggaatcaagggtcctgatgnggcaaaggatgaagttttaggaagntctgggtnaaaangntnngccccctggnatttagagatagtagcccagnaggntttgccataaactggnaccagtgtgttgaagtntgangnncagctattcacaggtctttctgcnggatcctccaaaagtccaagagtagggtcagatttagggctacacagaatccgcttaacttcatcaatgccaactaagaggaggcgataatagaagagacctcggtccngtacagccatatctttttcttcctctatgcagtaatacaacaaacgtcctagcatgtcctggcactcagcaggnggggggnggaaaaggcgccgaaanagtngagcagctccatcttaacagctggaaatgtttccgacttcacattctcaacaaagtcctctaacacataaggagcattaggaattctttcccatggacaccaagtagcaaataagtgnt

SEQ ID NO: 574885 - DNA, 98 bp, Homo sapiens
gtccactcaggtccattcactttcaagtttaacaagtctcacttcccatcagtgatttctcagcaaaggaaagccatgctgattctgtgttcattcac

SEQ ID NO: 574886 - DNA, 114 bp, Homo sapiens
ctcgtcgatggatacagaaatcgtcacactaagagcatgcacacaccagggatgagaagagctatcatctgtcatctgtcgtgtccggcggtgaggttccgtgttgagtcaaat

SEQ ID NO: 574887 - DNA, 296 bp, Homo sapiens
ggggcccccttttttgggggggggggggttttttttttttccctggttttctaaaaaccccttccttttagggggggtgttggttccatttttcaaacccgctcccttaggcaaaggggttgttcaaagggttccatggggcccccccttggtttgttttggcaactgccccccccccggcctgcccccgggctggttccgcattaaggggttttccttttcaaggatggccggggcccccccccaaagcgggcctgtcccccccccccctggggattaattgggaggtggggcca

SEQ ID NO: 574888 - DNA, 724 bp, Homo sapiens
  misc_feature (24)..(24): n is a, c, g, or t
  misc_feature (286)..(286): n is a, c, g, or t
ggacgcgtgggtcgacccacgcgntcgcttcccggccaccttctgtcagaatcaatgtaccattgagctcacactcgccaacaaagtgttatgcaggcacagactttcactcatgtgggagcaactagcttgtgaatgaaagtagccagggtcgatacagaccgctccatcgatagctctttaacgaatggattgcgccagaatcgcatgggcttcaagggtgtgcgccatgaagtcttggcacgtgccgtgtgaccctgatgcgaggcccccgtggctccagttntagctggttgggccatcggtcgataagcagtagttgtgctgtctgttcgggcctccttcgagcatccgacttgttgacgggcgttgggctcatgccgtaggtatcggaccccagtgggcgctgggacctagccgtatgattccaacaagaaccattgcttacacccccgggtgcagcgctttgtgctgtggcatggcttcctagcgcgcgtcgttacccttagggacttcgctatggccttgcccttgggttgggtccgggctggaacatcccggggacccaccatcgcggccttcgtaaccggcccaaaaatggacgccgccaacccccaagcgagacgacccatagcccacatactccatgtctcttggggaaacggaacatgaggggatgcgagaaaattcccccgccccaacgttaaccgaacgtcgaaccacc

SEQ ID NO: 574889 - DNA, 102 bp, Homo sapiens
  misc_feature (21)..(21): n is a, c, g, or t
  misc_feature (82)..(82): n is a, c, g, or t
  misc_feature (91)..(91): n is a, c, g, or t
atccgcgtgatgagcatgtanctcaatggtgccgtccagcacaaggttgaggagtgggtcgaagcccttcaaggattccacntggcttcgncggccctccct

SEQ ID NO: 574890 - DNA, 362 bp, Homo sapiens
cacttaccctaagctagaactataattacccccactcccataaatcttctgctatgtctgttgacatggagtgtctgctcatatctctataccatctccaaattcaaaggaggctaacatgattagcccaagtgaaatgtggggaaggtgaacgagcaggagccatgcatgagtttccttgggtcacatctttctcctcagggaggtggcgccagcgtctcatggctcaggttccaagatgttagcgattcacttggcctaggcagctggcaggtgaccaggcaaaggtcagcaccaatggtcccaaagagccggttgccacccacttacctagtgcccacaccaagtgattgttccccgct

SEQ ID NO: 574891 - DNA, 264 bp, Homo sapiens
  misc_feature (87)..(87): n is a, c, g, or t
  misc_feature (119)..(119): n is a, c, g, or t
gaattcgtgagaccgggcatgtgatttgagctgggcatgattgatttgagctgggcatgtgatttgagctgggcatgtctgatttgngctgggcatctgattgatttgagctgggcatntgatttgagctgggcatgattgatttgagctgggcatgattgatttgagctgggcatgtgatttgagctgggcatgattgatttgagctgggcatgtgatttgagctgggcgtctaatttgggctgggcgtctgatttgggctgg

SEQ ID NO: 574892 - DNA, 1110 bp, Homo sapiens
  misc_feature (27)..(27): n is a, c, g, or t
  misc_feature (54)..(54): n is a, c, g, or t
  misc_feature (147)..(147): n is a, c, g, or t
  misc_feature (153)..(153): n is a, c, g, or t
aaatacatctctaggttaaaggagttnggatcataatacaagagaagcacaggncaaagacactgcataacctcaagaactaagaatggaaggactggccaggcctggtggtgcacacctgtaatcccagctactcaggaggctgangcgagngaatcgcttgagcctggggggcagaggttgcagtgagctgagagaacggcgggcggcagagcgagactccatctcaaaaaaaaaaagggataagggaaggacttaagcaaaatcttcctgtgtaagtagaaggatgttttggacaagaaaagttggcaatgggaaaaatgggtcctcatggtccacggagttttgtagaataaggcatcggggtgggggatgggattcagatcaaaacatggctttaatggtcggggtcttaaatacgggggggagtataccctgggtggccccagggatcgaacgacttgaccttggacccatggtatttttaagagattactcacagataacaaaaaggtatttgcatcatggattagttggggaaaacagggttaatttcacatagggtaaaacgtgcagtcctatgtaatcggtcaagaagggtaatcttaaattataggctgggggggtggcttaaactgggaagcgggccaagtggagggcacgaatcctcctgattcaacctttctaccttataactttcctggacctgtgagctggcaagcttaaactccagggggattaacagggtcaaccggggcgttccaaagctgccagcacctgacacgacaaaacagggcgagggcatcccaaggcgcggacgaggggtccaagaacacccgggggcccccgaaaataaataaaatccccactataccggtggcccaggagcaatggttggaccccttgtgaagggcccccgtacggggaaacacacccgggagtactaggtggagagccctcaaattaaagaaaccgcgccacgctgccaagagggatcacggtggtgcaccaaaccctggggggccgcaaaagactacgttagcattgcaccagcgtttacgaccgcgcaccggggagaccaccacctccaataacaaaaaaacgacggcg

SEQ ID NO: 574893 - DNA, 591 bp, Homo sapiens
ggtgacattgcaccgcgcccctcgtggggtcgcgtagcatgccatgcggactccccagctggcgcgctactaccatgtggctgtgctggtcagggccccagacccgcttcccacctgaccagccatgggggctgcggctgtttaatcgcgctagcactttcgtctgcgttcggcccggccttcgcgcttttcttgcatcactgtggctggggacccgcttcgcgttatcatcctggtcgcaggggcatttctctgcgcaggtctccctgctcctggcctctgtggtctggttcatcttggtccatgtgaccgaccggtcagatgcccggctccagtacggcctcctgattttgaggtgctgcatgtctctggtccttctacaggaggtagtaccgctttgcctactaacaagctgcttaagcaaggcagcatgacgggttagcatcgctgcagtgaggacggaagatcacccatctccatccgccagatggcctatgctttctggctctctccttcggttatcatcagctggtgtcttctctgcttatcaatattttgggctgatagcacttgggccaggtgatggattgg

SEQ ID NO: 574894 - DNA, 114 bp, Homo sapiens
atctcagctcggcaccctgctgatcatcagtggagtgaatgctttttcattcaaaccatacacttgcccaaaaattccaaacaaagacggcttcggcaaagccgcaatcaaggt

SEQ ID NO: 574895 - DNA, 1282 bp, Homo sapiens
cttttatgtgtctctgctgtttttgtgttgtggccgtgtgttgtctctctccgtgtctcctcggtgtctatcgatgttgtggctccgttgtctggttttggtgtccttcttgttcccctgtttgtggtcccttgtcctttgtcttcgctgtgattggtctcttgcttttgtttgttgattctgtgtccttggctcgtgttggtccctgtattctccttttgtgttggtggtgtcgggtcccctgtttggggtgagccttttttctagtggctactgttttgtgtattggatgcctctgggatatcgttctctgatcgtctgttctgtgccccttattagttcatattggttacttgttcttctcgcttggcgatcctatggtacattataccaccggtctttcgatgtatctttgtatcgactgggttatcctctgtcgacctacatgtgtgttttcgactgtcttggcccttgcaatgtgtgtcagtatatgtgttttatcttggttccttgtcgagtcgtttgtcgctctgtgcgtctatcctatgcatagagtcactttgatcttatatcgggtggtccctcatgttccatgcctatatcgtttcaacacgttaccatgtccccgctgaatcattcctctagtgttccttggacaattctgtttctgtcgctcgttttattgtgtgagtatgcaggtactccttcggtcacgcttgtgctgtttatgcctggtgcggagtgctgtttatgtctactcctacgaggcgagtccatggttcctccatgtggaagtcatgatgccttgtgatgctggtctattcagtctgtggttgctgggccttgtgtgtgttttgcaattgttgtcaccttggatgcttgggcatctaatccattccaatgccgccgcatcgcttgtttccacctcctgggctcggggctctggctcccctaacgtgtctaggtagagctttctcccttagtatcgtcactgtgggccgggtgctcctggagggcatgctctgtgttaataagattgtataggtttgccctcctctacctgttgccggcatgcgggtagctatgagccacctcccctcctatctgttccctagcactcggagaagggggtgctcaggtgtaggtgtggggtatgcatcctgagctcactgcttcgcgcctgctgctctgccccaactgcgtatccgcttcccggctgccctagagtggcatggatgcctgcctggtccctcgtagcatagcctgggtacatcgagttaca

SEQ ID NO: 574896 - DNA, 123 bp, Homo sapiens
tctcccccatcctcccacaaaagcaagcaagatacacaaagtaccctgtcacaggctcataccttcagagcaagtgatgctgaaggttgagcaaggtttgttaagtgaggagagaatgggggt

SEQ ID NO: 574897 - DNA, 659 bp, Homo sapiens
ctgctagagaatggggtcgcacgtatggttcgacccaggcatggtccttgaacttccatgggactacaaagtcgactcagctctcatgccgctataggccttccccaacgttgcgtgggaattacaggtcgtgagttcatcatgcacctctggccgtcagacacgggtttttattggagtaaaataagcacaaccggctgcggtgaattaattttttgtaaccaaccttgttatttatgagtgtggtgcgcatcattcccgagctggactcgtgctgatacctcactacacagaccctgaggcactctttcccattcagcacgacgtcgcgaaacaaccatcctcaggcctgttaagacctctagaacctagggcctgggttaggagtgcgctaacgctcatggaagtcccagcactttgggagtgctgaggcaggtgaatcacctgatggtcaggagttcaagaccagtcccggccaacatggcgcaactcacatctctactaaaaatacaaaaatgatccgggcgtggtggtgggcgcctgtaatcccagctacttgggaggctgagacactagaatcacttgaacccgggaggtggaggttgcagtgagctgagatcgtgtcatgcaccccagtacatcctgctgtcaaacaacac

SEQ ID NO: 574898 - DNA, 448 bp, Homo sapiens
  misc_feature (135)..(135): n is a, c, g, or t
  misc_feature (231)..(232): n is a, c, g, or t
  misc_feature (263)..(263): n is a, c, g, or t
ccaaagaaaatgaagcatgaacttgtggaggattctccaactccggccaacgttgcagctcttcacccaattcctcagcctctgcagtgctggcaagtgggggcagatggctgtttccgtgggggccgtcctccngacgtgggacctgtgcggcacccctgggcctcacccaccagaatgccaggagcatcccaccccttgtgacaaccaaaagatgcctgcagtcactgnntgagtgtcccctgggggggaccactgccacnagacccagggcagcagagggcttatgacattgatgtggcttcaccaggcagcacagaaacagccaccacatttggtagaacacgagtgagtcgcgccgtccaacaagattgccagaattaaatcactggtttagattaaaaaaaaatttgtaaaactccaattaaatatacaaagacaagaaaaa

SEQ ID NO: 574899 - DNA, 160 bp, Homo sapiens
aggctttgtacttaaagtgtaaaaagacgtgtacgtccgattcggatcggcgcgtccccgaagagggacggggacgagcgacgggtcgcgcgagtcggtaccaccgaccgtctgaacacgacagagttacacgcggctgcggagcaggcggacatggccg

SEQ ID NO: 574900 - DNA, 674 bp, Homo sapiens
ccataatctaggatgagcagatgtggaggccgcttactgtaaatgcccagggacatcaacagcccctactacccaggccactacccacccaacattgactgcacatggaacattgaggtgcccaacaaccagcatgtgaagtgtgctgcttcaagattcttctacctgctcggagcccgggctgtgcctgcgggcacctgccccaatggactacgtggagatcaattggggagaaatactgctggagatgagtgtcccagttctgtcgtcaccatgcaacatgcaacaatgatcacatgttctgcttccactcatgatcatgtcctacacctgacacctggcttcttagactgaataccatctcctactgactccagttgacccaatgccctgtgtggcatgttcactgttgcctgcactggtggctggttgtatcctgtgaatgggagcttgcgcttgtgatagtgcttgggcctgacttgcacctgaccacatgctgattgagctcaaacttggcaatgtttgcacgaacgctcagtgccaaccaggttacaactgttgcacaggaaacaaggtatcttgcaaagacccctcattcttggtgtccttgcgaccaagttgttgaacaggacaaggctgtgaggaccaaccaagctgaaacgatgacaggtgga

SEQ ID NO: 574901 - DNA, 596 bp, Homo sapiens
  misc_feature (67)..(67): n is a, c, g, or t
  misc_feature (545)..(545): n is a, c, g, or t
  misc_feature (576)..(576): n is a, c, g, or t
  misc_feature (590)..(590): n is a, c, g, or t
  misc_feature (596)..(596): n is a, c, g, or t
atgcatgcattaaattcaaagtctgactgtcaaatcatttcactttaataaaaatttgaattacctncttagggcattattaaatatcaaataaaaagtacacacacataagtctgattcccaatataatttttatatagaactctgaccagatttgtattacacatttcaagataaaagtattcataaaaaaatgaaataagaattagtcaccttagaattcctgtaccattcttaggaatttgggagcaaattatcccctttaagtaatctcagccaccaaagtaagaacacaaatatatcttccttttagaaatagtacctaaattgtaattaactcaaaactttgaaaaactacacattattcatctatcatataaagaatatggaagtatgtgaaatatacaaaatctcataaacaacatttctctgtgtgtgtgtgtgcgcgtgtgtgtgtaaaagagagagataaaataataatagtcatttagatatttagagaatggcaactctgggtctaggacaagatacaaaccaaacattcnaggggataatctcccttcattaaaagtatcntttacagggattgncattcn

SEQ ID NO: 574902 - DNA, 327 bp, Homo sapiens
tcgacaagcactgtggaaaaaacagtttagcattgtcctcaaaaagttaaaacaggccaggcgctgtggctcacgcttgtaattccagcactttgggaggccaagccaggtggatcacttgaggtcaggagtttgagaccagcctagccaacatggtgaaacctaaaaatacaaaaaattagccgggcatggtggcagacacctgtaatcccagctactcaggagactgaggcaggaaaattgcttgaacctgggaggcggaggttgcagtgagctgagatcgcaccgctgcactccagcctgagtgacagagtgagactctgtgtg

SEQ ID NO: 574903 - DNA, 356 bp, Homo sapiens
  misc_feature (38)..(38): n is a, c, g, or t
  misc_feature (342)..(342): n is a, c, g, or t
tcggtaccaagcttttaccgcacatgccactgcttggntttcaaccatcctctagcacattctgaggatcattaggagcatattagaacatgaccattttatcttcactttaccttaaaaatatttccataaggacagtcatttatttgcatgagttggttttaacataaaccctaggggcagtcagctgacctgttaagtccacttgggatgaataccctctccagaggtgggttacacagcagtctgaactgcaaatcaaaagcccactctccaactacctttatctgtaccagccaagttaaagaattcagataagaggatgaataatatttttttttnggcggtaaaagctt

SEQ ID NO: 574904 - DNA, 136 bp, Homo sapiens
  misc_feature (33)..(33): n is a, c, g, or t
tcggcccaattgttgtggtacagtgaatcaggnatttgaacacaccaagtatctataaacctagccatggcgatccccttatgagcgggcgcaatgattataggctttcgctcttagattcaagaagtgccctaga

SEQ ID NO: 574905 - DNA, 115 bp, Homo sapiens
cagttatttttgcagaggaaaaggcggtggcagatacaagagatcaagccgatgggagcagagcatctgtggattcctggcagctctgagtgaacaaggtgggtcagaacataag

SEQ ID NO: 574906 - DNA, 147 bp, Homo sapiens
ttaccggagcttatagaggcaccaaggagggagcactctcatactgcaaggagtgacagtgcctagggctctgatgtgtctctcacagcttgtaaaagtgtgagacagctgccttgtgtgggactgagaggcaagagttgttccctg

SEQ ID NO: 574907 - DNA, 165 bp, Homo sapiens
acggtggaggcacttgcttgccttgccggggcccggtgttggtggcctcgctcggccgtgcggcggacgaagccgtgcttgcagagcccccagtgggctgatgcgggcggcgggctcatactccagcattgcgcagcaccagttctttacctctgtccgagggta

SEQ ID NO: 574908 - DNA, 435 bp, Homo sapiens
agaagcaagggcctttgagataaccagcagtaggaaaccagatgggttggaacagccttcccgtcaaaaacagctaaaaaagctggacaatataagaaaatatgtgtttgaaggcatagaagactaaagaagtgaggaattgtgggggtaaggtcaggagaggaaggaaatctagaaatgatcccagctttgggggccacttttccttcctagatgagtttacctgttctgacaacagagaggctaggaagctgaggagagctttctacaaactcacagggcagaggggacaaaatttagaatcctgccaaagaggaggcaccctggcaaacatctcagggtctgtgctgggacccagaagtaagagtgaactagaccttcaactgatttctacaatttcttatgttttgctcatgatcaaaaaagccaagtgta

SEQ ID NO: 574909 - DNA, 769 bp, Homo sapiens
  misc_feature (46)..(46): n is a, c, g, or t
gctcagcattggggacgctctcagctctcggcgcacggccaggttntcttgtagcgtagaaagttcggatacactctacccggagagtttgcccgcttggttgaacaaattggcctcaggaatggctgtccttcgaaaatgtctactgttcacgaagatcctggtgcaagctcagcttggagggtgatcactctatcaacccccaagtgcatatgggtctgtcaacagccgtatactaacttggatgctgagcgggatgctttgagacattgaaacggccatcaagaccaaaggtgtggcctgaggtcaccatggtcaacatttgggaccaagcgtagtaatggcacagaagacagggatatggccttgcgctaccaagagaaggactcacatacaaggaagcttgcatcagacactgaaagtcagccttgatcgtggcagccgtggagacggtgatcttgggcctagtggaacgacatgctgctcaagtatgacgctgtctgagctaaaagcttccatgaacggggctgggaagcgagaggagtctctgcatgtgaggataatctgtcgagaataagcaggagttggaggaaatttaggagaagtctacacaggaaatgtacaagaatgatctgggaaggacattatttcggaagatttggtgaatatccgcaagctggtggttgccgggaagggtagaagagaaggatgtcatggatggaattgaatggtggcccgatggcgggatctataagttgggtggaacacg

SEQ ID NO: 574910 - DNA, 286 bp, Homo sapiens
cggggggggggttttttttcccggggtttttttttttccccccagtttggttgggggcccccccccccgttttttttcccccctttggggggcgggggccgttttccccctcgggttttttttttgggcggggggggggtttcttttttttccggggggccgttttttccctttgggccttttttgggcccctttggccccgggttttttctttgggggggggggggccgggtggggtttttgggggtttttttggcccccggggttggtgtaaaaaaaagggtta

SEQ ID NO: 574911 - DNA, 429 bp, Homo sapiens
tatcagtgtgacctacgaataacacactggccgtcgttgaacatggagacttcactgcagatatctgtagaattccagcgagacctgattactctacttttgggatttgctatttcctcttttacatctgggaagattccatccagacccccagctgcagaggtgccctctctgactgagaacatgagaaatttctcactcttttaagcaaatcttactactgtggtcttaccaccatgttcttttttgcattcggtgaaaatgaaagccctttttatttatattttctattccttgagagtctgagtagatgtcattaatcatggacttgtatatttaaaatagattttaatacttggctgagcatacttttcatgtgtttggagagctatttggtattctttagttctttatttttgccctggtgtt

SEQ ID NO: 574912 - DNA, 294 bp, Homo sapiens
ggaccgtgacatcggcgttggggtctcggcgtgtgccgtgaagatcggcgatttcggcctcgtgaagatcggcgactttggtctggacgtgaagatcggcgataatgcattgacttcaagaagtgtatggatcctcggcgtgtgcagtatggattttcggcgtgtgcacgtgaagatcggcgattttggtttcgtgaagatcggcgattacggtctggttactcggcgtgtgcaacacgccgaagatccataccgtagtcgatcggcgactttggtctgggcactcggcgtgtg

SEQ ID NO: 574913 - DNA, 356 bp, Homo sapiens
atttcaacattccatcaaaggacattgaccgtgtaccatcacaagtcagaagaggcagatgtggcgcattttttatgttaagtctacttatttcaggtagggaccaatacaaatgaagccctcccctgcgccagaaataagtagtaacagtctgggaaaagccctttcaaatttcacaaaaagcataaataagttattattcctatttaatgtagtaagtagggtaaagatcatgggactctcattcttgactgggctttattaaccagtaatctgggccctacaaagcgtgttttgcgtgatgtggaattcgcgcctgattttaaatggtgggttttcctgtgatttatacacat

SEQ ID NO: 574914 - DNA, 393 bp, Homo sapiens
  misc_feature (98)..(98): n is a, c, g, or t
gtgaatttttcttcacaccacaccagctcgtatctcctccttggaacactcttgttgttccctttgtgttttgtgcggagttcacgggtgccttcagnagggtgttgtgtgggagggccgcagtgctctgttagaagcagtatttctcacctttacaccggcttcatttctcttgtggttttacccttctgtttctttcctgtgctcagtccgtttttcttgttctatgaccatttctggttttaattttaaaattttggttcacgttattcttaatttattttcatgtatttattttgcatgcttgggcgtaattgaattcagggccttggggctcaatcttctttcccgtagttgaatccccaggctggaaagctgctggaaagctgctgg

SEQ ID NO: 574915 - DNA, 136 bp, Homo sapiens
gaatgggtggccaggtggctcctggaaacgctcacccagacacagctgccctgagctctgggcccttggtatctgtccctggggatattaatattgaataactttttactatcaatacacagagaaatagccacta

SEQ ID NO: 574916 - DNA, 500 bp, Homo sapiens
  misc_feature (177)..(177): n is a, c, g, or t
  misc_feature (426)..(426): n is a, c, g, or t
  misc_feature (468)..(468): n is a, c, g, or t
  misc_feature (481)..(481): n is a, c, g, or t
  misc_feature (497)..(498): n is a, c, g, or t
ccaaaaaagcaaggagttaggacccccagtcctgccccccaggaggacaagcagggtcccctcaatcaaggcaatgggatgggcggctgaggaacggggcaggcaaggtcactgctcagtcacgtccacgggggacgaaccgtgggttttgctgagtaggtggagctcattgctttntccaagcttggaactgttttgaaaaataacccaaagggaaagggagagccccctgggacttgtcccccctgcctcctctgttttgaaattccatcccccccaggttaggggaaagcccctttttccctttccttttcacttttgcatgtttttactgatcattcgaaaagctaaccgttttcagccctgagccttggaaaggagggctgtaaccccttcagtcagtttctggggatgaaacttttaaangctttggaaattttttccaattagatctcttttcaaaagggnttataagaacaanaaaaatcttttacttnnga

SEQ ID NO: 574917 - DNA, 386 bp, Homo sapiens
tgtgctttgatgtgcagacacgagaccctcccagccaggcggagccccgttagtgccctgagtgccctcagaccccacatgccctgtgcttgcactcccagtgctgcagaccctgatgcggcatgtctggcgtcatgatgagcttggatgaatcacagtgtgcgtcagcattgcttgttctgaccttggagtcagcctcacaatgccttcaacctgcttccttgcatgcctcgagccctggggcactaagccctatgcacagacagggcagagtcttgaggctgatgtgctcctggtcccactgtcctgccacgacaggcctgtggatcatccaacacacactcacgtgtcttgcatgctgccttgtcttcgtgtcttgcctcaac

SEQ ID NO: 574918 - DNA, 846 bp, Homo sapiens
aggaaacggaggtcgcatctgagtcaagatcatgccactgcactccagcttgggcatcacagtgagagctctgtcaaaagaaacaataaaaatgaacatgcttaaagaggtaatttagtccatcattcttatgcctgcatatattgaaataaacttggaccgcatctggttcttccagcgtaatgctgtagagatttcaagatgtgcgatggtacaatgccctatggatcatgctaggtgcccgtcgctctgaagctagcgggtatagcaatgggcatggcagaagagaccaatcagtatcccaagctcagccactggtaagagaggagtcacatcatatagacttgtgtttacgacgttttgggtgagccacgcaccaagttgtctggaatcgcactatctggtggttaaaacatatcgtaatagacggaatccctgagtgctgaggcagtactactcaaaatcacgatttatgaatccctgataatgagaaagatctaactgacacacaatagtcgtgtcgagtcgcagagtccacacatacagtgtgtattaatctatgagaggagtggttggatgtgccaggttgggggtaaagtggtgactgcattctgagaaacggaggctgtgaggctgaactcttgtgtggctgccgttctgtatacttccaggaggtgagtcttcaagtacaggccccgtgctcgtagagagagtacggtaggcacctatgtcggaagtgcgtggggcttgctgcttgctgctgtgtgagatcggctttaatcaggattttcccctcccgggaggctggggatgccgactccagcctgtggcgggaccgatgcgggc

SEQ ID NO: 574919 - DNA, 179 bp, Homo sapiens
  misc_feature (42)..(42): n is a, c, g, or t
  misc_feature (75)..(75): n is a, c, g, or t
  misc_feature (89)..(89): n is a, c, g, or t
cggcggtggacgaaatattccccgagggcgccgggccctacntggacctggacgaggcgggaggcagcaccgggntcttaatggacttngcagccaataaaaaggccgttaatgcagacttttttaacgattttaaagatctttttaatgatgatgacatccagtaaaatgccctctgg

SEQ ID NO: 574920 - DNA, 275 bp, Homo sapiens
gaatagaggaagaaaagaatgcgtttgctgaaccatggagatatatgagtgtctatgatgactccccagagatgtatgagacaatctctcaagaatttcttacaccgggaaaactggaaattaagtccgtagaattattgaaactacatatggaagaagaaaaacgacgatcataggaggaacggaagcataagctagaaatggagaaacacgaatgtgaacatctgagacaggaaatgggagaggaagaggaacacaatgatacctttggattg

SEQ ID NO: 574921 - DNA, 391 bp, Homo sapiens
  misc_feature (50)..(50): n is a, c, g, or t
atcaagtctgcagagaccaggacttttgacaccagaaacatatttttttnttgagacggagtttcgctcgttgcccaggctggaatccaatgtcgcaatcctgcaacctccgcctcccgggctccagcgactcccccgcctcagccctcccagtagctgggattagaagcacgtgccaccaggcatgggtaattttgggttgttttaatcaacttggtttcaaacagctttagattggcagaaaaactatgaatatagcaagagttcccccactttctcctttttttatttattttatttaattttttggagacggagtctctgtcgtccaggcgggagtgcgggggcgcaatctcggctcacggcaagctccgcctccggggttctcggc

SEQ ID NO: 574922 - DNA, 357 bp, Homo sapiens
acctcctaccccacgctatttgccaatgtgtagctacagtctcaattctgacaatacaaggtgtggatatagggctatatatctcatctcgattttcaaaagtagccaaaggcagttcttcagagcttagcgttgcctggctgacgctgaagattatgtaccttcatagcgagacccatgttgccagcgattttcaattcgccttgacagaaggccgactgagctttcattttaccagtcattaaagccacgaagtctgagtcagccattgtgattgggcagacagccttcttatctgagttaggaggcactgatcctttgccattcttcacatccaccacccaggcggtctcttta

SEQ ID NO: 574923 - DNA, 101 bp, Homo sapiens
tgagctggtaccatagcgaagacacggggggtggggctctcctctcccaccctacggggcctcagcaagggtgcccagggcaggagtgggggtgactccct

SEQ ID NO: 574924 - DNA, 218 bp, Homo sapiens
catgtgagtgaagagtgagacccttctcaaaaaaaagagaaagctgtaatccagcactctgggagtgctgaggtgggctggatcatgaggttaggagattgagaccatcctggccaacatggtgaaatcctgtctctactaaaaacacaaaaaatttgccaggtgaggtggctgggctgcctgtagtcccagttactcagcagtgctgcaaacagggt

SEQ ID NO: 574925 - DNA, 797 bp, Homo sapiens
  misc_feature (53)..(53): n is a, c, g, or t
  misc_feature (64)..(64): n is a, c, g, or t
actctgcgacgacgtgtgcgtgatctgtatctcgccgacgcgccccttggatngccgttgggangttccaaagcggtgtgcaggtgtataccagtggatcctccagactggaagaattcagcacgaggtcaaatttaactactatactcaattgatccaataacttgaccaacggaacaagttaccctaaggataacaacgcaatcctattctacaatccatatcaacaataaggtttacaacctcaatgttggatcaagacatcccaatagtacaaccactattaaaggttcatttagttcaacgattaaaatcctacataatctaaattcagaccaaagtaatccgaatcaatttgtatctacttgaaattccttcctatacgaaaggacggtacaaataaagcctacttcacaaaacaccttcgcgcagaaatgatatcatctcaacttaaaaaaaaaaaaacttaaagcatctaataagaaaaaagttaacaacataaatataaaataggatctgggcgtggattgtatgaaagatagtaaaaaaaaccctaaagagggacccaccgcccaattccgccttaaaaaaaccgggttacaagtggctagcccacagttttaaaaaggggaaagatgaaaaaaccgtgctttacccaactttaaatgccctgttaagaaattcccttgtttgccagttagcggaataacgaaagaacgcgcgccaataaccctttgaaaaaagttcacaagcctcaattgggagtatgcaatttttcaaccgtgaagattttttga

SEQ ID NO: 574926 - DNA, 768 bp, Homo sapiens
  misc_feature (28)..(28): n is a, c, g, or t
  misc_feature (73)..(73): n is a, c, g, or t
  misc_feature (98)..(98): n is a, c, g, or t
  misc_feature (130)..(130): n is a, c, g, or t
  misc_feature (151)..(152): n is a, c, g, or t
  misc_feature (165)..(165): n is a, c, g, or t
  misc_feature (167)..(167): n is a, c, g, or t
  misc_feature (173)..(173): n is a, c, g, or t
  misc_feature (184)..(184): n is a, c, g, or t
  misc_feature (195)..(195): n is a, c, g, or t
  misc_feature (199)..(199): n is a, c, g, or t
  misc_feature (202)..(202): n is a, c, g, or t
  misc_feature (211)..(211): n is a, c, g, or t
  misc_feature (219)..(219): n is a, c, g, or t
  misc_feature (221)..(221): n is a, c, g, or t
  misc_feature (225)..(225): n is a, c, g, or t
  misc_feature (233)..(233): n is a, c, g, or t
  misc_feature (248)..(251): n is a, c, g, or t
  misc_feature (281)..(281): n is a, c, g, or t
  misc_feature (287)..(287): n is a, c, g, or t
  misc_feature (347)..(347): n is a, c, g, or t
  misc_feature (400)..(400): n is a, c, g, or t
  misc_feature (402)..(402): n is a, c, g, or t
  misc_feature (411)..(411): n is a, c, g, or t
  misc_feature (415)..(415): n is a, c, g, or t
  misc_feature (418)..(419): n is a, c, g, or t
  misc_feature (521)..(521): n is a, c, g, or t
  misc_feature (535)..(535): n is a, c, g, or t
  misc_feature (566)..(566): n is a, c, g, or t
  misc_feature (571)..(571): n is a, c, g, or t
  misc_feature (573)..(573): n is a, c, g, or t
  misc_feature (579)..(579): n is a, c, g, or t
  misc_feature (585)..(585): n is a, c, g, or t
  misc_feature (587)..(588): n is a, c, g, or t
  misc_feature (611)..(611): n is a, c, g, or t
  misc_feature (642)..(642): n is a, c, g, or t
  misc_feature (762)..(762): n is a, c, g, or t
ttagattccgattaaatgaaaatcattntgttacctcagatcctgacatacacaatgaaaggattggaaagtnacataaccagttgcgacttaatgantcatcctttgtaaatattagaatgagggaacnaggatatgactaggaagaganncaaggggtaaaancngacgantctggcccatncctctgcagantcanggncccccagcngaggactngngggnggggcgcngaagcaaagggctgnnnngaaaatagtttgattttgacacaatggttngcaganaaggccagccaccgtggagaaaagatagagaatgaagaagttccaaatggctaagatgancatgaacttctaaacagaatgaaagctctaggattatgtccactttaagaggncngcggggganatcnggnnttagaggcaggtaatgtcttttgacaccctttcttcaaagaaaggggtaagggaaaacaagaccaaaaaaaaaaaaaaacaccttctcaggccaggcctggnggctaacacctgtnatcccagcactttgaggaggctgagaggggnggatnanaaggtnaggagntnnaaagtgctgggattacaggcatnagccactgtgcccatgcccggcccaacttangtttcatctaatgaccttattaagtgttcacttttcaaaggatcttttaacttcttctgaatgaacattagtcagctgcccctcccactagccaatctttagccctgagcacacatgggnataaaa

SEQ ID NO: 574927 - DNA, 133 bp, Homo sapiens
cgctcccggaagatgcagttcaagccgatggagatcagcccgagatgctgaacaaagtgctgtaccgggtgagggtcgcggccagtggcgcttcgggacgtgctggggtggaaagaggacgtcctcttggggc

SEQ ID NO: 574928 - DNA, 143 bp, Homo sapiens
aaccaaggtagatgacaacaagaaactaggagaatgggtaggcctcttgtaacaatcgacagagaggggaaacaccgtaaagtggttggttgcagttgtgtagtttaagaagagctattcatcactgtacttattattatttt

SEQ ID NO: 574929 - DNA, 669 bp, Homo sapiens
ggtgctgtctagaggacccggctagccactcaccaagagacgtacacaggacaggggatcgggtaagaagaacagctgtcatcaaagaaacaaaagacagagaatgtcttcgtagatgaaaccccttattcgtgcaacgtacttatattcctttgatggataatgctgactcaagtcctgtggtagataagagagaggttattgatttgcttaaacctgaccaagtagaagggatccagaaatctgggactatgaaactgaagacagaaactgacaaagaaaatgctgaagtgaagtttaaagattttcttctgtccttgaagactgtgatgttttctgaggatgaggctctttgtgttgtagacttgctaaaggagaagtctggtgtaatacaagatgctttaaagaagtcaagtaagggagaatagactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaatgggaacattagaaaaggaacataatgtatttcaaaacccaatgcatgtcagttatcaagagactcaacagatggcgatgaagt

SEQ ID NO: 574930 - DNA, 173 bp, Homo sapiens
tttttttctttcgttaatctgtagatattaatatatatggaagcttgtttctcccaaggtgaacactttggagagaaaatttgctctcattgctgatttatgaactgcagcgtcagaaaccagcattaatttggagttaatttttccccaaagctttgcgtttacttacagtc

SEQ ID NO: 574931 - DNA, 160 bp, Homo sapiens
taccgactccagctcggggttggcgagtgcacggccggtcgcccagggacctcagcatgaacaacctcacagagcttcagtcctggcctcttccaccacctgcgtcttcttggagcgagctgcgtctcttctgggaacctatctctcacatcatcccagg

SEQ ID NO: 574932 - DNA, 1066 bp, Homo sapiens
gatcaacttgatgaaataaagcatacagacaagattagagcaaacaaagactgaaaaggaacgaacagcagcctccaagaaatatgggactcttttaaaaaagattaacaaaatagaccactagccagactaataaacgaataaaagagagaagaatcaaatagacacaataaaaaaatgactaaaggggatatcaccactgatcccacagaaatacaaactaccatcagagaataccatagaacacctctacacgaaataaactagaagaatctggaagacatggctcacattcctggacacatataccctcccaaaactaaaccaggaagaagtggaatccctgcacttgaccaataacaagttctgaaattgaggcagtagttaactagcctaccaagcaaaacaaagcccaggaccagacggacttcacagccaatattctaccagaggtacaacagaggaggtggtaccaatttccttctaaaactattctaacacaatagaacaaagggggactcctccctaactcatatcatgcaggccagcatcatcctgataccgaaacttagcagagatgtgcaccacaccgcacacatttcagggcccaataatcccgtgatgaccattcaatgtgcaaaattcttcactcacacaccggccgaatgaattcagcacgcggttcacaccttatccacaatgaaacacgtaggttactcccggtgatggcaagccggatcactttacaccatctcatcaactttactcccttcactcttcaaccctccaaaaacccatatttactcactctatcccaaaggcctatatcaattctcccttccccgctactacctctaatacaccactatcacacctcccactatccaccccttttacaccacgaataaccactgcaacacacccaccaccaagccacacaacgccacaccctctcattcgaaccgccagaatcataaagataacacacaaatactaataccgacacaccctcactacatctataaaaacaaccctaaccaataccccccacaaatgatccatcaca

SEQ ID NO: 574933 - DNA, 1201 bp, Homo sapiens
  misc_feature (218)..(218): n is a, c, g, or t
agtgagctgagatcgcaccactgcactccagcctggtcaacaagagcaagactccatctcaaaaaaaagtttttgtctcttttttggatatgtatgtataaccaggatctacggttaagacagttaagacagaagtgatgtggaataagtagttaagccctctaagaagaacttagaaaatagtgggaggctaggcgtatactctagtggtgtacacnagtggccctcgagcttataattctcattagccccttggctaaagtgtggatatatagaccataatagcctcgttggtctccagaaagggttagtgccctgtgaaaatctccctataaacccctttggggcgcatatctttctcccaccctctctataactcaatgttcaccacggaagacaaaactgcttttctccctttgagaactagaacctcttttaagccgactcttcacttttggtctcccaagcacgggcttctcttcccaagcagaagcgggctacctacaacgcggcggaaacctacttcttcactcctctctatcaagaaggcgccgcgcctgcttttaaccgctgcggccaacataaaagggtacttggtaggaaatactcccacaccttatttagcgactgggcgccaaactaattaaagatttcttctaccgagccggcgggcaatccttaactacccaaccctttctcactagacaggacgcctcttcttactcgaaccggctctatcttaccccccagttgatttatctaggccgccctagcgctttgacaacacaccggcgggcaacaccaacccgttggcgcacacgcgtatactttcatcatgctccaatccccagccctatgtattagattcgctacccccacaccagactggagttaaatcgttgtcgtactacactcatctttgagacaacaaacacgcccgcgttctgttttcacttacccccggttatatatagcgtcgcggaagggcttgggatcattaaatatccttatgctatagtgaagtcactttcaacgcaacctgtctttaaaatacttgtggttgcccccaccccgaacaaaataatggttctacttgggctgaatcctttttaaaacgggcacgggtgcattttattaatatctacacaacactaaccactacaaccgtggctagaaaataacaccgccataagcctgtcct

SEQ ID NO: 574934 - DNA, 137 bp, Homo sapiens
ggtggtgatctagaggatcccggccttaccgcacattaccatcaccctctacataccgccccgacttagctctcaccatcgctcttctactatgaacccgcctattttacaccaaccccgcgcgtaagggccagcag

SEQ ID NO: 574935 - DNA, 747 bp, Homo sapiens
tccaattggagagcaggtacggtttattaaccaaccagtttagaaaaataatcagggtagaccaccttagttcattcttctaataagccggtggatcgggtcctcccgttgtggccagcatctccaccttcatacaaaagggggggtcctttttcttcattccacctcggggagaagacaattggaggggccacaggaagttattggcctcttggaagcgtttctccaacagtatagatctcatgaatcaaatcctccagtgcagatgatgccgtatttaccaagagatcgagcaatcaagagcgtaatcggtcaaagcaatgcgcttcttatggatttggccataaccacgctggtagataagtgcattatagggacttcagatgggggtacccccaggcaatatagggtctacaatcctcagcatgttaatcgaagcctggtggagcttcacaagggtcccatggaagattgggacgaaggcgaagaagcggcaacacctttcgaacctgtgggctcactccatggatacctcggattctgattgacaaacgcgccaatgtggggtcccgcgcgggtacatagaagtggccagctttctgttggcatccctcgcattcgaattcagttctgacatcgtgcctatattcctgtggaacgggctgggttccataagattagcttcctcctggccttcgaagcatcttgtgccaaccgataggtctagatccgggagggccgctagag

SEQ ID NO: 574936 - DNA, 497 bp, Homo sapiens
  misc_feature (10)..(10): n is a, c, g, or t
  misc_feature (17)..(17): n is a, c, g, or t
  misc_feature (50)..(50): n is a, c, g, or t
  misc_feature (67)..(67): n is a, c, g, or t
  misc_feature (77)..(77): n is a, c, g, or t
cttggtcctnaagaagnaaaactaaaagcaaactgaagggtgcaaaacanagccatgaagcccaacntgcccccagnactactccccatctgccttccttccccgtcccccgtggaaagtggccccctgaatatggattgtatctgtatcccccaccccaaatcctcagggtagaattgggatctgtgtcccccaccccaagtctcaggtagacttgtaatccccagtgttggaggaggggcccagtgggaggtgattggatcatgggggtggatttctcccttactgttctcatgatagtgagtgagttctcatgagatctggttttttgagtgtgtggcccctccccctctccttttgctctcttcctctttctccggccatgtaagatatgcctccttctccttcaccttccaccatgattgtcagtttcctgagcctcccagccatgcttcctgtatagctgcgggactgtgagtcaattaaacctctttatt

SEQ ID NO: 574937 - DNA, 209 bp, Homo sapiens
gtctgggaggtggcgcacaccaatctcccgacaaaactcttcaaacggcctcatcctctaccgggttcatcttctccttcaagtcttcatttccctctctgggatcggaatgatcctctggatatcataaaggcgaggcccaaagtgggctagctcactctccagctgggatttttcctggcagatgcagggctaagatggtcgggtct

SEQ ID NO: 574938 - DNA, 234 bp, Homo sapiens
tcgagatgctgctgatcccgcaatgatttcttcaacacagcttggatcactgggaaggcttacgtcactatgtttggagcgatgcgtgaacttaggcacgcttataatcgttatgaactggctgcatctgggcttttccagtccaaggagtgttccaaactgacatgattccctgaagctgtcctctacattcaacttgattggtttccagtgttcggctgagatgtctcggtg

SEQ ID NO: 574939 - DNA, 816 bp, Homo sapiens
tgtactggccctcttcctcctggccagcctcctgggctgcggctctagccggcccggtccttgggttgaatgaatgcaccagggctcggcagtgtggtgccagaatgtgaacgacggtgtccgactgcggggcaagtgaagcactgacatgcagaccgttaggaacaagccagacagtgaaatcccttccctgcgacatagtgcaaagagcgttgtcactcgctagctggtgatatgcgtgaatggacaatggccactgaggaggagatccttgataacattggagaagacctgtgacgtggcttccgaaaccgaacatgtcgtgcttcatgcaaggagatagtggactcctaccatccctgtcagtccgtggacatcattaaaggagaaatgagccgtcctggggaggtgtgctctgctcgtcaagctctgcgagtatctccatgaagcacctagcagagctgaatcaccagaagcagctgtgagtccaagtaagatacccagagctgaacatgactgaggtggtggacccttcatggccaacatccctctcctcctctacctcaagaaggccccgaagcaaggcccccagcccaaagggattaatgggggacggttggcagtgcctgcttccgcattggtgactggcattccgactgcgggtacggaccactcagcccttgtccaggcgctttggtgcactgtacggtgacatttccccatggccctgtaatttgacatagcaaacataacagagtttaaatgtctaccacagtatcaaaacaacatatcttgtactgtagtcttagtacaaca

SEQ ID NO: 574940 - DNA, 673 bp, Homo sapiens
cacccagcatgtcacccctgttgacattggcataacatccccccagtatattacaaataatatcaaaaggtgtacacacattgtgacattagtagtagtataccgctagtatgttgtgaataattatatcagggtgtagacacctgttacattaggagtaacatccccctagaatattaccaatgatatcacagggtgtgcaccctttgcgactttagaagtatcatccccctagaatattaacgagtaatatcacccccatctcccacaatggatattacgaaccatatcacaggggggtggacaccccccacaatatggcgagtaatatcaccctactctccccgcctagatactacgaaccacttcccctgtaaagacacacatagacttaaaataatgggatgaaaagatatatttcatgtcagtggaaaccaaaaaagagcaggagtagctatacttgtatcatacaaaatagatttgaagacaaaaactataagacaaagaggcccaggcgcagtggctcacgcctgtaatcctagcactttgggaggccgaggtgggtggatcacctgaggtcaggagttcgatgccagcctggccaacatggtgaaaccccaactctattaaaaatatccaaattagccaggtgtggtggtatcaggggatcctc

SEQ ID NO: 574941 - DNA, 325 bp, Homo sapiens
  misc_feature (182)..(182): n is a, c, g, or t
  misc_feature (255)..(255): n is a, c, g, or t
  misc_feature (285)..(285): n is a, c, g, or t
  misc_feature (293)..(293): n is a, c, g, or t
  misc_feature (310)..(310): n is a, c, g, or t
gccgggcgcagtggctcatgcccgtaatcccagcactttgggaggccaaggtgggcgaatcacccgaggtcgggagttcaagaccagactgaccaacatggagaaaccccgtctctaccaaaaatacaaaattagccgggcatggcgatgcatgcctgcaaccccagccactggggaggctnaggcagaagaatcacttaaacccgggaggtggaggctgcagttagccgaggacagtagagaaaccaaactggnctctaggtggtgctttgaagcagcgtaggngaaggctngcactctttcacggtgnaaagggtattagctg

SEQ ID NO: 574942 - DNA, 766 bp, Homo sapiens
  misc_feature (10)..(10): n is a, c, g, or t
gcaggctggntacggtccgggagtcgtatggattccgagccaacggagaggtgaatccccagtacgaatagcaccttcctggtttgacaacgacttcccagactctggagcctgatgcccccagtccagagacccagtgatcatccccttttccaaggcaaagtctgctcgaggagtcttgtaaggtcatgtgcttccacccctggtctggatagtaacgctgccactcatgtcaggtccctgagatccggtgtctgtcgttgatgcagtgggcctcattcacataggagctgggtgcccagtacccttgggctgcagatctttgaaaagcaaaggtgccttgagtgggctgttcataaccgccgcaccgcccgactgccaggatatgggccagtcatgtttaccctagtccagtatattgcccatgtgtgaggagcgatctcagcaggtgcctagtaagagtcatgcatggagagcccctgtctacttggagtacagtcgccaggatctactcaggaaggaacgtctggatcctaaccgaagtgagcactggttagtactggtccccttctgggcaacatggccctaccagaggactgctgctgccccgtgcggcatgtgcggcggactacctgagactgacccctgctgagcgtgatgatctagcctccatcatgaagaagctcttgacctaacgtgatgacaagccgtctttgatgacgtcctttccctactccatgggctggcatggggctcccacaggatc

SEQ ID NO: 574943 - DNA, 105 bp, Homo sapiens
gccgccagaacaaaggtgtcgtgaaaactacccctaaaggccaaaattgggaaaggaaaggactcatatcacatagtcgtcattggacacgaagattcgggcgag

SEQ ID NO: 574944 - DNA, 112 bp, Homo sapiens
tcttctatactattattcataaagtaacatccattcatccattcatttaacccatcacatactctctatctaggcacactgtattacataggagggcatacaagtaggtaga

SEQ ID NO: 574945 - DNA, 153 bp, Homo sapiens
gaccgtatagagaaaactacctgtggggccgatctgtgattgctacagaaactaacgctcgctggcaaggggacagaggcattcaacccaattctacaacacaggcaggtggtcaaaaccaacctttccaaccggaatcgcctcagttgatag

SEQ ID NO: 574946 - DNA, 349 bp, Homo sapiens
gttcgcaaagaaaagttagggcttaacccttttttctaaaattttataattcaatttccaaaagtcccctctattttagcgtgtttctccaaaaaattccttataaaaccaaagaccaaaaattgaatatttaatgaattgcccttttatacccccccggtttttatctccggggggaatttttgaggccagaaatttataaagaggttctgtattttccccccttgaataagcataatcccataaaaaatggcccttggcagggcaagggttttgtcatttcattttaaactgggatttggggtttttttcccagataaaaatgaaattaaaccatttctttttaaga

SEQ ID NO: 574947 - DNA, 199 bp, Homo sapiens
atagagagatttaaagcgagccggcagatgtagtgcacatataagatgggaaccaagcagagggcgctggggagcggcatgtaaccatcactggctctccggtctccgtcgccctggcccagtacctcatcactgcctgtctagagacggccaagtctacctctagggggacgcccagctcggcccccgcagacctgcc

SEQ ID NO: 574948 - DNA, 290 bp, Homo sapiens
  misc_feature (17)..(17): n is a, c, g, or t
  misc_feature (43)..(43): n is a, c, g, or t
  misc_feature (66)..(66): n is a, c, g, or t
  misc_feature (76)..(76): n is a, c, g, or t
  misc_feature (86)..(86): n is a, c, g, or t
  misc_feature (101)..(101): n is a, c, g, or t
  misc_feature (107)..(107): n is a, c, g, or t
  misc_feature (120)..(121): n is a, c, g, or t
  misc_feature (127)..(127): n is a, c, g, or t
  misc_feature (158)..(158): n is a, c, g, or t
  misc_feature (197)..(197): n is a, c, g, or t
  misc_feature (200)..(200): n is a, c, g, or t
  misc_feature (240)..(240): n is a, c, g, or t
  misc_feature (244)..(244): n is a, c, g, or t
  misc_feature (248)..(248): n is a, c, g, or t
  misc_feature (253)..(253): n is a, c, g, or t
  misc_feature (287)..(287): n is a, c, g, or t
  misc_feature (290)..(290): n is a, c, g, or t
catcccctcattggaanaaaaccttaaactgggagaacctagncccctctctttcctcttcctccnccacttcccncttattgtcnccttgtaatattcanagagcncttggattatggnnctgaanagagaaatgcttacagataatcattagcccncataccagtaacttaaagatgggatggagttgtaaagtnctnttataatacaatataattgttaaaggcaagggttgacccnttgntttnttttnacatggcatgtcctgaaataaatattgattcaanatn

SEQ ID NO: 574949 - DNA, 149 bp, Homo sapiens
gcgatacccacaaagcatcttcaaggtcattggcatgaatatttagaaatttaacgaagaaatagcttgtttaccattatttaattcgacatggaaatttccttaagtttagatttcattttgttgatttcatttcgcacaaagtaaaa

SEQ ID NO: 574950 - DNA, 729 bp, Homo sapiens
  misc_feature (13)..(13): n is a, c, g, or t
  misc_feature (286)..(286): n is a, c, g, or t
  misc_feature (289)..(289): n is a, c, g, or t
  misc_feature (293)..(293): n is a, c, g, or t
  misc_feature (385)..(386): n is a, c, g, or t
  misc_feature (389)..(389): n is a, c, g, or t
  misc_feature (443)..(443): n is a, c, g, or t
  misc_feature (452)..(452): n is a, c, g, or t
  misc_feature (465)..(467): n is a, c, g, or t
  misc_feature (469)..(469): n is a, c, g, or t
  misc_feature (471)..(471): n is a, c, g, or t
  misc_feature (533)..(533): n is a, c, g, or t
  misc_feature (553)..(553): n is a, c, g, or t
  misc_feature (555)..(555): n is a, c, g, or t
  misc_feature (566)..(566): n is a, c, g, or t
  misc_feature (595)..(595): n is a, c, g, or t
  misc_feature (708)..(708): n is a, c, g, or t
ttttctccccttngccgcccactcagcaaccaacaaggaggaaagcccccgcagtgctcggccagtgccgcgccatcgccaccagggagcgccccgcgcgcggtccacgtggcagaggtcgcggcctcgcggcgcggggtggagccgcacgccacagtggcaggtcccaggccgtcactccgagctctcgccttccgggccgctgtccggcgtgggcgggaggaggggtctccggcgcgagcgcttgacccggcgcagagggctgcagcagcctccgcttcagcanagnagcnactgtgtcctggctgtccgactgtgggcccccagatagatgctctccccgcgtcggaagatttctgtgcagccgtgtgcagagcgtggccannttnagcagcaccagcaggaaggtcaggaacataaaaaaaaaaaaagcatcttaagtncgtggggtngggccccgggctnnncntngaggcgctgctgcgcgaggggccggggaagcctgacttgaacagacacagccccctgggctnccttgcccgttgggcacctnancctctgtcctntatcttgcatttcctccattctccccctncagcagggagacagtgggcacagatggggcattactctccctaccagggattcccgccatggactgcttggccttcaagctccctggggaagcagagggaaacctcagggctnagcgagtgggctggggaacaa

SEQ ID NO: 574951 - DNA, 1240 bp, Homo sapiens
agcggactctccggtgcgggtgctggacggacggacggactggggcagccgtgctcacagcctcagcagtgcggggccttggcgcgcggggcgttttcccacgggtcgcgcgtcatggccgcggaggtggccacgcccgagcggtctcgcctgagctccgggggtcgtcgaccccgcagggattgcgggtcacgtctaatgtggcctgctgcctcgtgatcacatcgtgaaactcgtctgtagcgtcacgttacgaaaggttcttgctataacactaagcctgaacatatggctctcctgtgatttacaagttacagatggtgctgaattagacaagacgtatgacgtatgcagtcgacagaagacctagtgggcacccattgcgagtaattccaagacaggcaacgtgactgggaacactatgttgccttgttaggacgaactcagcgcatgagcaggcaggcagtagtgaggcttaggaactgaatgggtgaagccgtaccaggaaagacagaactgggggaagcccaaagttagtggactctgccctcttagccatggctgtgagacatatcttcgtcgtacacctgacccgtaagcctggagacttctagctaaacgacataggctgggctacaagtaaacacagggaaaggccaccaatttgaacacaagtttggaggctataggggggcccaacatgtaaggacagtggaaacatccgattgtacttcccaccatgacattccgttaggcgatttccggttcaccacaaattgtcataacacgacactcataattcacacgtgaccaacaaggattacgtctttggggtgcgacacccaccaacggagttcggcgcaacacacggtaagggcgatcccccttgggtagcggggtcatcagtgagcccccgagaagggtcaacacagacaggggatagaggaaggaccagtcgtgcgacgaagtaccgagaaacgccttaacggtcggcgcagcctcgaacgcctcaggcccgtgagctcgatacgacacatgaggacatcggcagacggagcgcaaaatagcagacagggctaaaagacccctactggtgggagaaaccacagaagagcggaagccagcgagagtcgacgaagagaaagcgacagagcgacaacaatcagaggcgacgcgaagcgccaccacagagcacaggacacaagagagcgtaaccgcacagacgccaccagaggcgcag

SEQ ID NO: 574952 - DNA, 798 bp, Homo sapiens
  misc_feature (210)..(210): n is a, c, g, or t
  misc_feature (798)..(798): n is a, c, g, or t
cagaagcttgctacgacccacttctgttcgcacgcgtcggtccccagtacgtgtaaggctgaacaatgtctcattaactgccttgtccatagtgagagtccgtgggtcaatgacgtagatgcgtctgccaatctcgtcatccatatacacatgagagcgacccggacgggcaaacctcatgcgcttcatgaaacaaaaatcacaagaatnggacgttccctagacggagctcattttatctgggcacgtcttactcgaaccatgtgcagtcccacactgctgacgcctcagcactattcaatagttgacgcccccccggccccccttgaaatgggcggtacaacacagagagacacattggggtgacacctatacacgccgtgggttccatcaagagagagcaacacacccgcgcgggtaccacagaacagacaaaaagaagcgtgccgccatggcagaaaactcgctctcacccaagcacagcataattaaaaaacaaacacgcatcccgccgtggagacgcagagaacaaccccccacagcgacaccgcaccgttctccgaataaaacacaacaaaaataatactacccaaacaaagcagagaagagccattcatcagataatgaagccggcgacacaatatcacaccaaggagggagaccatatacaaacaacaaacgacaagaagagaacgctagtctcaaaatacgagcagcagcaggcagctgccgccgaatatgatactctacagacaatatatttaacctgcgcaaccccccgcccacctagtggagacn

SEQ ID NO: 574953 - DNA, 301 bp, Homo sapiens
gtgcatccaaaagtcgcagtgtaatagcaggacaaaatatactgtcagtcagctgaccatatatcttaatgactcctaagaatctcggggacttctaagaaagcgccaaggtctgtgcagctgttatgattcctgggttgtagcggtgctctgttggagccatccgtatagaggcggcgtcacggagtatgacactcagcacgtggcgccacctaactcataacgcagcataagagaaatcaacccacgggccgacgtttaaaacaaggaaccgaccaggaccgagaaagcggaggcacgg

SEQ ID NO: 574954 - DNA, 432 bp, Homo sapiens
  misc_feature (169)..(169): n is a, c, g, or t
ggaatttcgggatattgtcgaccacgcgtccgagttatgaaggtttccaaggacaaacgggccctcaaattttcaagaaaagggtggggcgcacatccgcgccaaaaggaagcgggaggagctgagcaacgttctggccgccattaggaaagctgctgccaagaaagantgagcccctcccctgccctttccctgaaataaagaacagcttgacagaagccctgggtttcctgctgtccgtgggtgggtgtgggtgtgtcgggggcccccagtcccctgtttgggggccgctttgagccccaccctctccggggggtggctggttgtgaatcaaaaaccgtgggccgcccccccttcccggggcagcaggtgaggaaacccccggactgcaaatggcttttatcctttaataggttttatgcccccctttga

SEQ ID NO: 574955 - DNA, 313 bp, Homo sapiens
  misc_feature (107)..(107): n is a, c, g, or t
ggggggggcccaaaaattttcaatttttgggtggggccccggggtttttcctttttttcccccccttttggggggccaggggggggggttcccagttttgggggttnggacccttttgggttacccggggaaaccccgttttttttttaaaattccaaaaattttcccggggggggggggggggccttttgttccccccttttgggggggttgggggggggattggggttttcccggggggggggggttttcttttgccgggtttgggccccttccctcccgccggggggccggggggggttttccttttcca

SEQ ID NO: 574956 - DNA, 165 bp, Homo sapiens
tgatacgaagtcagctcgagtacccccttacatgtaggacgtgtcccctacgatcttaggggcctatcaatttcatcactacgaattgatgaatataaaaaccggctgactataaaccagtacctaagcgacctcctcttcgtctgatccgtcctaatttcagta

SEQ ID NO: 574957 - DNA, 180 bp, Homo sapiens
gcaagacacgaggcgagacattcagaagcgtgggggtcaactgggctggcgggatccagcttcaggcctggggagtcctattggtccggccatgccacttattcgggattgggggcagggaagaacaatggtaatccttctggtgaaagccccttggggccttggcaggaagggcgggtg

SEQ ID NO: 574958 - DNA, 405 bp, Homo sapiens
gttttggtttcttattttctattatttttttgagccagtacttttaaagagatagtacttttttcagttagtactttttaaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaa

SEQ ID NO: 574959 - DNA, 1244 bp, Homo sapiens
acaataacaatataataggaacaaaacctcacatgttaatcaatcaatcttgcaatgtggcaaggcattgcacattttcccacttcagcaagctacagcctggcagcaatggcattcaacaaattaagcatcccagctatatcattaccctgcaaggaaacacactttacctcataatggcaccatgtagcactcaaacacatcaacaggcaatggaaaacaaattactccacacgaacagaaaccgaaaagtgagtaggagtagctcatacttatgtccagatcaacaacagcactttaagtcaaaacacgagtcaaaaaaaaaaacaacaacacacacaaagaaaaaaaaaacagagggcacaaaggaaagacaaaacaggagtaacaaaaaaacagacgcacaacagaaaactacacatagaggcctacgaaaataccatgctgggtggtccacaacacggtgagacacaaacgacgacggaccatcgaagggaacccaaaacatagaacagcaacgaatacaagcagacgaaacgaacaagcacacaagcagacagaagaccgggggggcgacaaacgaccaaaccacccacaaacaaccacgacagacaaagtaagacaaacacacaacacccggagtaccgaaaacagcagacaaagtagaacaacaccgacacgtgtgaaaaaagacgcaagaaagaacgaaacaccaaagggggggaaataacaagcggacacaaccgcgggggcacaacaccacagaagcaagcttagagccagcaaaccaacagagtgagccagccaaaacagaacaacgccagaacacgaagaaaggacgcagtagccacactcacacgaccaaagggtggagaaaacatgctacgcacaacaacgaacaaaacgtgggaagcgccccgacaaacaacgagcaaccacaccagcaacatagtccacaacaccgcgaaaagaacaccacatacgccaaagtagacaccgaacaacacaccagggggcataaacagagcagccaaccaccaaggaaaccccaatggggaaaacaaacaagccaccgataaggcacgacaaccaacacaagcccccaacgcgcgaggaccggccaagccaacacaacgaaaagcacggacagacagcggccgaggcagcccacagggagcacaccaccacccaacacaacacggggagcaaaccgcacaggagaccagcacgccatgccacaaagg

SEQ ID NO: 574960 - DNA, 692 bp, Homo sapiens
  misc_feature (144)..(144): n is a, c, g, or t
  misc_feature (148)..(148): n is a, c, g, or t
  misc_feature (187)..(187): n is a, c, g, or t
  misc_feature (194)..(194): n is a, c, g, or t
  misc_feature (196)..(196): n is a, c, g, or t
  misc_feature (201)..(201): n is a, c, g, or t
  misc_feature (212)..(212): n is a, c, g, or t
  misc_feature (229)..(229): n is a, c, g, or t
  misc_feature (324)..(324): n is a, c, g, or t
  misc_feature (379)..(379): n is a, c, g, or t
  misc_feature (389)..(389): n is a, c, g, or t
  misc_feature (391)..(391): n is a, c, g, or t
  misc_feature (395)..(395): n is a, c, g, or t
  misc_feature (398)..(398): n is a, c, g, or t
  misc_feature (577)..(577): n is a, c, g, or t
  misc_feature (580)..(580): n is a, c, g, or t
  misc_feature (594)..(594): n is a, c, g, or t
  misc_feature (609)..(609): n is a, c, g, or t
  misc_feature (683)..(683): n is a, c, g, or t
  misc_feature (687)..(687): n is a, c, g, or t
ccaggcctgagccccacaatcggtcccagaggtggctccatccccacgtctacgtgaaacacggggagatcctgaggaccgagcccgtggccacaggaaactgtacatgcagctcatcccgcagcaactgctgacccccctagngccnctgttccggaactcgcgctggtccagttccacttcaccnaggaccngnagacnctgaagagccngtgccggatcatggacnatggcttcgccggctgcgtgcacttttcctacaaagcatcgtgtgagatccgcgtgcttatgctcctgtactcttcagagaagaaaatcttcatnggcctcatcccccatgaccagggcaactttgtcaacggcatccggcgtgtcatgnccaaccagcngnaggnccngcagacggaacctggagcaggagcaacagacaacgcagaggatgtggggggtaatggttaccccgcggctgggcccctcccggagatcacagatgaggcccccgccagagactgtgcttgggagcctgtggcccgacagcccccactgcacccctgccccccggtgacacgcttttgancangggcccctgggganttcaactgcccagcnacatggaggatggtgtcctgaggcctccacaggacggtccccacccctttacgtttcccccataaagccttttnaaancctta

SEQ ID NO: 574961 - DNA, 559 bp, Homo sapiens
  misc_feature (96)..(96): n is a, c, g, or t
  misc_feature (191)..(191): n is a, c, g, or t
  misc_feature (246)..(246): n is a, c, g, or t
  misc_feature (256)..(256): n is a, c, g, or t
  misc_feature (258)..(258): n is a, c, g, or t
  misc_feature (262)..(262): n is a, c, g, or t
  misc_feature (265)..(265): n is a, c, g, or t
  misc_feature (444)..(444): n is a, c, g, or t
  misc_feature (447)..(447): n is a, c, g, or t
  misc_feature (461)..(461): n is a, c, g, or t
  misc_feature (476)..(476): n is a, c, g, or t
  misc_feature (550)..(550): n is a, c, g, or t
  misc_feature (554)..(554): n is a, c, g, or t
catggacaatggcttctttctccatctgtgaggtggagaaggttggactttggtgtttctgacacctcccaccgatcgcctcccggatcatggacnatggcttcgccggctgcgtgcacttttcctacaaagcatcgtgtgagatccgcgtgcttatgctcctgtactcttcagagaagaaaatcttcatnggcctcatcccccatgaccagggcaactttgtcaacggcatccggcgtgtcatgnccaaccagcngnaggnccngcagacggaacctggagcaggagcaacagacaacgcagaggatgtggggggtaatggttaccccgcggctgggcccctcccggagatcacagatgaggcccccgccagagactgtgcttgggagcctgtggcccgacagcccccactgcacccctgccccccggtgacacgcttttgancangggcccctgggganttcaactgcccagcnacatggaggatggtgtcctgaggcctccacaggacggtccccacccctttacgtttcccccataaagccttttnaaancctta

SEQ ID NO: 574962 - DNA, 541 bp, Homo sapiens
  misc_feature (90)..(90): n is a, c, g, or t
  misc_feature (120)..(120): n is a, c, g, or t
  misc_feature (294)..(294): n is a, c, g, or t
  misc_feature (316)..(316): n is a, c, g, or t
ccggggagactgggggaaaaaaaaaagaaacccgtttctggttgccttggggggcccaatctgtgggttctccccctggggtttgtgaanaaagagaggaaggggatttcttgggtggtntttatttccaagggcctcgcgcctgggcccccaaaaaggtggcgagatcccgcccctttttctctctctttaaagagatggatggccgcccgtttgttgtaagaaagccctttaataaaaagggggagaccccctggggcccaagccccccaaatttggggttttgtttccccnccgggtcctgcggcccaaacgnggggggttttgtttttaaaaacccggggccccaaaaaaataaaaaagggggggccgaatttgtttaccttttggcccaaagaatgaaggggggtaaggggagggccccgggcccaattggggaggggcgccgcctttcccctttggggggtttttcttttaggtttggaccccggccgaaataagattttttgggggcccaaaaaataaggtccgcctttggata

SEQ ID NO: 574963 - DNA, 260 bp, Homo sapiens
agacgtgaccaggttgatcatgaatggaaagactgaagcttcttcaggcatctggaagtttacactgtgtcccaatagatacgtccagtaagctctaagtattattcgagaaggagatattaaatctattatctcacttttagaccaacatcggagaaatcacgaggtactggatgtcttgtgctcactctgtgtttgccacggggttgcaggccgttctaacccgtgatctcctcctgtgagcaatctccttaccagga

SEQ ID NO: 574964 - DNA, 733 bp, Homo sapiens
gctgtttccgggaggcgcgtggggcttgaggccgaggaacggctcgcttgtctgtcaccaaactatggtagactttgtacctgtgtcccgtgtcttagtgctcgaatgtctccaagctgaagctgaagaagccgacctggtatgctacatgcgcagtaccggccaattgactgtagtttgcttctggatggatggtgtcgtttacttccatcatctaccgcgaggaatgacatttcatggatgttgattggttgaacctcctaagtgttcggttctagtgactgtatgacacgatgtggcatcataggcctagtagtctttgcttggtcctacagagttaatatggtagcaatatgattcatggtaacgggacttgctatccagcttgcctaattgttagcaatggggaggtcttaggttgcatcaatcctgtacgcgatgctgaatgcaccttagtatcccaaaattacaatagtatttccttctgtctagttcagttggattctgtctgtgtcctattgagtctatttcatgggctatgagtattctttgatgattttgagtatgccgggctatctgatgggtatagagatgcctttgagaagaaatcatgtggttactggatgtgctcctgtcaatgaagttctaaaggttgtaccaagtcctctaatatgcaatgtggataagaatgagagcagctagtaagagaaatatctagtgaatataacaggaa

SEQ ID NO: 574965 - DNA, 159 bp, Homo sapiens
tggaaaaggagggagtatctcaggctgtgtgcagcgacaggtgcccagggctctgatgtgtctctcaaagcttgaaaagcctgagacagctgtcttgtgagggactgagatgcagggatttctcacgcctcccctttgtgacttcaagaacctccttgg

SEQ ID NO: 574966 - DNA, 1099 bp, Homo sapiens
agcgggttctacctcctagtctacatatggtccgcggtgtgcgactcttgcctatacgcccgagagcgcctgagagggcctagtgggctgggggaaggcgcaggcggttctgccgggactcccatacaggcaacgtcatgtagcgcactcagggcaacgacgggcagatacgtgcttgacctaggagattcccctgccgagcactcgttgcgaggctcgggcaggcacatgtcgagagaccctgtgcgagacacggcacgggaagggacccgcagagagtaggtcgaatgaaccaaaggtcggagtcattgtccatccactaggaccggggcacccggacagttacggctagacagtgaagatgcgcgcacacggggaacggtagttgctggcggcatatgctgtctgtggactcaggagacgagtcgctgttccaggtcgctccgagggttgagaagtaggacttatgacgcgcaatgcataattatcactattgcgcgaccgaatagtttctgggggcaaaggaacttgggcatagcatgtcagagctctagcgttggtagcttgtacgagtgaacatccgcgcggcgcgttttgggatagcccggtgggttaagccgttgtggtgttagttcccacaggacagctttggcgccattttgggctgtgaacacacacggactgggaggtatcacggacggaatataacaatccttcgggcagacaagggagaggcgcacccggattgagacggttctttaagtagaagaattacacccgtttcaggaagcgccattgcggtgggtgcttagccacaaccgtaggcaagaaacatggtgtgggcggtattggacaacattaccatggcgtgtggggcaggctacagtgttgccatgcgaggcgcagcaccgacaattccgtgccacacgggctcgaactacacaaaggcaccaggtccctatcccgcgaccgacggggctagacgccaccacagtacgaacggtcgagacaagcgagggtatggtccccggatgggtaggtcaaaacccacgaagacgcagggagctcgcaaattgccacagcgaatatcccctgacag

SEQ ID NO: 574967 - DNA, 186 bp, Homo sapiens
aggaagaaggaaggagcgcttacgatttgatggtgatgctagcaaaaaggattccaggatggagcgagtgcaatttggtgatgaaggtagcagtcggcttggcattgacataccacacggtggattgcgagcaaggctttgtgcgtagaggatcctagaccagcatgcccgtgtgccatggtcact

SEQ ID NO: 574968 - DNA, 738 bp, Homo sapiens
tcgctatagtttccggcaacaacctaggccgtagttacccctttgctccgcttgtggccccccccttggcgtccctttatttcccctccgggccccactttggggtccataacttaccaagcggcccgccccagaaagggttgccatagggcgcccccccggtggggtgccccacgaggaggggcctctgttgtcttcttcgtggcgctctctttggaggggctttgtgggcgccccccccgctccatagggcccaccccgtccggtgtgtttggagagctctctttcgggggccccacaccacaaccctgtgggagactggctggcacagccgcgggctgtgccaccaccacgagctgcagttcgtgtagaactagggttcctcttcgttgccccactggtgtttaataccacgaacgcgatccacgcaagaccaccctcttttttccccccctggtcacggggctccacacaccacgaacttaacgtatggcacctataaggagccacgccccaacccccaatgggcgcggggggacccacataatggaacacggggacaccttgtccttgaactgaaggcagactttaccgaagctcatagtgaagaaagggccccgtattctacctcccctgtcccccacggggctgtggaccaacccgctgggggactgccccgcctcccaccccgtttatttaaccttatttccgtgctttataatataaggaaaccctaac

SEQ ID NO: 574969 - DNA, 545 bp, Homo sapiens
  misc_feature (229)..(229): n is a, c, g, or t
atcatagattatttttttttttaaatctcgggtaaattctgactggcatgcccagtaaaaaatccaggtaaaacatggggaaatcctaatttgggaaatataatgggatttttttaaagtgcaggaaagaaagtatcataaagagaaatcctcaaaagaaagaaagaaagaaacaccttggaaggctgaggcaggatcgctaaaggccaggagttcgagaccagcctgnacaaaatagtgagcacctcgtcattaaaaataaaaataaaaatgagaggggcgccgggggtggtggctcacgcttgtaatcccagcacttggggaggccgagacggtggatcacccgaggtcaggagttcgagaccagactggccaacatggtgaacccccgtctctacttaaaataaattttaaaaaatcaggtgggtgggggggtacgcacccgcaatcccaggtactcgggaggctgaggcaggagaatcgcttgaccctgggtggcggaggttgcagtgagccgagatcgtgcccttccccccagactaggg

SEQ ID NO: 574970 - DNA, 248 bp, Homo sapiens
  misc_feature (18)..(19): n is a, c, g, or t
gggggggggggggccccnnaaaaagaaagtttttcccctctctaaccaccgggggggaaaaccccccctttttattaaaaaaacataaatccagccgtttggtatggtgccagcctggagtctcatcttcttgggaggttcaggaagggcaatcgctttaactgggaaggcggaggttacagttatccgagatcgcgccactgcaaccgggtgacagagttagtctctgtctcagtagaaaaataaaa

SEQ ID NO: 574971 - DNA, 309 bp, Homo sapiens
cgttgccatctgaatcggggggagggatagcattgggagatatacctaatgctagatgacacattagtgggtgcagtgcaccagcatggcacatgtatacatatgtaactaacctgcacaatgtgcacatgtaccctaaaacttagagtataataaaaaaaaaaaaggaaaaaaaaggaaattaaggaaggaaaaaagaaaagaaaaagaaagaaatcatctgatagctctcatttgttaagtgcttacggtgtcccaggccctgggctggcgacttggtatccattctctcattaaatcataaaagcc

SEQ ID NO: 574972 - DNA, 220 bp, Homo sapiens
ctcttacatctctctctctcctcctcctgcctcagacaactgatacaccacgtcccactgctgtacacactgtgtatatatagtaggacacccccacccctcggtccctcaatctgatctggctacatccactgcctctagtcatctctccatcaatttcattcttccaccactgcccactggtcatgctcccatctcacgcatcacaacatgtggctca

SEQ ID NO: 574973 - DNA, 552 bp, Homo sapiens
ctactcagtccccttctcttcttatttttcttacctaaagcaatttgaccctcttgttcataatccagatctgtttaaccttcagctcatgtatctcccatatccttgactgctctaaccttcacttccaaaccagatcaaaaaatcttagttcagatttttcatttattttaagtttatatgaaacaacaatgtgacttaacttcaaataaatgtcagtatcatcttagactgaattaagagaagtataggccgagcgcggtggcccatgcctgcaatcccagcaccccggcaggccaaggcagatggaccgcccgagccaaggaatctgagaccagcctgtgcaacatggcaaaaccccgtccccacaaaatatacaaaaattagctgggtgcagtggcgtgcgcccgcagtcccagccacaggaggccgaggcgaaaggattgcccgtgcccgggaggttagggctacagtgagccacgatggggccactgaaatccagcctggacaacagagggaatcccaagaaagaagaaaaagaagacgacgaag

SEQ ID NO: 574974 - DNA, 153 bp, Homo sapiens
gccattctcgctcgagcaccgaaactcatccgcctctacgtgggtggtgctcacgcctgcccatgaagatggtgacagagctggcacctctgggatctgttgttggtcctggctacgtaagcaccaggtccacttcctcctggggactctgag

SEQ ID NO: 574975 - DNA, 871 bp, Homo sapiens
tgggagcctgtagcctttattcatgccgccctgaaccaaatgcagtgagagacaaggcccctgaacgaaaacaactccaggggcctgggactctgggtcccctactgcagacactttcctgtgagccaaaagtgtataaagtgctggtgtgtgaccatccttgtggggaaggtcaaagggggcaagatccccaggggccctgaggaagggcagggccataggggctcaaaaaacaagtgacagctcctgggcaggagggacctgaaaatgggagccttcagaatggagccctcaggaggcttggggttgtagggggataatttctgtaccccgtgtgacgggaggggccttgtaggaaaggcctgggggatctcagagaaggggacagcccctcgcaacgctgagttctggcggaccgtggaggccagcccaagtgggccatctaaaacacttcccgcaatccctccatgggactgtggttgagcatctcaaggtagccaaagggactgatccggttcgccatgtaccgggcttcctacagaccgaggggctcctgcttcatctgggcaggatccctcctggggtgcctcgatattgggccacagggtccttgtaataccccaaccaggtatgatgggggctcgttggggcagaaaggtgcttcaccctctggggttccaccttctcaggaaatgtgtccaccgcgtgtcagggctcgtcgaatgcaacagcccatgaggttaccacacggtccgggtagaaaaaggccgatgaaaataatgcttccggccggtgtgtgcccaagacggcacacactgtgttgggcacacaacggacggatattctccaacagagggggagacaccgaatt

SEQ ID NO: 574976 - DNA, 145 bp, Homo sapiens
gaatacggagtttgtacaccctggcatcatggtgaaacccacctctactaaaaatacaaaaattagccaggcgtggtggcacgcacctgtaatcccagctaccatgcctggcctgatttttgtaccatttgtagagacaagagtt

SEQ ID NO: 574977 - DNA, 870 bp, Homo sapiens
cgcagtggctcacgcctgtaatcccagcactttgggaggccgaggcaggcagatcacttgaggtcaggagttcgagaccagcctggacaacatggtaaaaccccatctccactaaaaatacaaaaattagccaagcgtggtggcaggcacctgtagtcccagctacttgggaggctgaggcaggagaatcacttgaacccaggaggcggaggatacagtgagccatcgcaccactgcactccagcctggacaacaagaacaaaactccatctcaaaaaaaaaaaaaaaatgttattaaaaaatttgtgtgggaagatacccaatttttatgtaggttggtaacccggtacacaaacaacttaaccgggttgtacgggggagacccttaacggggaacgagttgtggtattgtactggaggtacgtggttatcagcttaaaacatccggtttttactacaagattattttatgcacgctctagggtacccataaacaatttccctatagcagcgggaggttctccacaagcgaaccagcggattcggggtctcaccacgactttcctccagcccacacccaaatttcaacacactttccaggggcaatccgcgcacagaacggggcgcgcaaaaaagaaggttccaggacaaacgcaaacaaacctctttcaacaccaaatcgccaggtaaattcgtttcccctaataaagaaaataacctctacatggttcatttttgtttaaacttcccaagagaaagacattgggcttctggcttgggtctcaacaccacacaaacacaaaccagtgtggcgccgcatggcgcagaagaaagtttgacacattctgtgggcggggccatggttggaag

SEQ ID NO: 574978 - DNA, 904 bp, Homo sapiens
aggttgtagtgagccaaggtcgtgtcactgcaacctatgcctccccagttcaagtaatcctcccaccttagcctcctgagtagctgggattacaggcgcctgccaccacacccagctaattttgaaaaatgagtaatagcttctttgtttgctctttagtcttagtatatatcatgtgccttgggatatagaatttacttaacacatttcttttaaaacaagtggctatataaagtcctctatatgcataaaactgttatgtatagtgagtatttttaaagtacccttcaggaatgtaagtacattttaaaacctgtttctatccatagtagttaaaataaaatatttgtatgcttaagggagtaaacttagctattgagacatatttatcccctgactgaataattgtgttattactgattaaatatcaatgtttgcccttaagaatctaggatccaattagggttagaaaccttaagtacataaaacatttaaataatggtacataatagaatgtgtgattagatatcaaaataggctgggctcagtggctcatgtctgtaactcagaattttgggaggctgaggcaggcagattgcttgagcccatgagttcaaaaccaggccagagcaacatggtaagaaacccatctctaccaaaaaaaaatacacaaattatccaggcatggtggtgcacgcctgtggttccagtacacggacgccaagccaagagatgctcgagcccaggaggtggagatggcggagagctatgatcaggcactgactctgccggtgacggagaaagatctatcctcaaaaaaaaaaagggggcgcagagagcctggggccaatagctccggttctgaaaggcccagggaggaaaaccgcagcgcgaacgggaggaa

SEQ ID NO: 574979 - DNA, 215 bp, Homo sapiens
acgttggcagattacatgcagtcctggacccaaagagagtattaaaaacaaaacaaaaaaacccaagaatcacaatgagtatgtgaacgcccgtagcgatcgagagtaccaggaaatgtaagcagagccaggatgcaggtctgtgactattacactggtccttccagcggtactggttttgtgcctcccctcgacacctgtcgggctagtcgggg

SEQ ID NO: 574980 - DNA, 270 bp, Homo sapiens
ctactactactaaattcgcggaggctcgactgaactcctggcttcaagcagtcctcccgctcagcctcccaggtgggtgggattacacacatgggccacagtgcacagcccagagtgatttctatttagacggagctcgctctgttgcaaggctggagtgcagtgggcgatctctgctcactgcagcctccacctcccatgttcaagtgatcctcctgcctcagcctcctgagtagctgggactacaggcgcacgcgtcgacgcgccgac

SEQ ID NO: 574981 - DNA, 108 bp, Homo sapiens
gggggccccggggggtttccccccccccccttgttccgggggttttttccccgggggcccaaaagccccccctggggttttttattttttttgggggcccccccccca

SEQ ID NO: 574982 - DNA, 828 bp, Homo sapiens
  misc_feature (157)..(157): n is a, c, g, or t
  misc_feature (823)..(823): n is a, c, g, or t
tacctttctgctcctgaggaatttgagccccttcgcactgatgaaggccctggcacttatccgggtagtacaaagaagattaagcagaccccgcagattgactacactaggggttccataatatcacagtgtagaagggccccctactggacatggngaaagcattcaggattccagaactttgccattcaaaactcatccttttcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggtataaaccaaatcattagtttccattgatatcttgatttagaaaaacagatttttaagaagttattttcataattactctcattctttttagctacctttctgagagagagactttctgaagccatagctttatgtatgataggtcacagagttattgatgaatattagaaatttaagtaaattaaattgagaaatggtttatgagttgccactgcattaatctaatcaacacatattctgtgtctgcattatactctaagattaggatcaactctctctgaattcatatcttccgtgtcttaaaaataaaattttgaagttgttttanaaaaa

SEQ ID NO: 574983 - DNA, 580 bp, Homo sapiens
  misc_feature (157)..(157): n is a, c, g, or t
tacctttctgctcctgaggaatttgagccccttcgcactgatgaaggccctggcacttatccgggtagtacaaagaagattaagcagaccccgcagattgactacactaggggttccataatatcacagtgtagaagggccccctactggacatggngaaagcattcaggattccagaactttgccattcaaaactcatccttttcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggttatcaagcaggggctcacgctaatcttgctagacagaggcatgcactttcaggatcaacttcaaatacgccgtatactccattgg

SEQ ID NO: 574984 - DNA, 330 bp, Homo sapiens
actttttttagattgcctccttaccattacactgtaatccagcctttggaggctgaggtgggcagatcacctgagttcaggtgtacaagacagccaggcaagatgttgaaacacatctctactaacaattccaaaattagccaggcgtggtggcaggcacctgtagtccccagctaatcagaagggctgaggcaggggaattgcttgaacctgggaggtggagggttgcagtgagctgagattgtggcccatttgacttcaagcttgggggaagagaggcaagactcttggctcaaaaaaggaaatgtcaagtagcctctttattcagcc

SEQ ID NO: 574985 - DNA, 179 bp, Homo sapiens
  misc_feature (178)..(178): n is a, c, g, or t
accgtcatatgtaacaacagcagagtggagtagttacaacagaaagctaggcccacgaaagcctaagatattgccacctggccctgtttttgtaaataaagttttactggaatgcatccacactcatttatttacattgttgtctcatgttaacaacagcagagtggacgtagttacna

SEQ ID NO: 574986 - DNA, 413 bp, Homo sapiens
gccaccacattcggcctggcattgataattttcttactgattgtaaatactctctctatattaatgatgttattaacactatggtatttattgtaaaattttattaacagtatttttaatatagaaattataaaaataatttataatcaagtatataaattatgtttatattttgccttgataacatgctttgaaaggccttatttgattctaagttatgtaaatattcaactatactttcttctagtaactcatttaagtccttttaaattttattgagctataacttataaaccttaaaatccacccacttaaggtgtactatccagtggtttagttgtatttatggagttatacaaccatcaccattatctaattttagtatttttatcacccttgattatattttcttg

SEQ ID NO: 574987 - DNA, 147 bp, Homo sapiens
tggagatgtcgagagattcctgagcatggtgcatgtgccgctctgtggagggcaggtgtggttatctagtgtgcgctgagtagctatctgtgacccctcccgcagtgcctctcctggggccttaaggtgctattccagtttcggacc

SEQ ID NO: 574988 - DNA, 351 bp, Homo sapiens
  misc_feature (113)..(113): n is a, c, g, or t
  misc_feature (324)..(324): n is a, c, g, or t
  misc_feature (348)..(348): n is a, c, g, or t
aagagtaaattagcatataccaagtgcttaatataacacctccccataagtgcaaagcaaatattagctattattaatagtattactcaaaagcaatgaaataatttctggangaattatcaattctaaatatcaaaaaaaaaagctcacatttctgctcagtgtggtttaaagctccaaaatcaaagattcaatttggcattctcctttagcattttaaagttcactgcacttttgtgacagtgttaggatatttgaatgtccatctcaactccttctaccatcagaggcaaatattagagctgctctaaaggctgaagccanattgaagggtcttcctcattaagnagg

SEQ ID NO: 574989 - DNA, 868 bp, Homo sapiens
gtttcgccatgggcctggggccccgagaacgcagttaaagcgtgtgcagcagtcgaagcataggatgcttgacgaaacaaagcgggtgtattagcacctcgtccatcgacaggtcaccacaagctgatggaatgtcttcctctgatcgtctatccgtcaggaagtagatctcaagctatgcgttgactggagatgaggtaaagcaagatatgtcctgcaacgtttcatcaaagatgtgatggcaaggttcgtacgtggatgtcatcgatatccctgcgtggcattcagttggcactagtcgatcagcgatcgacaagacaggtgaacatttcgcggctgtgtctatgacaccaatgggccgtttctgcattgttctagcgctatcacagtggaagaggcgaagtacacatggttgtgctacaatgtgagcgaacgattactgtgggacgctgaagggaagtccctcacctggtgactcagtgatgctcgaaccactccggatagccagactccgtgtcatcaaggtgaacgatactgatgcaggatctgagttccagagtgactggtcaaggataattcaacctttatcaacagtttgactacaggccaagtttggtgctatggatgatcgcgtggacgccaaccctcggtcgctgctggtgtgatcaccatagcagtggcaaagacatcctggtgtcgtgtatggatgtgtgatgcactgtgagaggatgccactggtcgaacagctttgccacgaggctttccaacattctcagtcattgtcaactggcaataaaccttggatgtccctgcccaggggaaacgggcgttcgacttacctgttgctgaaagagagagataagaggct

SEQ ID NO: 574990 - DNA, 390 bp, Homo sapiens
gggatttgttggcgcgttgtctcacagaaagtgctccgctcccagacatgggaccctctgctgtctccctccgaagcgcagcagaaagcattgcgggaagaggaagagcttacctatagaagacccgtgcaagccggtgcaccttaacagcctcctgtgatacaaagctggcatgactcacatatgtgcgggaaggccacaggccgggatccaaggtgaacaataaggacagtggagaggctgtgaccattgtaaagacaccacccacagtggttgtgggcattgcgggctacctggcccctctagggcttcggaccttccagactgtgtttggtgtgcacatcaaggacgaatgccagaggcggtgctataagaattgggcattatgag

SEQ ID NO: 574991 - DNA, 327 bp, Homo sapiens
catcgctgaccgtcaggaatcccatcgagctcagctatctcggcttagcacttctttgcatgtcgctgtcccagcgcaaaggttcgttctgcgctgcgactgcgttctttattgttgttgccggcagatcgaatgttgcgatcgtgagcgcgctcgctatgatccttatccatatatcccatgggcgctcagttgcacgaactacccgcctggcactcttggtagtgctgccctgcatactaattttctttgcggcgtttcttcctgatatttatcttgagccaggagcgtcgacgcggccgcgaatttagtagtagtaggcgccgc

SEQ ID NO: 574992 - DNA, 103 bp, Homo sapiens
  misc_feature (1)..(1): n is a, c, g, or t
ncccatgcgcgacgcctccatcaaagcacagactctcaaaccagaccaattaccctcactaaagggagagaagggtgagacacttgatggaagcgtcgcgcat

SEQ ID NO: 574993 - DNA, 187 bp, Homo sapiens
acaactttcttcttgatctgctccaggaaccactcatccttgccaatcaacggactgtccaggggttgtctgaggcccagaggtcgtagaagggccactctacggtgtcctggggcccgggcttgcgccttgtatgcagaagggttgaggtttcgggcctgggcccctgcgcccctcccgggacagc

SEQ ID NO: 574994 - DNA, 401 bp, Homo sapiens
  misc_feature (48)..(48): n is a, c, g, or t
  misc_feature (175)..(175): n is a, c, g, or t
attcgcggccgcgtcgaccgccaaaccacggtctactgagccgcaaancgggttttcatttccagaggttctaaacagatggccgcagtactcgtcggacaatttcatgccagggatgcggaaggtcgcgtctattccgtgcatgaattccaggaatccacgccttcagccgaangctggccggcacggagcctgtcaccacctacaaactggccattggcgatcgcgtcaacaaaatcgaccacaactcatttcagctggttcaatccggggtcacgctcacccgtgaacccgagacctcgaccgcttcctgatctgggacaacaggcgcaacagccacctgaagtcatgtgcgcagacttgagttaggagtcgacgcggccgcgaatttaatagtagta

SEQ ID NO: 574995 - DNA, 1026 bp, Homo sapiens
  misc_feature (334)..(334): n is a, c, g, or t
  misc_feature (509)..(509): n is a, c, g, or t
  misc_feature (632)..(632): n is a, c, g, or t
gcttcctggcagggtgttagccggcagaacatagggtgtcggtgaaatactacccctgagaaatcataatgggaaatggaaaatgactcactagtacaacagtgtgtctgtccttgcgcatctacagtatgattgcagaggacctcagttgcatacacatatctggtctcagtacatgaagtcttatagaagtgcagcgagtgtcagtcagcaaacgataaagggaaactcagtctgggagattatatatgtctagacggaatgggatggggtgtatttgaagatgagtgaataaaagggtcgtacctatgaaggtgagtagaactggtatctnttggtgtatcaatatcctgttacataggactcgaagcagttgaaaatggtttgggctactcccacacggtgtgcattagttctgccatgtggaggcaatagtatcggatgagggctaatggagagtataacttatctcgatgagtaatatcttgaacgtatagaattggctgggncaaagaggaaaaccattgaacgaaacttatagattcagaaaaagaaacgactgactgtaatcatggggaatcaatttgttcaagggcgtgaaaggctgggtgctttggatggccttagagatntgctcgtcattgtcaatgtgatagatgtgtgtatgacataatttagataaggcttgggggataatccttacccacttagaatttgggacatgagcgcttcgagcaagtgaagtggacccatgcgtggtctttagcaactaacttttgggctgttgcatataccatatgtcaagtgcgttcgggttgtggcaacgagaagaaagggatattcaacatgaattgcaatactttacagttacagcaaagagtatttccagcgaaaatttggttgatggaaattcaagacacttttccactcctaaagatataccattggggattgcaaggtccgaaatagtgctagctttttgttgaccaaatttactgagttagggaattggttgaaaaaggaagc

SEQ ID NO: 574996 - DNA, 109 bp, Homo sapiens
  misc_feature (74)..(74): n is a, c, g, or t
  misc_feature (98)..(98): n is a, c, g, or t
cagaagaaggagaactcatgattccagagagctttggggcttatttttaagtacttagcaaaatatttgttttncgtgatttagcttgtcattaaacnaagagctactg

SEQ ID NO: 574997 - DNA, 1213 bp, Homo sapiens
agcgggtggagaccatggagctccaaaacgcggaggtctttacgtcccggaccaacgagtgccagggacaatgtgggcgccaacttctgccaccagcctgggtccagcatgccccagaccagcccacctggaagtcctccttgtattcctccctcgcctactctgaggccttccactacagcttcgcagcccggtcccgcctgcctcacgcagcttgcgctggcgcagcgtcccagagcctcagcggcttcgtctgcgcccctcctcgctgcgcacccaatgatatctcgcacttgctcaccggcgtcttccgcaactttgtactctgccgaggtcatcggcgacgaagtgagcagcaagcttgatcaaggcccgcggcagcgagaatgagcgccacagaggaagttcgtggaccagctgcagcagaatcgggagctctataagcatgcggctggatgagtttgaaatgttggagagacatatcactcaggcccaagcacgggctattgcggaaaaaatgagcgggtcatgagcccaaggctgggagtcaccaggacctcgagagccttgtcagggtggccatccaagtgacagagtgtctccagatggtgtataagacaagcgagtagcataagggaaacgatcatattgattctcccagagaagattactacagcgatagaagtgccgaaacacatctgcaactaaaggcattccctactggattgtcgaagagtgacatttagctgtgaggaagctgtcacgaacagaagaaaggagctgaacaagaaagatggaagaatcagtgagtgtagaagagtgaaggagattgaggatgagtataaggacatggtgtgacgacttgagcatgtattaaattccaagggcaagaaaggacagagaactggtcaagagaggagactcgcacagagaaacacaatggcatgaaacaagtaaaaggtagtgcaagagagaaaacagaacaaaaaattcgtgcccagacaagggaataggcaaccaaaccaataaacaagcacgcagaacaaccatcacacgagaggcaggaacggagagaggaagacacagcgagaagagaacaaggtgaatgcatcgaaaacgcaaccaagagggataacacacaacgagaacgcaaagaaagagaagacgaacgacaacagagagcagaacgaatgaagaagagagaaaacagaaa

SEQ ID NO: 574998 - DNA, 1827 bp, Homo sapiens
  misc_feature (1482)..(1482): n is a, c, g, or t
gcctgacgaggccatggaggacggcgaggagggctcgcgacgacgaggcctgagtgggtggtgaccaaggacaagtccaaatacgacgagatcttctacaacctggcgcctgccgacggcaatgcttgagcggttccaatggccacagacgctgtgatgtgttgtgggaccaagactcctccaacatcgagtgctggggcgcatctggaagctcatctgatgtggaccgctgacggcatgctgggatgatgaggagttcgctgctggccagccaccctcatcgagtgccacagcttggagagggccactgggcttgcccggaccaaagcttagcccccaggtggccttgcgtgaccagtcgctcacagagcgaagggccaacgaagggtgcttccaggcggatgcttgatgtccaagagctctcacctacaccaataggtaccatgtcttgtgcggcataccatcgagcctaccaagatcgcggtttgccgtcgacaagagtcctccctgatgtccagagcatctagaacgaggggccaccagtgagtgcgttgcaccgaacacacgttgctccctaggttcatagagttgaagtggaacacggggtggggtatgaggatcaccgtactacttcgatcgtatgtgcaggaccggaaggtatcaagaccctgcggtgcctgagacagagcagtcaagattgcgagagaagtaggcagatcctatgagagtagccatacgaccaggttggaacatatactttcctcagatacccgaagcagcattagcagtttcaagaagatctaacgtctcgaccttagtggacgtgcctcgccctctaagcgttagatagttgtgcgcccatagtagcccaatcagttcgtaatgcgaagccttgggtgaatatttagttcctattaaggcactgcaagccgtgacactaggacacaccacagatacatagaacgatgcccgcgtatcatttggcgaaaggagagccgttttacccgaggttggaggacagaggagcaccgtttaactagcaaggtcgccactgggatgaaggtccgtgcccataaagattcgcgtatagatatgagggttcgccattccgaagcagacgcccctaacatcgatgtgagattagagacagagttcatcttcgtaggagactttatcgcattcgaacttaggccagtattgtacacgctacggagaggcccccgtatacatatgagtatacgagacaagacaatcacactagtggcagagaagcaggtaggaaacacaaagccagtaagagctcgcggagactagaataaggcgtcgtcagagggtatatggagaagagcaactagaaagaggactacaaactggagaaaggccacatacagtaaaagtagcatcagtcaaagaatatgcgagcacgtaaagcaggagaccaaccgtgccgaatttagatcggagtggaggggcacacagtgnctggaccatacacgcatgtgaatgacatggtgcggtctcttccatattgtgacatgagcgagccggcggagattcagggattggagccgccgagaacgtggcgaggaggggtgaagatttcgctgcacgacgtggtggtgtagcgcggagccagaggtgagaacgggacatgaccatggaggcggtgaagtttcgtgatggttgagatgatgctctcagcgagtacgagcaggaggtgatctgctgagaagatcgacgagggcagagattagacgctgccaagacgaagagttgtgacgagccatcacatgtgatgatgatagttcgagcacgctgaacgcgtga

SEQ ID NO: 574999 - DNA, 125 bp, Homo sapiens
ctaaacattaccaggttagtggcatcacctgtagtgccagctattcaagaagcaatggagagaggattgtttgagcccaggaggttgaggctgcactgaaccatgtttgcaccactgcactccag

SEQ ID NO: 575000 - DNA, 862 bp, Homo sapiens
ggttctggcgcatcgctgtgcctcgggttccgcgccccgattgagcagtcctggcccggagcgtcaggtcctggtaactctgtattgaaaaggcgctgttggacccagtggtggctaaaggccgagatcaggtccctcgtgtgagagcatcggatgcatgtctccttgcgtcaaagataacactctccaagggagggactgacccagattctttgaatctttactatagccattggcaccatttgcgaatccaggtgaatgctttctagtgagtgttattcctagtatggagctatctccattcctacgaataggacgttgggaaagataagcgcatgcgtagcttagcgaaaccatataccatgggacgttggtaaccacgatgactgttcagttgttgctcggaagacacataaccacgctagaccttgtagtggatctacgaacgttgggagaattgcttttccatgtgtcattaaatcgccaagatctgtggaattgtgcccttcaactattgggacgcgacagggaaagcacaggcagcctttgggaaacaggtcttgttgaaggggacacacgggaaatggacaaggatcacaattaatccccaggaagttgccttgccgcactaaaaccccacaaagagggaaccctctccggcacagggaacttgacaccaaatgtgttccaagggccatctgtagttgggcaacgcaattgctccttgactgtgaccgtgggattacttgcgttggcagcgcagacaaggcccagacagttcgccgattccaatgccgtttattgctacatcccaagtcattgcctttgtgccctgcaatggatggtatgaacacttgaagta

SEQ ID NO: 575001 - DNA, 791 bp, Homo sapiens
gcccaggcgttaaaccagccaccgcctccgccccacttcctccggctccgcttccctcgccttcccgctccttctgaggatgtgggaatccgcccgcgccccagccccctccgtggctgcggacccctctctccgcgacccagctgacctccgtggcccacttccttggcccagaggggcctgggattggcaattcggctcccgtctgtgccccgctagctcgtctcccgacctcccgctagaccatgtatcctcgtaaccagtgtgcattccgcactaggtacgcccctggtcgtccagagcggcctggacggaagagatgacagtgagcggggtgcttaatgctagccaccattcgatccctatcctcacacttcagattctatcattcataaaactgttcccagtacacacagtcgtgtcacatagatgtgactcgcctgttagcaagcaataagtcaccatacatcagggtaaatacactgggtgactatgtataagtccactcgtccccgggtgaagcctggcgaggcagcagaactttcagcctagagcaatcccttggattgccccgacacgcggggccccccacgagcaagagacagggatgggcgagctggcgccgaaggggccccattgggcaccagcgtaggccttgcaactaagactgccctgggaaggatcgaactcagactaacccactatcaagaatcgagattcccaccgaaacagcattgacaccaacgcgtgttgcatccaatcccttgcgacgaagaggacgggagatcaca

SEQ ID NO: 575002 - DNA, 1119 bp, Homo sapiens
  misc_feature (576)..(576): n is a, c, g, or t
  misc_feature (835)..(835): n is a, c, g, or t
  misc_feature (838)..(838): n is a, c, g, or t
  misc_feature (855)..(855): n is a, c, g, or t
  misc_feature (858)..(858): n is a, c, g, or t
  misc_feature (871)..(871): n is a, c, g, or t
  misc_feature (874)..(875): n is a, c, g, or t
  misc_feature (880)..(880): n is a, c, g, or t
  misc_feature (884)..(884): n is a, c, g, or t
  misc_feature (899)..(899): n is a, c, g, or t
tgctgttcaggtaagttttaaggccatcatcatgacttctggaagaaaaagagctccttgtggaggttccctgaagttctctctgagatctaaagtattctgaccccttaaaggtcgatgttcttctcaaggaatggagaaccaggttcttcgttacccaatatcaccagattctgttaccttcttgtggaagagttttggtcattctctggaaatatctgaattcattcctgagcggtgcacagggcaggtcccccgtttcttgccgaatgcccaatgttcttgggacacagccgacgatgcaagtttagcgaacccaccatgacagcagcgggaggacctcccgagccccgcttcgttacagcagaacgcgcggttcaagttttgcgcgaaaattggtggcccgccgccgcccccctcgtccccattgttgtgcagggcgaggccccggcccccccccgcccgggggcacgcagtgtctcggcgtgcctcgcgcccgcagacgcctgggaactgcggccgcgggctctgcgctcctcgccaggccctgccgccagggctgccaatccttgcccngccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacgtagctacagaaattgacaganganagaagagaccattgganaantgatgggcctgtnaanncgaangtanagaaagtccaacaanaggaaggaggaagtgatctgggaatgtctggcaactctgagccaaagaaatgtctgaggaccaggaatgtttcaaagtctctggacaaatggaaagaattctgctgcgattctgcccttcctcaaagtagagtccagacagaatctctgcaggagagatttgcagttctgccaaaatgtactgattttgatgatatcagtcttctacacgcaacagaatg

SEQ ID NO: 575003 - DNA, 442 bp, Homo sapiens
cacacctatccttctgaagagctgaaggctaattaatctgtaatggccaagaacttctacttcgatagaaaaatatttctaatgacccagtctacaaattatttcttttacacaaatatatgatgttattctttggacactaggtggtcctacacacagtaggatcaattgctaatctactttgtgaaaaagaactaagcactaatcaataataaggcttacatctaattctcaaaggtgcttatccattttcttgctaaattatccttcttgtaatttggctaaacactaaaacatggaatttttagtttgaatattttgaagtttgaggatgttgggctttccttattgtaaaaaatgttatgtttgaaattattcctgttttcaaaaatggtaattaagtcattaggataaactttctaataaaaaaaaattatgtaaa

SEQ ID NO: 575004 - DNA, 270 bp, Homo sapiens
  misc_feature (74)..(75): n is a, c, g, or t
ttcaaaattatattttagatatccatccatgtaaaattatgaagatctgacttatttacttgccttgggaagtnnatataattttctgtcttcatttttttcaatctgtaagccgtgcataattttgcttaactcataaagcatttgtgaaagttaaatgcagtgatggatttaaatgttaaatgtttgtgtgtatgtgtatgtatacaggcacacctcagagacactgcaggtttggttctagaccaccataataaaagggaatatcac

SEQ ID NO: 575005 - DNA, 81 bp, Homo sapiens
accgaggacacagccttttatcactgtgctagagatcagttttggttcgggagatactacattgactcctggggccaggga

SEQ ID NO: 575006 - DNA, 228 bp, Homo sapiens
gctaatgataccatggtgggcgatgttaaaaatttccccaatcaggggcatgttcacgccaggcgaattatgactccccagtcctccaatttagcttgtggggattggaaaggggtaggcgacctgccactcatggctgatacaggaagcatttatgttgcctttattccccccaacatttttgctgaatcgcatcccttgtaatactcaagaaatatgagaaacaga

SEQ ID NO: 575007 - DNA, 300 bp, Homo sapiens
agccctcctcaggcgcttttggcaccctgcctctcccccagccccaccatagaatataacatgctgtgctgtcacttaaaaccccctttgtcatggccgggcgcggtggcttacacctggaatcctggcattttgggaggccgaggcgggcggatcacttgaggtcaggagtttgaggccagcctggccaacatggtgaaaccccatctctactaaaaatacaaaaattagccaggtgtggtggtggcacgtgcctgtaatcccagctactcaggaggctgagacaggagaatcacttga

SEQ ID NO: 575008 - DNA, 982 bp, Homo sapiens
  misc_feature (569)..(569): n is a, c, g, or t
  misc_feature (580)..(580): n is a, c, g, or t
  misc_feature (601)..(601): n is a, c, g, or t
  misc_feature (609)..(609): n is a, c, g, or t
catgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttganaaatgtatganaggaataatgaaagggtaaanagaacaangggtgctccaggaagaaagagtccccccagtcttcatccgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataaggcactgtttggcactctgggcactgtttgggctcgt

SEQ ID NO: 575009 - DNA, 330 bp, Homo sapiens
gactggtgtagaggttggatgttgcagtgatcaaagaggctgtgtctggctgttatgataggggtagagtatggtgatattgaaatccaaggatttcatttaaagtagagaatcaactgaacagccaaaatacgactatacccactttgccggactaacgacgactgtgtattacacggacgactgaattaggacgtttacttccaagaactactagggtgaccggactgggtccctagtgcacggactatttgcttggacctggcgacggaacggaaaacttatgaccacctttttagggacaacctaaccacggcttcccgtgacctt

SEQ ID NO: 575010 - DNA, 224 bp, Homo sapiens
tgtggcccacactgccgacgtagaaggtagctcatgagttggaccccagcgcggtgaacttctatatgctacagagtgcggccctaaaaatgcaaaaaaaaaaaaaaaaaaaaaatttgacttgcagttgtaagggaaaaatgattttgccatacctccataccagtttttgattctgttttcaccattgtaaggcccctttctccggggtggcgtggtgggga

SEQ ID NO: 575011 - DNA, 889 bp, Homo sapiens
gatcgtcgcgaggcagggtgggtcggcgggctcgtggcatggcgtgtgtctggatgtcgatggtaagggagactgcgtgcctctaccagtgtgcgtctaatgggccaggtcctggtcgctcgagagtggtagcctgccggaaggggaacgacaccggactgtgcaatgggcacccaaagaacgaatgggcatctacgcgtccatagggacacgagaaccacatcgcggttgatccgagccattgactgtgggcgagcagtgaggctgggcttagagttccactggcgtagtgaagcgatctgcagggatgtcgttagcggggacgggaacgtggttcttaactgcacccaatcacgtgctatgacgctccgtggcaatggtgcaggggcataacctcttcataatgggtcttccataagctatctaatatacctattactggccagtaatgagatcacggctgaatacctaaacgtctcacatgcattgcattggtgtaccatcacagcgaaccagatatggtggaatcaccgatgctgccacacgtcagcatctggctcctttcacctgattggacactggtggtgaaaggccatgagcctacagacggggggcaacggggccatgcgcctgcttgaactgatatgagaccaggacgcaaatcggctgccgcgacacccgcaacatggaggcaggacactcaggtcaccagagtaaacagcaagaatcaggccgaagtacacgggcacacaaagatcgaggaaaacaacaaaaaaggagggggaaagccaagacgcagcgatgcacagacgcacggatgaggctgccatacacgagcgaaaacgtgatcaagatggggggacgaatgagacgcagaaggaatctgcaa

SEQ ID NO: 575012 - DNA, 344 bp, Homo sapiens
atggactctcatcgcgttaggagattcagtttcccaaaagcaaagagacgaacctcatgtcctatgcccctaagaacacgtctccagaactggcaaagctacaggaggaacagattagtctgttgtcagcagatttctaacacctccctcagggagtggcaggtcagcaggatgtagaatgaacacgtgacgtatacttctatctgatggatctgtacaaacactgattccagcaactgcagagagcacattcttttcaagcactccacagttacgaaggctgatcataagctgccactgaccaagtttcaaaaatctgatctgataaggacgaagtttcctgg

SEQ ID NO: 575013 - DNA, 1274 bp, Homo sapiens
gggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgagggtaatgtggttgactgcctgatgcggccggttgctaaccggtgccaccatgcctttgacggaattaaaccggcattctccatgcctctgtcctgagggcttcgctggacgcttctgcaccatcaacctggatgactgtgccagccagccatgccagagaggggcccagctgtcggagacagtgtccacagaattcagacatggctcatgcccacagtggctatgagtggcaaagaactgtgagcttgtcttaccatgtcccagaccacccaaacaaagatggacaacccatctaagagacccacctcaaactgtagatggtaacctgcccacgagggcacaagacccaccaacaacgcaagggcatggatatgctgaggatcttcagatgaaaagacggtgcgtgcaggaaggccaaaaaggcttgcagactaaagatgagaccataagcattagagtaagagcccatgagatggaacagtaacagaggagccctacacataggatagaccatcgagatacatggcgtacactagtgttatactgaacccttaaagaggagctgggagcacagagatagtatggccacactagggaacacattgttaggaataccatagacacaaagatattggattacaaagattgacaggatcccaggaagtggtacaaggtaaaaaggctggacaaacaagagaaacacaccatggacaaggtaagaaatggaccccagaggcggaagaagaacccacagcgaaccgtaaatgacagagggaggaatatcgacacccaaatcactacacgcatttaccacccacacaatgagggcgatgcaggctaccaaccccatcaggacggggaccaccacgaggagacaaagtacaccaagcacaaatattacatcacacaaggaggaggatatcaaaaaacgtcaagcaaaaaacaagagggcagaaactaccagacgaacagccgcacactgcagacaaggtagcatagaagaggcaacgcacaagaagcacgcagccaaggagcagcaccaccatgacgtttagagacatagacgcaaggccaaacgatacaccacgaa

SEQ ID NO: 575014 - DNA, 325 bp, Homo sapiens
gcccccaacccaaaaagagtaaaagggccaaaaaaggaaggaaaaaagcaacccaaaggggccaaagctaacccggaggcacccaaagatttatccaggggctccctcaaagaaaacaggaattccctctcccaattttcaggccctgtggggcccctgaggttaagcagcgggaatgccccctctttcctccaagggcctgttgcatatggaaaggaaggagaaaccccaaagcagatccctgggaccggctttcagtggaagagggggctccccttaggagccatattcaactacagccttctaaaacctgcgccctcagcca

SEQ ID NO: 575015 - DNA, 577 bp, Homo sapiens
gactcgtcaggtcaggctcgaacggaacactagttatccgcatggccccaatgagcataagcaaaacttgaaatttaccactgggctactaattcagcttccttatcatagagaacattaaatggttgatgcaatacatgtttgtcggcctccaacaactccatcccaccctactactcatcttcaaatgctcttaaagcaaacgacatggcctcaaaacgcctttccacctcactgaataacgcacgtgaaatcctcattaacagtccatactgttaagagggctctcgtttggacatagttgtccactgtcctgcatcgttggacttggcctctcctgagctgacaagaacatccacagcatatacttcatgtacctcaaattccgctttttcatggtccttcttctgctggtctgtgggcttctggataatggtttcttctccatcgattgcatgctgcttccactggtgcgacagcataacttctattggcgtgccgttaaatgagtgggcactttgtccaggcgtctgtccttgtgtgttcttgttccaggtttgacaggcgtaggcagctc

SEQ ID NO: 575016 - DNA, 239 bp, Homo sapiens
cccctgatctctataaaaaacacaaaaattagccaggtgtggtggcgcgcacctgtggtcccagcatactcgggaggctgaggcaggaggattgcttgaacacaggggtagaggctgccatgttcgtgccactgcactccagcctgggtgacagagcatgaccctgtctcaaaaaaacaataaataaaataaaacagggatgaactggagaaactgtgaaggtgatcgtggggttgtaa

SEQ ID NO: 575017 - DNA, 341 bp, Homo sapiens
  misc_feature (303)..(303): n is a, c, g, or t
  misc_feature (311)..(311): n is a, c, g, or t
  misc_feature (331)..(331): n is a, c, g, or t
gaatccttctgtctcggcctcccaaaatgttgggattacaggtgtgagccaccacgcctggcccacgttggtatttaatagacggaatactggatttattttgttttcttccagtaatgtttctcatcatggactatcacattttactgaatgtcttcagcaatcgcctgtttctatttctgatttccagttgataattagacttctttatgcatcatttgtgttatttttttctaaatatatatgtatatttgcagcttatatgctgccctttttttctcattcagacaactttaggaatanttttcctntttattaccaatattttccnatttagtagg

SEQ ID NO: 575018 - DNA, 134 bp, Homo sapiens
gcggtgcactcgtatctgttttcctttctttgaggctgatcatttcccgagtgaagctggggcacttgcttgagcggttgttgggagacacgcgcacatggggagataggagggcgtgcgggagagaggagtag

SEQ ID NO: 575019 - DNA, 666 bp, Homo sapiens
ctaaggaaaccaaaaaaaaaaaaaagggcgaaaaaaaaaaaaaagcccccccccccgcaaaaaaaaaaatattaccaaaaaaagcccaaatttttttccaaaaaaaaaagggggaaaaaaccccccaaaaaaaaaaaaaaacgccggtaaaaactaaccaacgggaaaaaaagggggaacaaaaaaaaaaaatctttcccaccacaccgagcgggccacccctactccaaaaaaaaaatttgctccccagggcgggaacaaaaaaataaaaacaatttccccctcccaaacaaaaacaaaaggtacccgctcctcaaaaaaaaaccgctccgtgggcgcgcccccaacaaagggtgtaaaaccctccaaaatgcgcggcaacaacacaacccaaacaacggtggggcggtggggccaaacacggcaacacctaaaaatattcgccgccccacccccaaaagagggccagaagcgccgccggttccgccccaaaccacaaaaaaatgcggcgcccccccccccagagaagaaggaaaaacccccccccccacaaaaaaaggggggggacaccaaaccaccccaaaataatcttttgggaggggcgcaccgctcaatcaaataaaaaaacaaaatttaataccccccaaaaatgtagggagggccccg

SEQ ID NO: 575020 - DNA, 848 bp, Homo sapiens
gctggtgtttagcaactccgaccacctggctgctgaggagtgctatgagcgctctacagcgcgcatagaacctgatgtcccccggcccaggtgcctctcattgcgtggaacatgggtgctgtagcgcccgttgtccagacaggtccaggctcatccatggatgccgtcgatgccgattcttgtgcacggggcgagggacgtgtgcacggtcggaatggactccgtactactcgcgtgatcgtgtgcgtagttcgtgtcatcgtgggctgctctctctcgtgcttcttcttgaggacccggcgacctctcaccacaggaaattagttacttccagtgttccctggagagctcctgatgaggcatgctgcagagatgagtagatcctgctcacctgggtggatcgtccaagctatgcagtgtccggtacattgccgtcccttggcatgcgcaagaatctctaggccgcctgagcgatcgcgtcaccggtgatcgtactaacctgtaggaccaccgttcatggcgtagtcaatcgagggcatcttcagtggtctcctatcatcgcagcccaaggcatgcgcggcccagacaggagaccacggagcagagtgggaagcccatcatgagctcagccgatgccctgttggacctcatccggaacatgttcccaggacaacctagtagaagccaaattcaaacgagtaccgaagcaaggaccatcccagttgtcaagtccgcccaatggtggcaccatgaggaggccccatccatcgtgcgggatcctcgatctacgtgggtccagtgaggagacatggctcacatgtgcagaacttcgacctggaactgaacca

SEQ ID NO: 575021 - DNA, 260 bp, Homo sapiens
ctgtggactccacagcctatatccagactcgagcgcgcagcgacggaacacgtacacacttcacctccgtaggcacacctgagcttggtcgactgcctgcctgccactaaggccttcagattattagccttgccacatgtaaacgctatcaacaacaacgctgttcattgtccgatccggccctgtaaaccctgcgcataggcgctcgcctaggcgcctcgggggccagcggccatttcgatattccagctattacgata

SEQ ID NO: 575022 - DNA, 350 bp, Homo sapiens
gtggtgggacgccttatccccgcccccagggggcatggcattgtttccgcccctgtgcctaaaaaactgctcatgatgggtgggatcgatggctgctccccctcagcccgggggtgcattgcccccctggggaattttgccaaggcccccttttatgcccttttttaaacctacaggtacctgaccccccccctttggaaggagactgtattcccccagtttccctttcaggggtttcttgccccccttgtcaaaaccccccccagagtttccgtgcagcggactcaggctcccgctgtgggtcccacatagggtttttttcccaaaaaaattaagtgaatttagggtta

SEQ ID NO: 575023 - DNA, 85 bp, Homo sapiens
tctcatagatttattactgcgtcatattatatatagatatatgcatatatacctttttttttttaatacaatctatatacccttc

SEQ ID NO: 575024 - DNA, 338 bp, Homo sapiens
gtgtcaggggtgcgcagacgatgccgcccgcctctccgggcctgcgagtgggctggcggataccggagtccctgaggtcaccggcggaggatatgagacttcacaacctgctaaaaatgagctttcctaacaacgtgggacctattcttctacgcgtaaactctcttagccatgagagatcagacaaaatccaaggccagagactcattttcttccaaaattgcttactctgaaaggttttaaaaataaaagtgggaagaaatgtgaaaagaaaataactcgggaacccaattcactatgccaaaaggaaaaataaagctgaaagctgagtcatgcaa

SEQ ID NO: 575025 - DNA, 591 bp, Homo sapiens
gctgggaccgtgctctgacgtctccgccgtatcttccgaccctcgccgccgcgcagctccccgcgctcgtgccaccgccgccggtcaccctcagcgccaccgcgcatgcgggagatcgtgcacctgcaggccggccagtgcggcaaccagatcggggccaagtttgggaggttatcatgtgacgaacatggcatcgacgcccacaggtcactataccatggggacagtgatctgcaactggagagtgatcaacgtgtactacaacgaggccacaggaggaaattatgtccccagaagcggtgctggtggaccttggaatcccgggcagccagtggatctcttgtccgttctggccccttctggtcatgatctttctgagccggacaaccttcgtgttttgtgcgcaattcctggagcctggcaacaagctgtggcacatagcgggcctctatcagcggacgtggcgcatgcatgcttggtgcgacgctgtcctggaccgtacgtccgcgacagggatggccgacagagctgcgacctgtccttcacgtgggcttccctagctgacccactcgctggagggcggtggcacgg

SEQ ID NO: 575026 - DNA, 655 bp, Homo sapiens
  misc_feature (484)..(484): n is a, c, g, or t
  misc_feature (574)..(574): n is a, c, g, or t
tcccggtccaaacacagctgcggggatgaggaaactgctgtccagaataccccacggatattttgttccagccaaaaaccttggggaaatctcctgtgccatcgtgcagccacattgaaaaaaccagaggctgcgtggggaacggtggaggcagtctcagaaggaactcagtgagtgggctccaaagttactctcagattgagacgtgactcaattcgtggccttcatattccacagcagggtgtgacatagccgtgtttcatttccacagattaaagagatctcaaagaaactcctcattattacattacacataggaaattatttctccagccattcaaaattaatgtgacagcaggtgctcattttagagcaacacagatgtgaacccggcggagacctgtgccctcctatactctcacaccattcacatgtggaacccacaccagtgtggtttctccccccttcaaatctcgggcgtgantctcgtgcatctctgtgagaaactgtgcctttcatctctttagaaaggaaaaagcctcccgaggctcccctttctctcacaaggcacacncacagagcccccagaaagatgtgggatgatagttgctgtcgctagtgcagtgcggtgctattccacgcgacaccctgtggg

SEQ ID NO: 575027 - DNA, 309 bp, Homo sapiens
  misc_feature (3)..(3): n is a, c, g, or t
  misc_feature (84)..(84): n is a, c, g, or t
  misc_feature (101)..(101): n is a, c, g, or t
  misc_feature (112)..(112): n is a, c, g, or t
  misc_feature (134)..(134): n is a, c, g, or t
  misc_feature (279)..(279): n is a, c, g, or t
ggntcaaaaaagtttattttctggccccaggcacagtagcttactccctgaaatccccagcactttgggagccccaaggtgggnggatcacttgaggcccnggaattcaagnccagcccgggcgacatagcaanaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctancctgggtgatagaagtgagactttgtctca

SEQ ID NO: 575028 - DNA, 139 bp, Homo sapiens
tagcggaccctatatattctacaaatagtaattctctagccatcatttggagtatttaaaattcttcacccgtttttaatgaacacaaaaataagtcttatgtcttcattaaaaacgggtgaagaatttgaacatttgc

SEQ ID NO: 575029 - DNA, 386 bp, Homo sapiens
ctgtttgctcgactctagagatcccactggttgaatacgaagcaggtttgttcttccctttaattctacgagttcctagtgaccatggaagactgaaaagccactagccagtttatcacctctaggccgcatcgttcgtcgtggagctgtacaacttctggcggctgtgcaccaaccttgaggaatccctcttaacgaacctacgctcagttcatgccacacgcgtgctcttgagaagtattttgtaaaacattctttttaaatcacctacaccccttatccccatactagtaattatctgaaaccattaggctactcattcaaaccaatagccctggccgtacgccttagcgctaacattactgcaggccacctactcttgcacc

SEQ ID NO: 575030 - DNA, 180 bp, Homo sapiens
gaactccgatttggacaggagaggaagtgctcagagacaaaaacaactggcaaaatctccagagccgaggcgtccactggccaggatccccaagggcaggcccaggcgaggagctgggcataacagggaaaggccgcctctccagagggggatgagagcaaggtctcggagcatctaagt

SEQ ID NO: 575031 - DNA, 498 bp, Homo sapiens
  misc_feature (32)..(32): n is a, c, g, or t
  misc_feature (64)..(64): n is a, c, g, or t
  misc_feature (85)..(85): n is a, c, g, or t
  misc_feature (116)..(116): n is a, c, g, or t
  misc_feature (138)..(138): n is a, c, g, or t
  misc_feature (141)..(141): n is a, c, g, or t
  misc_feature (153)..(153): n is a, c, g, or t
  misc_feature (160)..(160): n is a, c, g, or t
  misc_feature (170)..(170): n is a, c, g, or t
  misc_feature (183)..(183): n is a, c, g, or t
  misc_feature (218)..(218): n is a, c, g, or t
  misc_feature (224)..(224): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (267)..(267): n is a, c, g, or t
  misc_feature (272)..(272): n is a, c, g, or t
  misc_feature (276)..(276): n is a, c, g, or t
  misc_feature (323)..(323): n is a, c, g, or t
  misc_feature (336)..(336): n is a, c, g, or t
  misc_feature (341)..(342): n is a, c, g, or t
  misc_feature (344)..(344): n is a, c, g, or t
  misc_feature (349)..(349): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (364)..(364): n is a, c, g, or t
  misc_feature (366)..(366): n is a, c, g, or t
  misc_feature (370)..(370): n is a, c, g, or t
  misc_feature (466)..(466): n is a, c, g, or t
  misc_feature (471)..(471): n is a, c, g, or t
  misc_feature (476)..(476): n is a, c, g, or t
ttacagcacccccacgcccctctctttttggncctcccccccaccacaacccccacccccaacncgcccaccctccccccccccncacccccccgcccccggcccccgcttccccnccccccttcccccccccccccntcnttccactcttanttttttnttttcttctnttttttttttttnttttttttttttttttttttttttttttttttttntttttntttttatntntatatnttttattttttttattttttttttctnttttntttntgcttttttttttttttttttccattatttttttttttttctgtttnttttttttttccngctcnntnttttngtttcgatntntntntntttnttatgcagtttgtgacattaatagtattgtaaagttacattttaaaataaacaaaaaactgttctggactgcaaatctgcacacacaacgaacagntgcanttcanagagttctaacaataagtaaga

SEQ ID NO: 575032 - DNA, 354 bp, Homo sapiens
  misc_feature (226)..(226): n is a, c, g, or t
  misc_feature (322)..(322): n is a, c, g, or t
  misc_feature (327)..(327): n is a, c, g, or t
  misc_feature (332)..(332): n is a, c, g, or t
ggcatagtgctgacatatattcagagtgttgtagttttaaggttagcgtgacttcagttttgactgaggatgacgctgattgttagctgttttgacattctatctatttgtatatatataaatatattaatgtatgccagtcttggctgaaatgttttatttaccatggttttatatctgtgtggtgttttgtcccggctcgggctatggcccgagagctgctttnttatgcagtttgtgacattaatagtattgtaaagttacattttaaaataaacaaaaaactgttctggactgcaaatctgcacacacaacgaacagntgcanttcanagagttctaacaataagtaaga

SEQ ID NO: 575033 - DNA, 384 bp, Homo sapiens
  misc_feature (116)..(116): n is a, c, g, or t
  misc_feature (131)..(131): n is a, c, g, or t
  misc_feature (203)..(203): n is a, c, g, or t
  misc_feature (221)..(221): n is a, c, g, or t
atctcatttacgcaggtgagaggagatggtatagtgttaatggaactgctggctgagggagtaggctgatttccgacttctctgcagttatgacacagctctctttgtaagagagngacagaactaaccanccaatggatgatttcagggggagaggtggagggcagatgtcctgggcaaaccgggccccttctgccacacanctcacttgatccttttgncaaacttgtcaaactcagtggaactggcttcccagttgcccctttgccatattccaagtccccctcagacttcatgtctctgctcatcagcactgtcccaggatcctggagagggagaacccctggccccaggggaaagaggggggggtctcccgtttcctgt

SEQ ID NO: 575034 - DNA, 111 bp, Homo sapiens
tgaccggtactgtttggacacgggtacttcctgacctcggcctgcctctacttgccactctcttctttatcagatggtactttgtcttcttggacgcttttctcccttcac

SEQ ID NO: 575035 - DNA, 356 bp, Homo sapiens
cattgacgacttgtgccaggttatgcctgtaagtatgttattgccaccttgtggttgtgttgtgctaactgccaccttatttgtagtcttctaatgctattctttctttaaaatcaggctttccttttagaactcttctctgtcttactttttaaaagtcccttccttgcagagacctattctgcaatgtgcctgaactcttacagaacagtacagattttaggtctgatggccattgatttgaatgccgaccatgccatttatgggctttgtaaacttgagtgagttatttaacctctctgagcccaaatgtccttatggcaatactaggttattttaaaaataataatgaaaag

SEQ ID NO: 575036 - DNA, 509 bp, Homo sapiens
  misc_feature (117)..(117): n is a, c, g, or t
ggttgcactaactgcaaggttgctgggaagtagagtccattggttgatgagcttgactgcggtttgggaaccttacctctcctccttagcccaatatgctgtctggggtcctattcnaaataaagttgatttctccttggtctcaaaaaaaaaaaaaaaaaaaaaaaaaatttttgtgggcggtttggcgccttggaaaaagtttttataagaccatttcttgtgtggcgcggcggcggcccaagtaatcgggtactgttgcacccttgggtccatatagcgctgggtccccaaagagaaagaccgtggccaaaggggactaaggtgggtgggttttcctcaaccaattaaaaaaaacgccccggggggaacacccggcgtcggttcctggaccaactcccagaatgggacggtcccgggagcgccaatccctggggcctctatccacccggggcgtcccaagcggagacgccggaatattcaaaattaaggccccgccggtgtaggaa

SEQ ID NO: 575037 - DNA, 225 bp, Homo sapiens
ttccctggggacccccccccccctgttttttccccccttagaaaccccggggcccgttcccccccccggctttttccttgggcccggggggggtttccttttttccccggggaccccttttgccccttgggcctttttgggggccccttttaacccgttttttccaaaaaaccgggtggggccgggccggggtttcccgggtttttttgcccccccgggccccca

SEQ ID NO: 575038 - DNA, 219 bp, Homo sapiens
ctgagtaataagcagcctgacttcactcccctcaatacgatctccgcctatggaaactcttttaatctaactggtgaatgtaatcagcaaactcggataatctcgatcgtgcaatcaggcctcacagaggagctggaacgagttaaatagtggaccttcatacctttgggagtcgacagcgaaagatcccagtccttcctggccagccagttccggctc

SEQ ID NO: 575039 - DNA, 544 bp, Homo sapiens
acgacggggtctcagaggcgatctgcagtggtcaaacacacactgggggaacgcctgtggccgcccgtgtgggacctcaggtcagcggtgaagccaaaggactcgtggacgggcagataggccttgaccacaaagatgggggtgccggccacctgggactcctcgaacacgtggccccgtttcctgtccaaaaccccgtagatgccaccgaccacctgctcgtggacactggatctccacaaggtagatgggctccatgaggcgtgggcaacatcaagatctggtgcttggggcccgagggaaccggccccaaaatcctcaccgacatcaccaaggggtgacaggtactttgacccagccaagggcaagtacaggcaagtcagccaccagccccgaagggaagaagctgcccagcaccttctgccagttgatcctggaccccatcttcagggtgtaggatgcgatcatgacttccacgaacgcggagacggcacacctgatcgagaaactggacttcaaatgtggacagcgaggacaaggacaa

SEQ ID NO: 575040 - DNA, 250 bp, Homo sapiens
ttttgtaatgtcggccggaagtagcgtatgatggcgcactgcaggcggcgcatatgcatctaggctatacatataccggagtatacgtagccggtaacgttaacaaccggacctctagaactatagctagcatgcgcaaatttaaagcgctgatatcgatcgcgcgcagatctgtcatgatgatcattgcaattggatccaaatatagggcccgggtaataataacctcaggtcgacgtcccatggccat

SEQ ID NO: 575041 - DNA, 1649 bp, Homo sapiens
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctggtggggggatccccaggagaccagcatgtgctgaacctctctgtgcctctgcctccgcaccctagacacccacctccagtttgaaggtggcgggccaggggctttcttgctgaattgacgactccgagagccctgactcccgccttgccactcacggctctgtccactagggctcagccctgctgagaaaggacctccgatgcttgggagacgctgctccggcaggtgcagccccggaagtttgtccatgggggtccccgcggctggggctcatggaactgcgagacccgggaccctcctgccctgcgggtccccgagccaccagcagccaggaccggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgca

SEQ ID NO: 575042 - DNA, 354 bp, Homo sapiens
agctcccacactgcacggagttagctcatgtgtcacaggttctgggggctgggcatcctgagatagagatctccaccacttcttgatgcagagaccccgcctaccagccccctgcacatgcatggccgtgcaggcatagacatacgtgccattacctggcgtgtgaaaggtggcccaggtgttgtgtccccttcctcagctgctgactgcttccccggtgcaggttcccacacctgcacgggaaccgaaactggttgggcaggcagatggcgtcacagtccgcctcgtctgagcggtcctgacagtctgcctcgcagtcgcagcgcaggggcaggtccaaacactgaccggacc

SEQ ID NO: 575043 - DNA, 867 bp, Homo sapiens
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccaggtatttccatgtttgattcttttgaatggttggaattcgcaggagaacaagtggattctagaagggaacagacagaatgctcccaggccttcctgtgccgtgggcgagcctgctgcctggctgtttggcttgggggcgttgcgttgctggccttggggttgggcttgggttaccaggggttcggtaactgggcaacctcataagagaggccatacccattcaaagagacacattcagaaatcaaactg

SEQ ID NO: 575044 - DNA, 520 bp, Homo sapiens
gtttacgggctacacattcaccgtgtgttcaatgaactcctaccctttggcatacactctattggacctgcccgctaacactcgttagcttccctaacttcctcgaagagaaaaggtcccgtcatcgagggctttcggaaacatggcctttgggagtgcgtccttcggagtcttcaaccaccgtgccacgtttcgccaggaggcacccggcttgctgactggaagacgctccccggagctcactttccggactggcactctcgcgcgttacctcggtgttcccaaggtcagtcacaaagtggcctgtgtgtaccggccttgccaggggccgcatcggccacccagtatcctcagccacggtaagtcaacatgttcctcgtgtctcccacagccgccagcaacaggctgctctaccccgggcaggaggtggtccaggccacgcatggtggtcctggccttggccatggtgcccatgcctgctgctatggcacacccctgcacctagcatgcaccgcacacc

SEQ ID NO: 575045 - DNA, 619 bp, Homo sapiens
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtgccctgcgggtccccgagccaccagcagccaggaccggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgca

SEQ ID NO: 575046 - DNA, 460 bp, Homo sapiens
  misc_feature (42)..(43): n is a, c, g, or t
  misc_feature (101)..(101): n is a, c, g, or t
  misc_feature (107)..(107): n is a, c, g, or t
  misc_feature (133)..(133): n is a, c, g, or t
  misc_feature (135)..(135): n is a, c, g, or t
  misc_feature (406)..(406): n is a, c, g, or t
  misc_feature (443)..(443): n is a, c, g, or t
cgcgagtgatccctgacagaacggcccccctctccgccctgnnggagccgggagatgtgcagccccagtcctcctgctcggcggactccgcgcgcgcaganctagcngacttcgccgctcattactaatactntncgcgggccagaccaatcccctttctaatgcaccattttcgactgagaacatcaagaggccagaaacttccaagtcagcttgcagacgcagacgcctcctggggtcctggctttaagaaccacgatgccaacattcccggacaagtttatggcatccggatccctcaagggtgctcatctgcaagttgagaagtgttagtagcaattatttatctgtccttggaagaggagttcctgaacataaaatgtcctctgctgggccctaaaactgnggggccggaagctgtgtgtttttggggttgggggttngggggccgaatgtttcc

SEQ ID NO: 575047 - DNA, 2007 bp, Homo sapiens
  misc_feature (1677)..(1677): n is a, c, g, or t
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctggtggggggatccccaggagaccagcatgtgctgaacctctctgtgcctctgcctccgcaccctagacacccacctccagtttgaaggtggcgggccaggggctttcttgctgaattgacgactccgagagccctgactcccgccttgccactcacggctctgtccactagggctcagccctgctgagaaaggacctccgatgcttgggagacgctgctccggcaggtgcagccccggaagtttgtccatgggggtccccgcggctggggctcatggaactgcgagacccgggaccctcctgccctgcgggtccccgagccaccagcagccaggaccggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgcaaaaaaaaaaaaaaaaaaaaaaaaaaaanaaaaaaaaaaaaaaaataaaaaaaaacaaaaaaaaaaaagcggggggccatggggggggcggaacaacgagagaaaagacgggcaaggtcacaaagaggtgttgcaccgcccactctttctacgaagggaggggagcgagggcaggccccacaagggaggggagaaaactccgacgcgggtcccgtattgtcgtcgactagccgagggccgacgcaggggggggcaaccacgctacaagacgctgcaacactcaccgacaaaacgccactgcacaccataactaaccacacacaggacgccacacctcaggacacgcagcgcgaacagca

SEQ ID NO: 575048 - DNA, 605 bp, Homo sapiens
tttggccgggggccaccccgtaggcgcccaagggtgcaccccggtggcgtgaaaataaatgtgcgcgaatcgtgccgccggtgtgaaattcgctgcggctccccctttgggagggatcgagagaagctatttggccctgtcttgcaaagtaccacggggagacgtaaacagcgctcttcaggacccgcttttttaaggagccccccatatccagcaaggtctcttgtttcgatcccgcccaaattggggctccccttgtgaggcgaccaaatagtgtggaaagtaaatggattttctgtggtaacaagcacgcctgcttttgttatctgactagatctctcgtcccgcaagtctgtggtctgtacagagacgaaatacaagtccccaacagtcgcagaagagttgtggttttgtggtatacacgctctgggaagatttttgtgtatctctctagagaatcatcggtggcgtttgtagacaaacccacaagaggtggtgttcctcgtaaagagaccgacgtttctagaggatgtgtgttctgtctggagacattcccaaaaaagatgtacaccggaattccgcaaagaacaattgatacaaaacaa

SEQ ID NO: 575049 - DNA, 1380 bp, Homo sapiens
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctgctcatggaactgcgagacccgggaccctcctgccctgcgggtccccgagccaccagcagccaggaccggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgca

SEQ ID NO: 575050 - DNA, 1326 bp, Homo sapiens
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctcagcagccaggaccggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgca

SEQ ID NO: 575051 - DNA, 129 bp, Homo sapiens
aggataagatccgtgctgtatagcagatgtagtttggtcgtaagtaagtgtctataccagcaagtctcacctctccttctctatgccatggtcttccattagggatgtatttagtctagggttctgtac

SEQ ID NO: 575052 - DNA, 196 bp, Homo sapiens
tgcttgatgtactgcatcacccccagccctgattgtgcctctcaccatcatgaataggaaactgatgaacaccaatgatctggaggagtcaggcagctcacggaggaagatccagcggcatctggatgccaggcaacctcattgagaaagtcatgtgcgtaaggatcggtctcgcttgcttggcagcggtccggat

SEQ ID NO: 575053 - DNA, 1365 bp, Homo sapiens
gctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctccgatgcttgggagacgctgctccggcaggtgcagccccggaagtttgtccatgggggtccccgcggctggggctcatggaactgcgagacccgggaccctcctgccctgcgggtccccgagccaccagcagccaggaccggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgca

SEQ ID NO: 575054 - DNA, 297 bp, Homo sapiens
cgccgcgccgtgtccttcacggttcacgccgttatcacctctagctctcattctcctattatataccacatgattgcattacaatctatctttatatgcggcttcaccccttcttcgtcctttatggaatactcatgctttgaactatcgagtgagccgacctcattctgggtacgatacctgttagactgtttctttgactattgccggatgcggaatgcccgtcctgtgtaccgtttgatgtgctgagaccatttgtgggggtccacctggacttggcctgcatgcatggtcaca

SEQ ID NO: 575055 - DNA, 535 bp, Homo sapiens
aaaatgataatgatctcatagaaatgaacaaacgaatgagcgcatgacagcgttcgtcagtaagctagaagaagccaagaagaagaagagaggatgccctaatgtgagaccaggaagtcagagacaaggctgaaggagctcccaggagtgtgcgattgagaccatgatggtcctctgggaagagtgtcagccctggctgaaacagacctgcatgaagttctactgcacgcgtgtgcggaagtggctcaggcctggttgggcgccagcttgaggagttcctgaaccagagctcgcccttctacttctggatgaatggtgagcgtatcgattccctgctggagaatgagcgggaggagacgcacatgctggatgtcatgcaggatcgaattcagccgcgcgtacagcatcatagacgagctcttccaggacaggttcttcacccgggagccccatgatacctaccactacctggccttcagactgccccaccggaggcctcacttcttctttcccaagtcccgcatcgtccgcagct

SEQ ID NO: 575056 - DNA, 300 bp, Homo sapiens
atgtgagtgcggggcagaaagaagaggatgaggccagtcctctgggggtgtcatctttgcgcagcagttgacaggcagtgggtgtgaaggtctatatggcaaggatctacacacgcgggaggagggaggtactctgcaaagtttgcagcgtgggtaggaaatgactgtggagcagtgaggaaagttgatcagtgatggtgtactaggttagagagtgatggtggtgtaggtggagagtgagtgtgtgatggtggagttggtagagtgagtgtggtgatggtgttgtgggtggagattgag

SEQ ID NO: 575057 - DNA, 122 bp, Homo sapiens
  misc_feature (33)..(33): n is a, c, g, or t
  misc_feature (62)..(62): n is a, c, g, or t
actgcaatcgtctcagcctagctctaaccgatnatatacagagttctgacttggaaaacccnctgggaccagaaatgttattgaaagatgtctaaactaagagtcaatagggggacgggcat

SEQ ID NO: 575058 - DNA, 1326 bp, Homo sapiens
  misc_feature (453)..(453): n is a, c, g, or t
tcaccgcttatttcactttttttttctggtttaaaacccctatgttgtgtacccacagtgtggaccctgagtctccgcgtgcagcggaaactcgtgggtggtgggttcttgacgagggtggctcaggtgaactccgtgaatagggagaactgtggtgaatacagtctccttccagaaggtctcgggggctcaggtatagcgtggtaggtctcttataaaagatgtggcactcaaagggtggcctttggcaaagtttgcccaggggtggcagtgtgccagccccgggcgtgagagttgttagcagctcattcgaattaccagccacattcagtgaaggcaggtttttataggcacaccgaggtgtcgcggaagaaacgaatccccgagtgtgccccgcggtggtgtgaccagggaaattggagggcgttaccacagcccaaacagagaccccgnaaggcgtgtccgttgttccaccttttgccaagtgggacgaccacgtttggtcggggcgctttttgccagatctcttttgttccccccacaggtatgcgccccttgtgcagccacgggggagaccaatgtgggaagacgcttgtggcccagagagttttgatttgggccccaagggtgatgtgtgcgggggtggacacccttccctgttgggagagccaccttttagaacacccacataaacacgatatgctgggccccatgtgtgattgtggctccccccgcgatattagcaaagcaaaatagtgccctttgaaacccgtgggttggcgcttgggcccgagacacggggggtatattgaattcagtgagcaggtggaaaataaccctttttaaaaaaccctatattccctttgaaagagaagggcgccccagagaaagaaaaaatcaagaggaaactctgaataccctaaaggggggacgggaacacacagaacgtagaaatttccctccgaagaggaaattggtacattacattcgtctcttgttaaccaaggcggcccacatcgtgtagacagggaatacccacactatatctacggaattgtcaccacggaaacacccggggaccatgcgcccgagcgcgtaaaagcgggaacccgcgcagaaataccggttgaacctctgtgagaacacacgggtgtccaacccggggccagggagtgtgctcccacgttacatgatacaccattgcacgcgcgttctgcagatagctgatcaaaattatgacgatatataaacgagatgcaatgtacgaactttagaactgtgagcatattaataatgaagtataaagacgtcacgagtatactcgat

SEQ ID NO: 575059 - DNA, 340 bp, Homo sapiens
agacagtttaaaaggatagagatggtagtatctgtcatataggtcagtcctctatcatattcggctccatcgcggaaacccaccctctctaatcaggagactcacgtctttcagtaatcctagtcatatgtagagtgtgtactggcccatgggctgtgtcaatcatacttaataaaatgataggcctgaatggagcattcaagtttctctagatgccaatccatctaattttacagattttcaacaacaccaaggcccagcagcaaggtaaccacctcatttcacagaaccacgccgcccagccatgtgcaaacaggctcaatatcctatcactgaccat

SEQ ID NO: 575060 - DNA, 837 bp, Homo sapiens
  misc_feature (29)..(29): n is a, c, g, or t
  misc_feature (71)..(71): n is a, c, g, or t
  misc_feature (129)..(131): n is a, c, g, or t
  misc_feature (133)..(133): n is a, c, g, or t
  misc_feature (139)..(139): n is a, c, g, or t
  misc_feature (157)..(157): n is a, c, g, or t
  misc_feature (162)..(162): n is a, c, g, or t
  misc_feature (179)..(180): n is a, c, g, or t
  misc_feature (197)..(197): n is a, c, g, or t
  misc_feature (206)..(206): n is a, c, g, or t
  misc_feature (220)..(220): n is a, c, g, or t
  misc_feature (222)..(222): n is a, c, g, or t
  misc_feature (233)..(233): n is a, c, g, or t
  misc_feature (242)..(242): n is a, c, g, or t
  misc_feature (256)..(256): n is a, c, g, or t
  misc_feature (259)..(263): n is a, c, g, or t
  misc_feature (286)..(286): n is a, c, g, or t
  misc_feature (292)..(293): n is a, c, g, or t
  misc_feature (297)..(297): n is a, c, g, or t
  misc_feature (301)..(301): n is a, c, g, or t
  misc_feature (307)..(307): n is a, c, g, or t
  misc_feature (321)..(321): n is a, c, g, or t
  misc_feature (324)..(324): n is a, c, g, or t
  misc_feature (332)..(333): n is a, c, g, or t
  misc_feature (335)..(335): n is a, c, g, or t
  misc_feature (338)..(338): n is a, c, g, or t
  misc_feature (345)..(345): n is a, c, g, or t
  misc_feature (351)..(351): n is a, c, g, or t
  misc_feature (358)..(358): n is a, c, g, or t
  misc_feature (361)..(361): n is a, c, g, or t
  misc_feature (364)..(364): n is a, c, g, or t
  misc_feature (372)..(372): n is a, c, g, or t
  misc_feature (379)..(379): n is a, c, g, or t
  misc_feature (390)..(390): n is a, c, g, or t
  misc_feature (394)..(394): n is a, c, g, or t
  misc_feature (438)..(438): n is a, c, g, or t
  misc_feature (465)..(465): n is a, c, g, or t
  misc_feature (476)..(476): n is a, c, g, or t
  misc_feature (481)..(481): n is a, c, g, or t
  misc_feature (505)..(505): n is a, c, g, or t
  misc_feature (683)..(683): n is a, c, g, or t
  misc_feature (827)..(827): n is a, c, g, or t
tcctagcttgtcaatattctgttttatcnttttcattaacaaagcagattacaatgtagccctattttgcnttataattagttgttacaagacactgcacattctcctgaagccacacaatgatttccnnngncccagnccactcttccaatcagtnactgncgagcccactggcaggnncagggctacttcctgtnttccaatgntgtgcctgacatancnctttgcaagangagcgtggnttatgtggacacanttnnnnnggaatttccattacacatttggnagaagnntgcntaanttaatnttactattagtgtnttngtgttgtnntnttntgaaggnatattnttttccnttnttntgcttagntcaaggnagattaaagtntttngtccaaaattttaaccagattatgagctatttcctaagctaaanttacaaagtaaattctgaggttaatantgatgttatanttctnttcacatggcctttactgtttgtnaactgtgttatttaaaatcctgagcttaacaaaaatctttataaatcaactcatcaaaacaggcatttggccaataagaatttaatttcacatcaataaaactttagactttagatttatttagggctgtttgcatatgtttatagaatagtttactctaaaagatgacaagacagcnccccctcagtgagaccctggcctaaatatatttgctttatttatatagcaagaggataacattaaacatgggagctttcaatttgtggcactgaataatctacacagggcatccttcaaaggctacaattaaaggatccacctnacttttcagc

SEQ ID NO: 575061 - DNA, 1341 bp, Homo sapiens
ggacatagctcagctcgcaagcaagctaaaactgttatcatgacatgaccaatgaatcctgacagccagtgtgcctccccgcactgcaactgacagggaaggctttctcgctgagtccatgcccccatgactcagagtggcccacctacatcatggaccccagtgacctatgcctgcacttgcttgtgagcatgatctgggtgtcttgaatgtacctgcactggtgttgtgcaggatgcaagtgactgtggaccatcgcgtcagtctcttcttgaccactcaactgagacgcgaccatgacacgggaaatatggcactcactgcctgcatatagaggcgccaatgacggaacgcatgacctgtcctgccatatgagcctgctgagcaacagcaggtggcaccatgcaccaaccactggggatagcccatgtgatgcctggccttactgacactgataccggtcatggatgggctggcagactgccaacgagtctccgcctattctcagccttgctacaattgcggcctgtctgaggatggtcacgcaggcaccaacataacggtggtggccaccgtgcaagatgtccatgggaagccaagtgaccgcatggctgccagcccgacgcgcaggagaagaagcctatgcacctgcactgcacgcccaacggcaccccgacggaccactggtgcagggaacatcatacccaaggctccacgggcactgcgcggacaaccaacatagtatagtgtggaccccattgggtaggccagatgagggtaatctccaatggccaccttctgaatcacaatgtggcgactccaacgtcaatggcataggatcagtcccctttgctcccaacatcagctccttatggatgcccgtgagatacacattacattcagaacgggtaaggacggcagctatagcagaaccacaaaaggtgatcatcaccatgatggaatggcaacagcaccgaaatgtcagttgagaggtcccattaaggcatacgggtcccccccgcgcaaggagtatgaaacagacacacaaaggggagactcagcggggaaaacggtggagtccacgcatgtcactaaggggcccacaaagaaagacaccgatcacaccgacaagacgaaaccacgagggagaacacgcacccgtgtagacatgaaaccagcggtgagactcacagtaccaacgaactttgacaggaacacatacaacacttggataggcactacaagcaggcgacgccaccaagaacagtcaaggtgcacatactacggcagtggtcacgagtcaggtcgacttcgttaaagcacgagacacatagctcgaag

SEQ ID NO: 575062 - DNA, 242 bp, Homo sapiens
tgccaaagcgtatgtacccaaacctgtgtccttccgatctgtcctggctgcctccctaacctcttttcacactcctctccatccagacttttcttctttctctctctttttttttgggtctcactctgtcactcaggctggagtgcagcggtgtgatcatggctcactgcagcctccaacccctgggctcaagcaatcctcctgcctcaccctcctgagtacttgggtactacgctttggca

SEQ ID NO: 575063 - DNA, 165 bp, Homo sapiens
cccctgcttgtgattgaaggcgctcagtcagcagaatgtgagcattgacttggccacgttcatgaagctgcggacggatgcggtgctgccgttgactgtggctgactgtgcagaaacttcttgggaccccacgttgtagggccttgaaggcggagtgagcggcac

SEQ ID NO: 575064 - DNA, 379 bp, Homo sapiens
acatctacctgaatttcaattataaggctacagtaaccaaaagagcatggtactggtacaaaacgcagacacattgacggatggaattgaatagtagaacctcatgaaataaatccacacacctacagctgtcaaatcttcaacaaagtttacaaatatcagcattgggactataactccctactctatacatggtgctgtgatggttgactagccatatatagaagagatgatacttgatccgtactagcagcatatgcaaaacttaattcaacatggattatagatttgattcttagacctctaactgtcagagtcctataagaaaacctaggatacacaattctggacttcagcctgtggacataatttatgacta

SEQ ID NO: 575065 - DNA, 188 bp, Homo sapiens
gacgaggatgacttagatccatactgactgttaattccaagcttacattcattcccatatgctctggttaatatgattatggtttactaagaggggttttgtttgtttgttttagcatgttctatatttctataatgagcatgaattttataaaaattactataatagttacatatctaattaagtat

SEQ ID NO: 575066 - DNA, 257 bp, Homo sapiens
tggggtggaccaaggggaatttaatggggagggtcacaagtgacacaagagggtggggttctcccttaaggcccctctccctcttctttagagaggggtctctaacgtgtggcaaagtgtgtgtgagaggagaggggaaaatattcagaggtggtgggtgggggacacgtgagagtgtgtgtgcgagagggagactctctctcccacagagcagagtgagagagaggctctctctctctctctctctctctctctgt

SEQ ID NO: 575067 - DNA, 345 bp, Homo sapiens
acgtgctgacataaggctagagcctcttgcaagtctctattaaagtaaaaggggtggggtgcggtgagtcatgtttgtaattccagccctttgggaggctgaggcaggcagatcccttgagtccaggagttcaagaccagcctgggtaaaacagttaaaccccatttcaactaaaaataaaaaaaatttagccaagcaaggtggggcatgcctgtagtcccagctaccagctcatcaggaggctgaggtggtaggataacttgagcccaaaaggtccaggctgcaataagccaagatcatgcccctgtggtccagcctgggcaataaagttagaccctctttcca

SEQ ID NO: 575068 - DNA, 391 bp, Homo sapiens
ggtcaggccggtcttgaaatactgacctcgtgatccacccatctctgtctcccaaagtgttgggattataggcgtgagccaccgcatccggcctaacaaacctctttaatatctgaatgatagaacaaagctggtttcttatatctgcctctgtgtggaacctgttgtgataggttgttctgattgaagtatttgaagaaatattttattggcttttttagagaattgtggatatttttctttgatgctgtaccaaaccatgacaagttagtttctcaagggttaggtgtagtgtagaagctaaaaccaatcagtggcttttccctacactgttacgtgaaagtccattggtctgtcttgtcctctgaatggatatcttggccatgcgtgg

SEQ ID NO: 575069 - DNA, 713 bp, Homo sapiens
gggggctgggagttctcctgagggaagaggagtggagtaggggggacgcgagcggcggcgttgacaatagagaatattcttggaaggcttttttggtccaatttgtgagatcgatattgctcttaatgatggggaaaccaggaaaatggcagaaatgaacaactggaagatggcaaagtagaaaacaacactatcatcttctatgacggagtcaactccgtttcagcgaaaggtacaacctagacctattaagtcaaccctggcaaacgtaggctagaaaacaccaagcgaactccacgacactcgcaatttcgctaggtcaaacattggaacttatttcaatatacaaagagtacatactccatgaattctgtcacacctagctgaacagaactaggccttacctggagaactgactcagagcagcacgttatgacttccgcattttattgcaaagtttgcaacaaggccatatgaatcttaccatcggtgccaatgtccgctttgagcgtatattactttaaaggtgacaatacgtgcagacagacttgaacagactatggtaagaagaaggtatgagtcctttcaatggtacacacaggctatgcccaacatactccctaattgtgaaacaacgtctaattaagactggacagatgcgcaattagaacgatctgtctacaaataatagaactatgacttatataataaaa

SEQ ID NO: 575070 - DNA, 431 bp, Homo sapiens
  misc_feature (8)..(8): n is a, c, g, or t
  misc_feature (13)..(13): n is a, c, g, or t
  misc_feature (141)..(141): n is a, c, g, or t
  misc_feature (173)..(173): n is a, c, g, or t
  misc_feature (233)..(233): n is a, c, g, or t
  misc_feature (387)..(387): n is a, c, g, or t
  misc_feature (407)..(407): n is a, c, g, or t
  misc_feature (431)..(431): n is a, c, g, or t
aagcctancctcnacaccaattaacgaagctcctgtatcatggagagttcgaattgctctggcgttaaaaggcattgactatgagatagtgcccatcaacctcataaaggataggcgagcaacagttcactgaggaatttnagaccctgaaccccatgaagcaagtgccagcnctgaaaattgatggaatcaccattgtccagtcactggccatcatggagtacctggaaganactcggcctatcccacggctcctgcctcaggacccacagaaaagagccatcgtgcgcatgatttcttgacctcatcgctagtgggcatccagccccttcagaacctgtctgtcctgaagcaagtggggacaggaggaaccagatgcaatggggnccaaaaggtttattacttcnggctttaaccgctctgggagaagn

SEQ ID NO: 575071 - DNA, 738 bp, Homo sapiens
  misc_feature (71)..(71): n is a, c, g, or t
  misc_feature (208)..(208): n is a, c, g, or t
  misc_feature (214)..(214): n is a, c, g, or t
aggcaaggaggcatctgcaaacaaagtatgctcaatctataataacagcagcttttatttccaggaaaagncttgtatgaaataagcctttattgattggtttatagataaaattttttaaatattaagtatattataaaaatgcagtcattgttgtattttgcctgtattatcctttcactcacattcactcatttttggcctcacnttatanaaagtaagattggtactctgattttttttatttatgcttttttaagtctgtttaatgtctaaggaacgtaactagttagaacagctacttatttggcagtctcaagctatggaatgcatactgatgtgtcatgggttcagcaaaataataataaataaatgtgtatataaaaggatagttgagtctcagcaaataactaatcctgtgctctaaacgcgtaagcactttaagtagaaagtagcctctaagtccccactccatatctttttactctttacacacatacacgaagacctctgtgtttgagtacactctgcctcaaatctttgcctcgcccccttcgttagtgaaaacatctcttgtacatggtggtagatgtagatagtacaaaagaatgttgagtgataaattcatgtgagacaattttaataaacatgtttccctgcctactccagatttgagtaacaagttaaaaggtggacaagcacaataataatagcaaatagggtcaactgaaccagcaa

SEQ ID NO: 575072 - DNA, 897 bp, Homo sapiens
gggatgcaggagctgccggctctcaggcttgcactgtccatctcctttagaaatttattttttattgtatttattgtatttttgagacagagtctcgctctgtcgcccaggctggaatgcagtggcgtgatctcagctcgtagcggcctttggtttcaggttcgagtaatgtctcctgcctcagcctccttgagtagctgggattacaggcgtgcaccaaagagagaccggctaatgtattagtattgtcagtagagacagggttttcaccatgtggccagctggtctagaactcctgacctcaaggtgagtcctcccacgctcagtctcccagaagtgctgggattacgggcatgagccactgtgctttggccttagaaatttatcttttctcactgaactgaatcatttgcaacaccaaaagccagttccctggatgaggaccgaatcaccaatatggaagttatttcctaggcttccccaaattgacaaaggaagatcaagtgagcgtcgcagtacatcagctactgttgctcacaggctttttattccttaacataatgaggacaacatcattaccaagctcccatgtgtgagataccagacgttaatccatagacgacatgaggtccctcaccagggactggtgcgaggaccgcaaggtccacctctgtcagcaataattatacccatcagtgggcgatgggtgtgtcggtggcttatggatcaattgtctgtgcgtttttctgataatctacagctgtggttggggggcaaatgttgcttccgcatgggacggtttaacgtttcccatctaacggtttggtgcacatcgtgaccagggggcctcggaaaagaacggccggtatccatataaaggagagtacgtatagggcc

SEQ ID NO: 575073 - DNA, 1885 bp, Homo sapiens
  misc_feature (154)..(154): n is a, c, g, or t
attacattattatttttattttaaaaaccctcctcaataaatgtgagacttacaaaaatcagtccaaccccacaatctttaccaaacatgtcagaatctaggcgtggggctttccaaagcccacaaggtgcatagtatgggcgatgctacaagntgcaacataatctaagatagggcgggatacacacgccacacatacagctgcaggacaagattgagcccaacaaagtagcacgcgtcagagactcccggggaaaacccgtgtggagtcctcacaccaaaaacagtggtgtgcgacccggacaaatgaccgggcgagcaacagtgggtgacacagggaaacactcgaagagaacacccgtgagagaggctgtgctaaagacagaggctacacaacataaacaacaacccccacacatacaacacaatgtgcttacacttgcacgcccacgtgacgttctgctgcacatcatatcaattcggtgagtaattgcgcggtgtggatttatttcatatcatatacacacacctcatcgatgagtgtagacgcccctccacggcggtagcaacatgtagagacacaacacatccgcgtgaacagcgacgacgaccgaataccacacaacacgcgcgaaacctgcgtgcagtaaacactgagaggcacaagagtagtgaggacgacacctatcacaacaagagcggagcaccatcaacactacacagccgcggcggcgcgacggaaacaagcaccgccgcgtgacgatgaggcgaggatgccaccccaccagaagggccgcccatcccacaacaaaaatgctggaagcggcggcgcgtacacaagacggcggacccacacagagcactatccggcgaacagacgacggtgctaccacacacaacgacgcggatgccttaccacaaaacaaaaaaaacagtcaccgcagtagaggagagccacaacaacacaacaaaaaacaacaaacacaacccactatcgtaagacaagggagactacacaaacaacacaaacacacaaaggagaacattatacaaacaaccccccggacgcactccgcgcaacaaggggcgccaccatcatatagtaggcgaacccacaccgcaggtagacgcatactcatactagagcgctagcacaccacaaaagcgaaccaacacaacagacgacacaaactacacaccagcgaggtaataaacacaaatccgacagcgccacaaaaacaaccacggagaaaacaccaaggggacccaacaacacaatgtaacacacgcacacaacaacagcgcacccaacacaccacacttaacgagcgaaccgccacaacaactcagccaacgacgtgacaaccgaatgaacacaacaccacacacgagtggcacacacagaccagacaaacaaaacccaaaaaaacaaaaaagagattaacataactaagagccgccacccgctaaacaaacgaccaggaatacataataatgagcaccgacgagccagaatcaacacaatctacctcaaaacacgcgacatcgattaactgccagacgcaacacaaacaaacgatggcgtcgaaaccacacgcgacacatgacagcagccaaccacacacacccgtccgcaaaccacgaaagcagcagcggcaaaaaagcgcgccaacgcgacacaccaaagcgagaccaccacgcaatcccccacccagtgggaacgacacaccaccacacacagaacgccccgacaacgcacacacagacaaacatgagcctacacacccagcaccaccacacggcgccaacacaacacgcaacacacacacacaacacaccaaatgaagcaccaacagaccacacaacaagaacgaagcacagcaag

SEQ ID NO: 575074 - DNA, 251 bp, Homo sapiens
cgacgatcaacacttggcagtcagtgacaaagatacaggcaggcacaacagacagtgattcaccaggggtggtggctcaccactgtgatcccagctcctagggaggctgaggcagaagaattgactgaacctgggaggtggaggttgcagtaagccaagattgcgccactgcactccagcctcggggacagagggagactccgactcaaaaaaaaagagagtggacacccaacccatgtgatatcccagcc

SEQ ID NO: 575075 - DNA, 200 bp, Homo sapiens
ctggtcccgcgcaacggaggtatcacttagcatataaagcttattcacctgttcctcctctgggccgctgtgcccctcacgcaggccctcagctctccctcgtgggcctcctcctctgttgcattcgtggtgccgtcttcagattccttctcctcctcattgctgcaagtagctccatcgatctgccgagtccgctgcat

SEQ ID NO: 575076 - DNA, 171 bp, Homo sapiens
caaaattgacaaactgcaatatgttcaaacggagaagaaatcaaatccaactcaacattcatataggaaatggcactaggtataaattttggctggagaagtgggtggaattttgataagcagaaacatctttcgtagaggatatatcttatacgttctataaaatgacca

SEQ ID NO: 575077 - DNA, 247 bp, Homo sapiens
acaagagccttgaatcacccggacataaagatgtactcgattagaagagtccgttgtctgactggtaaatttaaggatgtgtgtgaccctcgtgcattataacagacaattggcgcggtgcggtggctcacgcctgtaatcccagcactttgggaggctgaggcaggcagatcacaaagtcaggagatccagaccatcctggctaacacggtgaaaccccatctctactaaaaaaaaaaaagtcgac

SEQ ID NO: 575078 - DNA, 220 bp, Homo sapiens
taaacatacgtaacaacccactactaggcttgctacagtagagctaagctacggataaattagaatggtcagtctactaccactacccaaaatagcagagatccaatatgtgcctatccataatgaagagttcttaattgtatagctccgtaccttccactatgcacaaatatcaaaggtcattccggaaagccgtccatgcatcagtatcacatttgga

SEQ ID NO: 575079 - DNA, 675 bp, Homo sapiens
tctcacttccacctccatgaacgctcctcatagctaggcctactcaacctacacctaaccatataccaatgagtggcgcgatgtaacacgagaaagcacataccatggccaccacacacccacctgtccagaagaggccttcgatacgggataaatcctatttgagtacctcagatcgttttgtgttcttcgcaggatttgttcctgagcctatttaccactccagcctagcccctaccccccaattaggagggcactggcccccaaccaggcagtcatccccgctaaatcccctagaagtcccactcctaaacacatccgtattactcgcatcaggagtatcaatcagcctgaggctcaccatagtctatatagaaaagacaagccgccagaatcctaaatatattcaagcacgtgctttattacaatatttagctgggtaccgtctattgttaccctcactacaagcctacagagtagcttcgagtctcccttcaccatttccgacggcatctacggctcaacattttttgtagccacaggcttcgcacggacttcacgtcacttaatggctcaactttcctcactatctgcttcatccgccaacgtaatatttcagccgtttacatccaaacatcactttggcttcgaaacaattgcctctactgcacttat

SEQ ID NO: 575080 - DNA, 426 bp, Homo sapiens
  misc_feature (214)..(214): n is a, c, g, or t
  misc_feature (312)..(312): n is a, c, g, or t
ggaaaagaaaggaggaggagctggtgagcgagcgcacagaagccttcactattgcccgcaacctcctgacagcggctgcagatgccattgagcggatcatgtcgtcgtacaaggaggtgacggatgctgtgctgtgctacactatgcccgggtgcacgagattgttccaggtatttgaacgatgttcagctgctgtcacttcaagatgtgcccnagggatgctacgaagcggaccgcttcaaaggcgagggggttctttgggggaacccagtaggccggtctggtgtccgtgtggagggcccctctgagagnaatccgatgtgccaaggggttgggttgggactgtggaacaggggatcatctgcgagaacatccccatcgtcacgccctcaggagaggtggtggtggccagcctcaacatcaggg

SEQ ID NO: 575081 - DNA, 997 bp, Homo sapiens
  misc_feature (843)..(843): n is a, c, g, or t
tgtcgcaggagagagaaaaacattcaggttcactcacagtgttttagaacacttggaagagggtcggctttatcctcctttgaataccattagagatgtgggtctgaaaattgcacaaaacattgtgaaggatgcataccaagaaaagacagacacggataatggctgaaccggacaacaaagaagcgtttgtcctattcccacatgtagttgactgagtatgagcagaggctccctgagtggcatacaccgcctagtcaggggggggaaaatacatactgaacgttgacacggaggagtgttgcctgcatggatggagggcttattgagatttatttcatctcgcgtagggtggtgagggcgggcagcatgagattatggattacgcgaagctgatcattacagacattactgggacaggctctatactgactctgtatattattattcgtcattacgcgcgtagacaatttatttattctctgctttcgcgcggggcgacattatcgtacggaaccgcgatttccgccgtcgtgttgaagcttctcctcgggctcctcgttgtgagcacccgcaccgtatggctaaggtaggttgtgtattccatacgcactaggccttttttctgtcatctgtatcgatgtcctgtctgactcatcggcgtgggatgttcgtattgagtataattatacttgacgtatcatccagcctcggtctcaccactgaccgtctcttagtctattagtcgtacggacgcgacccactcggtgtgtgtctccccgttcggtcacgagcggaaacgagatagcgagtgtccgagcgtactcccccttctcctcgacntcttgcacaccgaaatttgggagtggcgggtgtcggcgttgcgcagggtcatgggtgtatatcgcgatcctctcacgcataagcgatgatgtggatccacatggtttggggtaggcgtccaactcccgacgcgtcgcggggtttgtggcggcgg

SEQ ID NO: 575082 - DNA, 132 bp, Homo sapiens
aaaatctgcgcggcacatttaaagttgaacataagattctatcttggacaaccagactatcaccaggctcggtcaggtttgtcgcctctacctataaatcttcccactatttagctacatagacgggatgtg

SEQ ID NO: 575083 - DNA, 219 bp, Homo sapiens
  misc_feature (2)..(2): n is a, c, g, or t
  misc_feature (30)..(30): n is a, c, g, or t
  misc_feature (34)..(34): n is a, c, g, or t
  misc_feature (40)..(41): n is a, c, g, or t
  misc_feature (61)..(61): n is a, c, g, or t
  misc_feature (90)..(90): n is a, c, g, or t
  misc_feature (155)..(155): n is a, c, g, or t
  misc_feature (184)..(184): n is a, c, g, or t
  misc_feature (186)..(186): n is a, c, g, or t
  misc_feature (210)..(210): n is a, c, g, or t
gngtgagccaccgtgctcagccactagctnttgngttttnncaaacatagattatattccncaagatgaagggcttaacatatccacagncttcctcagctttgcctaactccccatgcgctctgtctgctgcaaggcacagttattctaggttntatgctgctaggatgcagctgcttccctngntgcctggtgcatttgtcccctctnatgatgctg

SEQ ID NO: 575084 - DNA, 339 bp, Homo sapiens
  misc_feature (111)..(111): n is a, c, g, or t
  misc_feature (151)..(151): n is a, c, g, or t
  misc_feature (252)..(252): n is a, c, g, or t
gcccatcaaccccgcatttcggttcaaggttgatgggtttttttgttatctaaaacttatctactaccctgcaaccctctcaaccatcctcaaaatctcctcgcgcgatangccttacggtcggtgacaaaatgcagcgtcatcccctcanataaacgcatcaagcgcgcgggcggttccgggttcaaaccattgttcgagcgttgctgactgcgctgcatccagttttgcattaccgtttttaatagcggntttcggctagccagcgcgtagagctggtacaatcagctccatgttatccggcggttgcaaccctgtgaccctgtaggacaattacgg

SEQ ID NO: 575085 - DNA, 214 bp, Homo sapiens
gtggtgagaagacagaccctgtcgttgtcgtgtgggtgtgtactggctcaacaccagtcatcagtgaatcaagcaattcctggagtagctcagttagttccagatcaaataataatgggcacctggccaacatggtgaaaccctgtctctactaaaaatgcaagaattagctgggcatggtggcgcatgcctgtagttccagtaaggggtaagg

SEQ ID NO: 575086 - DNA, 555 bp, Homo sapiens
taaaggcgtcccaatggggcgaacatgagtcgtccgcggtctttattttttgaccaaacccgtagggcccagtcggtcctttttgaggacaccccccacgggggccccaaagttggaaccctgttcatgtgcaggagattccatggcatttcccatgtatcgatcctgtctcttttataaaggcggagactttgtgttacgccagcgggcccgagtctcccgtagtgcggataaagcgccaccccgaaggagggtggatgcagaatacggcggtagagcatgattcagacattctggccccccgttgtagagtactactctgttaaatagtttgtagacacacgtcgagtactggcccccaccaagaatcatcttcaagttttttagggcagcattttgcatcgtttgcgggaccaacgtggagtctttagtgcggtgtgtaccccgtggcttgttagaaaatagttgcttgtgctcttatggaggaaacaggaccactcaggagaaagaacaacgacttttttcctgcgcgggcggatacaatagaccgagaaa

SEQ ID NO: 575087 - DNA, 259 bp, Homo sapiens
cggggattgggggagtcttgggggttgtagcagggtgcatcaaacagcactcgcatggaataaacatatcttgcacaggaacatatggcaggtaattgaatagttggatttgaattatgtaaagacatgatcctgatggtcagcacaggcatggtcacagcagtcacccacacatgaggctaaacagatgcaaggtgaatgaactcagctatagctcagagagaccagctgcaggcaggcagttcacagcagcattgca

SEQ ID NO: 575088 - DNA, 407 bp, Homo sapiens
aaccctgtctgtgcggaggcggaccctgagagggggatggccaatccatgcctcccccagtgttttggttttggttttttttttcagaaagagtctcgctctcctcacccaggctggagtacagtggcgcaaccttggctcactgcaacctccacctcctgggttcaagcgattctcctgcctcagcctctccggtagctgggattacaggcgcaccccaccacgcacggctaattattgtattttcaatacaggtggggtttcaccatgttcgtcaggctggtcttgaactcttgacctcaggtgatccacccgtctcggccacccaaagtgctgggattacaggcttgagccgcactcgacccagtgtacacacttggaacataaacggattctctcgcgaggta

SEQ ID NO: 575089 - DNA, 225 bp, Homo sapiens
tgtcacccactccaccttaactaaccagacaaccttcagcctaaaccatttcaccctcatcacaagtataaggcgcataagaaacattgaacaccccgccgcaatagatatagtaccccacggccacagatgagacaaattatacaccaagaataatatagtcacggaactaacccctataccttctgactaatgacttaactagaaataactttgcgaggagag

SEQ ID NO: 575090 - DNA, 1604 bp, Homo sapiens
  misc_feature (1604)..(1604): n is a, c, g, or t
gcgtcccaaattgcctgctgtttctctcgactaggctctattcctgtttcgtctggttctgccacctcaggggtgaacgactggccagtggatgtcctatcagctcacgtgtcgcgccgtcgccgtcggagcgctggctattcgtgccgtagcaagatacttgaaggactgcttgccctgactctccttcgtacactcctgtcacgcattacacaggctggacacgcacgctcctgcgcactgactgcgtactacgtgtgcaacgccttaccatgtcacacatcctagctccgcgacgccctctctaggcggaacaggaacacacctagtccttgggctgacttgacgcgcgggacactactttacaccaaagacaacgtcacttgctgcgacacttgcccaagtgtacccaaggcagcacaacggctaccgccgctacgcgtaccttgagctctaacgcagctttacactgcacagcgcttactttgcgcacgccacgaaaccaaacggccacattaaaacctcgcaaacggctagggtccgccgcaacgcacaacagacccccttataccaatctactactgattccagtcaacttagccgcgcaaaactagcttcccagccattgttcccttggggccacggcatatcttgacggcccacatgcgctcagcacctcgggcgaacacaacaaccttggtggccttgcttagccatctcagtagccagccaacacgcacgcaagacccccatttaggacgacaacaaaccgctgactcagacttcgaccccaacgtttggccttggacgcgcaacacacgctaaccagcggcacaccacgccaaccagcgcggccaacgccaacgccccaccaccgaccaccgccaaacgcaaaccaaccgacaacatctggcaatccacctccccttccccgttggcggccatttgcacccccacatacgaaccactgtcaacaacccttcggcaacgtctaacacaaccaaaccataaccgccgatacttggcaaaccacatacctcttggcactcatcggcggcaccctacctactgccaacaacgctaacccggcggcacgatttgccaaccttccacaaccagaccgcgccaacaatcactaaactctggtgcaacccttacacgaaacggcacaaaccccaccccggcccatccaacttggcgcacaacacaaaaccctttgggtcgtcgcaccaaccacgcacagcctcggcaccaaccttcggctccccacaaaggcacattacccgcagccattacgtgcgcaaatccactcataaacgcacaaacacacagcctttacccgctttcccgattctcccccacataccgcaaacacacacatcacttctgcgccacagcccggcacacggcgcgaccacagccgtgacaaccgtcatagacattccactggtggcagccgacaacacacaccacgccccatatcatacgcgcaaaaatgagaccacacatttaattgaggcaccccaccgcattggtgcgactacgtcaaatactcctctgatcatttgagtacgaacaatatgggacagacacactgcactcgn

SEQ ID NO: 575091 - DNA, 176 bp, Homo sapiens
ggactagatgatcctataaacattgtaaattgacagctgaggaacactacttgggccatcaactgcttgtataagattcatccgaaaaatttgaaaattatacatgcagcgcttatcatggctacccatgacacatcaaatcgtataggaaataagcaatatggatggctacgccg

SEQ ID NO: 575092 - DNA, 240 bp, Homo sapiens
acacaaccaatgcattcctggaggatatatccctcactgtctttggacaattattctgccaatgttatggtagatggaaacccggtgaatctgggcttatggatacagctggacaagaaggttattacagattcgccccctatcctatccgcaaacagatgtgttcttaatttgctttcccttgtagtcctgccatatttgaaatgccgtcaaagtgttctgggggcggaccctgtcaca

SEQ ID NO: 575093 - DNA, 428 bp, Homo sapiens
ccgccatctcagcaaatttcaagcccagaccgtgttcgattctgcgcacttcgcggtccatggtgaaggcctcaatgtctaaatgagcatggtaaagaatggtgcctgcaggggtctcgtagatacctcgggacttcattccaatgaaccggttctcctcgatgtcaatacggctctcaccatgcttgcccgcgacttcgttcaggtacatgaagagctccaagcaggtctggtgcgtggtgccatccttgacgttggtcaccttcacagggaccccgtcatttgaactcatatctcgagaatgtcagggcgtgttgagggctttgactgggtcttgggtcttcgtgtagagacctgtaggcacttggttcatggggttctacaagattccagcctcgtagctgatgtgcatgaggttctcctggtcc

SEQ ID NO: 575094 - DNA, 488 bp, Homo sapiens
  misc_feature (280)..(280): n is a, c, g, or t
aggagtcagaacactggtaatgctgaattcctgggaatagatcagactacgatttaagtatttggcaccagataagtgacgttatccaaacagaatgttgaaaagtactgaaatataagagaataagggagaagtaagtttcagcgaatgtgactgtgaaatatattaaaaacaaaatcaggctgggcaaggtggctaatgcctgtaattgcagcactttgagaggctgaggtgggtggattgcttgtgcccgggagttccagactcgcctgggcaacanagtgagaccctgtctctgcaaaaaaaaaaagtttaaaaatttgccagatgtggtggcacatgcctgtagtcctagccactttggaggttgatgcgtgaggagggtttgtgcccagaagtcccaggctgcagtgagctttttgtgtgccagtgcactccagcctgagtgacagactgagaccctgtctctaaaaaaaacagaacacgtc

SEQ ID NO: 575095 - DNA, 919 bp, Homo sapiens
gggtgtccgctgccttgcgctgcgggcggcgggccatggtggtttggattgagcctgggccggccggggcgccgagtcgcgaggtgcgtggcagtgagcggcgtgcagaggctacggggctcggtttggctgactggggagtcgggcgaggcgtgcaggaaaccatgtcgaggactcgatggcgtgtagcctgcgtgcttgttgcccggcccggctctgcctctcgcctccttctgcttgctgggttacatggcgccgctgtccacctctactccggggtctagtacagctgctggcgctacgtgcaaggtctgcctgtgctccctggctctgcaagtcctttggggtgcattgacaccgcgtgttggattgctgcctttggagcctgtctactggctggtagacaacgtgatccgtggtttggagtggttgtacgtggtcctggtgatctgtgctgacgggctccattgtagctatcgcctacctgtgtgtcctgcctctcatcctccgaactactcagtgccacgatctgctggcatttcttctataagccactggaatctgatccttgattgtcttccactactaccaggcatcaccactccgctggtacccacccccagtggcaggaatgatatcggccaccgtcttccatctgtaagaggtgcatttaccccaagccagcctgaacacgacaactgatgcatctggaacagctatggaagttgggaaccttttccgggaggcttatgctggcattgggaaactgaaacagtccgacaggaccaactacggggttccaccaaattttaccataaccaccaccactttcctttcgggaaggtgccccagaagtttgttacctgggcctggcctctgggtttcctggtccacagattggggtccacaccgcgggaac

SEQ ID NO: 575096 - DNA, 133 bp, Homo sapiens
  misc_feature (25)..(25): n is a, c, g, or t
ccaggagcagaaccattaagctggnccaggcaagttgactccaccatttcaactccagcttctgctaatcctgtgtccaatgcttgagttagcttctctttagacttcagtagctattctcatccttccttgg

SEQ ID NO: 575097 - DNA, 207 bp, Homo sapiens
gatgcaaaattggattaagtcttcgccttaatacttgtttatatcgtgtatatgaatgatgagccttcgctgccaccgcgttccccctttaagtcccccaacttgagatgtatgaaggcttttggtctccctgggagtgggtggaggcagccagggcttacctgtacactgacttgagaccagttgagagggccagtgtggagagag

SEQ ID NO: 575098 - DNA, 156 bp, Homo sapiens
  misc_feature (41)..(41): n is a, c, g, or t
  misc_feature (101)..(101): n is a, c, g, or t
  misc_feature (129)..(129): n is a, c, g, or t
  misc_feature (141)..(141): n is a, c, g, or t
aggacagggtctcctcacccaggctggagcgcggtggtgcnatcacagctcactgcagcctcaaactcctgggctcaagcaatcccctacacccccaaganttcctagtagctgggacaacaggcacgnacccctactctnggcttttaattaatt

SEQ ID NO: 575099 - DNA, 333 bp, Homo sapiens
gtaataaattaataggtttcaaataatgtacaaactcacgtgtaatttctctaataaaccgtattaactgtttctattttaaagacatggaataaactgatagtccacatatacaccatataaatacagacacgacacatatctgttgtgtatatgaggatttgaatttatatacaacgatattgttcgatttctaatgatacaattctaattaagtaattttttagataatataattttaacgtagacgtaagtttcgtctttacatttttttgtttagtcacatgatttatgtgtgccttaaatgtttcattaacttttactttattttta

SEQ ID NO: 575100 - DNA, 166 bp, Homo sapiens
atgtgccttgccaaacatattctgtatagaacttcattttcctaacaagcatcgctgaattactgagctgttgtatcacttcatgtcaaagttttcattcttatgtaccaaagtactagttggaatttgtaatgagtctgatggtatattccaatttgtggcttgg

SEQ ID NO: 575101 - DNA, 337 bp, Homo sapiens
ttgccagcaagggaacagaactggacggagaatgagtttgatgaattgacagaagtaggcttcagaaggtggataataaactcctccaagctaagggagcatgttctaacccaatgcaaggaagctaaaaatcttaaaaaaaagattatagaaattgctaactagaataaccagtttagagaagaacataaatgacctgatggagctaaaaaacacagcatgtagaacttcgtgaagcatacacaagtatcaatagctgaatcaatctagcagaaaaaaggatatcagaggtagaagattgacttaatgaaatgaagtgtcaagattagattagaga

SEQ ID NO: 575102 - DNA, 588 bp, Homo sapiens
gaggaagcgtcctggagtgggtgcgggcccggactccgacccccgtgggcgcttcgagccccccagcatggtcaccgaggcaccgctgattcacccaggcccagatagccgaccccatcgacgcaccacacaggacccagacctcacacagcagctgccaagagcgagaacacacaggagactccacctacgggacacagacgtgagaggcaagggagatacagatgagttcatcatcggagatcatcgagagaacgcagagatgcagacaacaccatgtagtgcaccgagaccaaacaggaccaatgcaatgacggaaagaacaatgagagacggagtttgacaaagaagacaatatcgggaagagagacgccgccagtcaccgacaaacagagatgacaggggcaggagaaagaaacaccagtgtagttacaccaaggagagatggaaactatcacattggcagataagacgtggaacgatattgcacgtcccataagcagaacccagaggttatatggacaactacttcgcagttggaaaacaggcggaaatggcaccatatccgatacctatgacgaaattaat

SEQ ID NO: 575103 - DNA, 145 bp, Homo sapiens
ttttttttttttcccccccggggggtttggggggggcccccttttacccaaaaaatccccctttccccttttggggggcccaaaaaaagccttttgggccggcttgggtttgggccaaaaaaatttgtaaattgtttttttggga

SEQ ID NO: 575104 - DNA, 788 bp, Homo sapiens
  misc_feature (14)..(14): n is a, c, g, or t
  misc_feature (97)..(97): n is a, c, g, or t
gcactccgcgcagnctactcgactccagatgcttgttattctcttgccttgtgactgattgaagggaacaggcacaatgcaactaattacccctggnaaataattcatcgctatgtggacattacttgacaagtatttcggcagtgtctgtgaactagatatcatctttaattttgagaaggcttattttattttggatgagtttcttttgggaggggaagtccaggaaacatccaagaaaaatggccttaaagcatttgagcaggctgatctactgcaggaggaagctgaaaccccaccccgtgttcttgaagaaattggactgacctaactctcctcccttgttgatgacttcttgtggcatttcacacactgtagatggtcactcccttcatgtccatgttagctcatggtgtaagatgacgtcttgtcagtattactgctttgctaagccgcttcattcatgcctacacaatttttttttaaaagggaactttagttaattacgtgataagggacttacacatgaattagaatggggccgaaagagataccttttctggatattctaaagattacaggtcggctgctcttaatctgattgtgtcgccctctgaaaatggcacactcatatacatgttaaatcacgcagtgtgcatttctcaattgctgtatttgacacaggaaactcttacatataatgtgaaacctggctcttgagaccaaacactacgcagcctttcacctatgcaaaatatcacataaaaggcctcgttggccccacccgg

SEQ ID NO: 575105 - DNA, 462 bp, Homo sapiens
ggatatgaacgagaccggaggtagggataaaagttaggcacagtgtggttataacttaatggggattttgaattagggtagtagccataggaatggaaagggatgaattttgagaatcacattattgaggtgtagttaataagtaattcgatgaggggaaatgagaactctgggaaggccatttttgagatttgagtggtgatgccattcatacaggagtcagcaaaaggaggaccttggtgcagagtggagaaattgctacatttgattctggatctgttaaatttcaggcatccgtgggctagttacgacaagagctctgaaaagagactgagactagagaaaagaatttaaggtttgaaacagcaaaaagtaagacttccaaggaggctgtttggaggcagatgtgaactacgttgaagggcgaaactggaagcaggtacatttagagggcaagaagag

SEQ ID NO: 575106 - DNA, 1526 bp, Homo sapiens
tggaggggtgtcctttttatgggaaaccttaaatacggtccaaaaagaatatttcttcaatcaagggccctgggtgcagccaacacagaaaaaagtgaagcctttgtggggtttagggcgcaagggagaagaagaacgagatacagaaggaacaaagaaccccttcagcgagtgaaagtgcctcttcagccgagcctatactcagccttgtggccacagctttcttcaagtgggttcccaccattattaacaaggccgtgtccgtgggaaagtggctcatatttacaccgtgccaaaattcgtgcgtggaactcccttgaagggatctcctttcaggggttacccagttttccccaaatatgtgacctgtggtgaaagacctctcagacaacctgtggaatgtggctgtgacagacaagagaaaacgctgtgatattttccccgggtgccacggggagaccacggggtcaaactgtggggtcttacctctcaagaacaggtttccactccattaaccccgaggagtggccaaagtgaaatactccgtggaaggggaacaaagacacatagctcttcggagggacactcatagtgactcgagaggtgccggcagaaacagcagggctaagtgaaacaggggcccccaaggggccccaataagacgtggtctacgcgagaagcccccaaggcttatagcgtgtgtacccacatgtggggcgtaccgaactcatgagcgcgggtacacaccccataattcagataggaggtgccggtactacaacatcttccccgaaataaacgcccaaaggggataaacccctggccattaaatagaaccttcgccgggcgacaaaaagaacgagactacaggcagaccaaccaaaagacagcacaacaaccacagacaacacgaccaaagacacaaaaaacaagacgccgccagcgggagcaacatcacaaccacacgcacatcggagacacaaacacacacataaaagcccgaccgcacaccacgacacaacgcaacacctaccatcgaaccacaatacagagacaacacgcaaccacacaccacccacaccaaacaccgcaccagcacatctcaaacaacaccaaaccactcacactacacacacacaccacacccaccaccacaatcagcacacacacccaccgatgcgaggacagcggaacaagagagaagaacaacgcccatcgcacgaaagagacaacacaacgcgagcaaggaaacgaacaagagaaagatagagacgcacacaaagaaaccccacacgagacaaccacgcgcacagacagacaccagaagagacacagcagaaaaacgaccaccacgagacacacaaaagacagcaaacaaacgagaacgaacaacgaagacacagacagagcaacgaaaaccacacggccacccaacgagatagaacgcaagaaccagacaagcaagctaggaacgaagcggaagacaagcagcgacgccgaagacacgcgaaaacaaaaccggggat

SEQ ID NO: 575107 - DNA, 641 bp, Homo sapiens
  misc_feature (53)..(53): n is a, c, g, or t
  misc_feature (265)..(265): n is a, c, g, or t
  misc_feature (289)..(289): n is a, c, g, or t
  misc_feature (433)..(433): n is a, c, g, or t
  misc_feature (436)..(436): n is a, c, g, or t
  misc_feature (442)..(442): n is a, c, g, or t
  misc_feature (445)..(445): n is a, c, g, or t
  misc_feature (498)..(498): n is a, c, g, or t
  misc_feature (502)..(502): n is a, c, g, or t
  misc_feature (505)..(505): n is a, c, g, or t
  misc_feature (532)..(532): n is a, c, g, or t
  misc_feature (551)..(551): n is a, c, g, or t
  misc_feature (556)..(556): n is a, c, g, or t
  misc_feature (561)..(561): n is a, c, g, or t
caggcatgtactcagtgcgatgccaggagcggataatgctggttacgcgggtnttcgcgatcaggccaatcatcattacacgcgcatcttcgggtctgcactgctgatgtcaggtgtgacggctgcgtcgtcgtatgcgacggatcgaaacagaaacaacagtggcatctacagccaaccaaccgccagtagtgagttgagtcaggcactcggccaacagctcggcaacgtaacggcgcagatgatctcgaagaatctgaacatngctccgactctccaaattcgcccnggctatcgtttcaacatcatcatggtgaaggacctcaatttcacaaagccgtacaaatctttggattactgacgccaaggagccatgagcatgagaacgttcttgaaaaatgctttaaccatcaaaaatgctggcatagcggtngtnctgctngtnggcatctcgcagcaaacacaagccggtatgccggtgatcgacatcagcaatcnggancanaatatcgtcagtgcagtgcagcaggtngcggctgtcgagaagcagnttcancagtnccagacacagttacaacagtatcaaaacatgtggcaaaacacggttgcaccgagcgcttccatttgggaccaggcagtca

SEQ ID NO: 575108 - DNA, 303 bp, Homo sapiens
ccttgctcccgctgtgcaaaaaagaatccaggcccttccacgcgcgttttgggtgccggggccccgaagtgctcgtgggtccccgctagtctccgctggggcaggaccggaatcatgggtgggacacagcaccgccggtcacttcgaggcggacgagattagacatcaccgtgtaagggcatccgcttcggaaatgtattatcgatgaggatctctcatctggtcgagtctcacgtatctgtctatgtgctagttctatgagattaaagagagtagctagagctgcattgacagcagaagatc

SEQ ID NO: 575109 - DNA, 1429 bp, Homo sapiens
tgcccccgcgtgcaaaccagtaagccgaatacacaaacattattataataaacaccctcaccactacaatcttcctaggaagattgtagttggtgaggcgtgccctatgtaatatctaaatgatacggtgtacttggcgaccatggaacgcactacatgctatccgtccgctgctgctgtatgaaatgcgaacagagataccgcgccgagttccggctaacgaccaagctcagtacgacctcctcatgaaaagaacgtgtcctacccacgtcacccgtaggcattgacttatatagaatatgtctccgatacccagttacaagtctccgagcattccccgctcaaaagaaaaaacagaaaaaagaaagaacaaaaaaaaaacaaaacaaaggagggggcgacccccatatatatctaattttttatactgtctcacagctgatatagaaatccacacacacgtctcaacaagtgagaactagaagaaaacataacgcaaacagaggcggagggaggaagaaaacgagcagatgagcgacagcaagaggagaagaggcagaaagagacgaacgcccgagacgacacgtgagcacggggggttcgaccttattaaagagaacacgcggagcggcgcgagaagccgcaggggagaaagagaaggagggcagagaacagaggggagggggcagaagagaagaggagcggcggcgagacaagagaagaacgcacagggagtagcatcacgacgaccagccgagcagagactgaggagaagggaggaggaggacgaggaaagaaaggatagacataacagcaaagacagaaagcagaaagcagcggaggaagagagcgacagaagagcgagagagaaagacaccaacgcctagagacgactgtaccacaacacagaacgcaagaggaaaagaaaagagagaagacggtagcgtgccgaccagcaagcagcgcaaggcaaaggcgaaaagagagaagaggcaaagaccatagcggagaccacgacaggaaagataaccgcgagccgaacagaacccgcacagagagagaaaggaacaagagaagcaagaaaatcccgacacagcaacccgtcaaacgcagataacagacgcagcaaagtagccgcaacacgtgcagcgacgaacagcagaaagcagccgcacgctgtgaacagacgaacaacgcaagaagaagatacgcaagccacagtcaataccgtccaggctgcaggtaagacacgcacgacagcacaacgacggcccacacaccgctcgtaacagcgcagcagagtactaccgagatagcactagaacagaaagcaagacaacggcaagcacacgaacgagcagaacaaaagagacagggagaccatatcgagacaagacaaccagcaatcgaaagcaccagacacgcactg

SEQ ID NO: 575110 - DNA, 159 bp, Homo sapiens
atttttcggttggtttccggagaccgatgccccccacagtcagggggattttttttctagaaaaggggacaggtgctgcacgggcgcgggagcaggtcacagggaggcagggccaggggcatccccttttaaacacaacctaggcggggaaccgagctc

SEQ ID NO: 575111 - DNA, 130 bp, Homo sapiens
ccaagcatgtactgtgtaccttaccaagggtctggtaggtcgtgaggactgagcaatcaggacagcagtatgcagatgcttccctgcttcagactgacacacatcttagtgcatggcatgggcactaaaa

SEQ ID NO: 575112 - DNA, 302 bp, Homo sapiens
ggcacccgccgatgggtgaggaggcattgctccccttgcgtgcggtgggatgctatggacgcggagtatacccagtatgctagcgctcgtcgttggcaggagttgggtggggtgtgtttggctcgctggatgcacaccttggcttgctcgtcgtccgcagagactttatagcctatgatgcgccgcaccacgttttcgtctgcgttcgggtgtacgccgggtggagcgtggaaaccctggatgtacccaaactatccgtctgtggccgattcgactttccacaagacacctttacggtagga

SEQ ID NO: 575113 - DNA, 158 bp, Homo sapiens
cccaggctggtctcgaattcctggtgtcaaatgattctcctgcctcagcctccaaaagcattgggattacaggcatgagccactgtgcccagcctgttttttaacaatatagtctatgaagtgaagtttctctgttagtggagacattatgatttact

SEQ ID NO: 575114 - DNA, 338 bp, Homo sapiens
tgacccagagtcagatgaagccctttatctactgacccagagtcagatgaggccctttatctactgacccagagtcagatgaagtcctttatctactgacccagagtcagatgaagtcctttatctactgacccagagtcagatgaagccctttatctactgacccagagtcagatgaagccctttatctactgacccagagtcagatgaagtcctttatctactgacccagagtcagatgaagtcctttatctactgacccagagtcagatgaagccctttatctactgacccagagtaagatgaagtcctttgtcgacgcggccgcgaatttagta

SEQ ID NO: 575115 - DNA, 221 bp, Homo sapiens
  misc_feature (11)..(11): n is a, c, g, or t
ccccttgattnttccgagtattgtaaagggcttaacataactaaactgtatgatggacaatgtgaaaactcttgaacgtacgacaaagaattataaaacctactgaatctccagattgccaagtgaaacacaatggttgcctcttcaaatatatcccctttaattactaatggttggatcaaactcgttgatttatgtcttcaataaatgattcttagcag

SEQ ID NO: 575116 - DNA, 404 bp, Homo sapiens
  misc_feature (124)..(124): n is a, c, g, or t
ctaagatcgattagggtaccaagattgatcaattcttcgtagctgtgctcgggaggcgagagagcgtggctgttcatgatttacctcttttaacaaagaatcgtgtgagatctctgagatattnctcatatgcccatgttccaaggccttttttacctttccaaggaggacaagatatgaccctcatataaagggaccctctgccacttatgtcctcaagctggttacttggtccaagcttgccaaagacgcatgtgggggcagcattctgaaaatgaaggcccagggtcacaggtttgccccagcacacaggggcggagctgggaccttgtgccttcctttccattgcattggaaagcctttctgttggaagctggagtactttagggttaacttgtttaatc

SEQ ID NO: 575117 - DNA, 194 bp, Homo sapiens
tgatgtctccaaaaatctccatctgcaaagcttctgccaatccccttatggcaagacttgtgatgcagacgtagtgctgtgaaaccgaataatccctaactgtcctgcctgtggaggacaaaacaggatcctgcccacctggtgctccttcatggtggtgatcactgcccggcttgggtacctacgctttggca

SEQ ID NO: 575118 - DNA, 417 bp, Homo sapiens
catccttgttctagctacctccatgtggatggcctttgcaattgacttcccccttcctatggcctctgaaagaggtcagctagacaaaacaatagttgaatgcctcaagaatgtaaataagtgctggtttttatcctacatcaagcccagtgaacctatttgtggcagtgaccaggttacctacagtagtgactgccatctgtgctccaaaattctatttgaagggcttaacataactaaactgtatgatggacaatgtgaaaactcttgaacgtacgacaaagaattataaaacctactgaatctccagattgccaagtgaaacacaatggttgcctcttcaaatatatcccctttaattactaatggttggatcaaactcgttgatttatgtcttcaataaatgattcttagcag

SEQ ID NO: 575119 - DNA, 125 bp, Homo sapiens
tagtttcttctttgtaaatatcctattggtggggtaagattttactatattcttatagttttaaatttctggctgtgtaagactctggcagtctgcctctatggtagccgaaaccaagctttttt

SEQ ID NO: 575120 - DNA, 716 bp, Homo sapiens
  misc_feature (598)..(598): n is a, c, g, or t
ttggaaaacctgtgaatatttcactgcaacctctttaaaaagctcaaaaatgagttgtaaactggttaggtttgtggataatctttagtattttatgctaattatatttatacaaatgttaactttgttgaaaagtgatgctttttaaataactctaaagtaaatgtaacttttactcatgcaacaaaaaggcttcagaaaacacagtgtacaagaaaaccattaaacatgtagagacctcacagaatggaaacttgtacgtgctgcatgtcctctaaccaacaatatggctccagatacctcccaacctaggcatgcagtgaggggcatttccctgatgttacaaatggtgcttacctctagttaagtagaaattatcctccgattgaaaaaaggcaatcatttaagatataaatttgaatttctatattactttttaaaaaatattctggaccaggcaatataatcacatggtttaaacttcaaaataaaaaagtgtaaactcttcccccactactatccaattcttttcctcacagacaacttatgtggttggaatatttatatatcatttgagatatttcatgtaaatacaagnaaatacaaacaaatctatatatagctatcatttgctttcattatccaaatggtggcatgttgtataaattgttttgtacctgaagtattcacttagtaaaatttcttgatcaaatttc

SEQ ID NO: 575121 - DNA, 349 bp, Homo sapiens
cacgggctcccgaggtctcactttgtcacccagctggggatgaatggcacgatcttggttcactgcaacctccacctcctgggttcaagcaattctcctgcctcacatccccatggctgggattacaggtgcccaccaccaagcctggatttgaagggcttaacataactaaactgtatgatggacaatgtgaaaactcttgaacgtacgacaaagaattataaaacctactgaatctccagattgccaagtgaaacacaatggttgcctcttcaaatatatcccctttaattactaatggttggatcaaactcgttgatttatgtcttcaataaatgattcttagcag

SEQ ID NO: 575122 - DNA, 156 bp, Homo sapiens
  misc_feature (45)..(45): n is a, c, g, or t
attcgcggccgcgtcgaccaagttaacttgaaattgtatttaatngattgcttaagaaagtatgttggtatgggcttctcgctcttcccttctttttatcatgcacttaacctaccttcctctcccgtcgacgcggccgcgaatttagtagtagta

SEQ ID NO: 575123 - DNA, 421 bp, Homo sapiens
cggtttctgaattcaggctttagtgataggaaggctcctggttgtcagtggcctcagtgctataacgggctccgcccttatttacactgacaacaaagtggtattggcgtgttatagggtcacggaaaataccttcaattatcaattataggttttacatataccctggcttatcaaggaatagggcacactgttttatgattttgtttaagtattaagtatactatttctttactcttaatttctttgactctgtaactactgtactactccccttcgtctccctctctacttctctcctccgtctctctctctcacctactgacatctacactgtctctacctctagtctcactctagtctctcctactgtctctctctctactctactactagatactctactcctacacatctctct

SEQ ID NO: 575124 - DNA, 138 bp, Homo sapiens
ttgggacaggtggaacagcatgctttcctcttaccatccttgtatccagctcacgtcaggaacgagcagagctaaaacagcatatctgagactttccagcaagtgtacgctagcatgatgggatgggtaaggtagcca

SEQ ID NO: 575125 - DNA, 249 bp, Homo sapiens
cggcagtcagatcttagtggggctgtgatccacaggcgtcggttctcatcaggacttgtgacacagcttcgcaacatccaggacccaagtttgccctgcctggagttccccctggctctaggacactctaacaagctcggtccacgggtctccccattcccaccaggccctggacacacccactccgtaacctctcccctgtacctgtgccaagcctagcacttgtgatgcatcggacccgagaggcga

SEQ ID NO: 575126 - DNA, 139 bp, Homo sapiens
ctacattctccccgcatctctgcaaaaatcgatcctttgtccggtagaaatactacttgatgcttaaatcgctctttaaatcttattcttctcgagatttgatgtcgatacataaataactaaatgttgtttgctgcga

SEQ ID NO: 575127 - DNA, 1209 bp, Homo sapiens
tggaaaatgaattgtttcccatcataggggattcttaagcacgttctccacgttatgcggcgttgctagcgtggagtgttctttgggcataatgtgttcacacgtttgggcagtggatagcacacaggttggggtgctcttcaaaaaggccaaccagaataggccttcatgtgtgcctccgtgcaaagcaccgatagcgtgcgcctcgtggaaggcgccagattcgtggtttaaaagtctccttgagccaattttcttcgcaccagaagcgccgtggacagggaagtttgtgcgaattcaaaagttctcaggtggaactttcgtgaataacgttcataaattctcagcggagcggccaaaggataccagggccttgataacagaatagaggtttctttcaccccttccaggataagaggggcgcgcacttctttgcaggagccggcttttgtgatacgccagtttgcttctccgttgggtgcttattacccaccgggtcagaatttagaggcggggcgaggttctgcgcttttgagtaacgagacggcctatgtgtgtaaccaggaaagaactctcctctttaatctgtaaacccccccccctctttatctcctcttatacgagacgtactggagaacagctcccgcgagagaacaggcgagagagatggcgggggccgcattaggctgtatgggagcgcgaacgaacgacgggggggaacagaccataagcgttccttccagagaaggcttattgaggtctaagttataagatagaatgtagttaagttaacatcttattaatcttaccaacaggaggtattatttcagctgatgagcaagccactcccctcacaaagagcgtcactagtggagagaatggaggcgaccaacaacccccccttctctaccgaagagaggaccaggggggaggaaaaaagaagttgcccaccagcatctagataaaggcagactgggccccccactcatgtgcagtgggggagggtagtagagacaggcccatattatatagtggccgcaagtagaaagacaaggcggggcttagctgttggggtaaaaacccaagagtaagagtgacgagaccaccccccccgtttgtgtataacagcgagggcgagcggagccaaataatagcgcagccacatggaggggaacacttgcccttgaacgcgcagaacagagacatctt

SEQ ID NO: 575128 - DNA, 187 bp, Homo sapiens
gatctacgagcgcatcttcaggctattaattataacatttataccttttccatttacttcatgtcctgaccacactgatcccttactctgtgcttgtgtttttgtgtgtgtgtgtgtttttttttgggaaatggaaaaaaaataagtggcccaggttggagtgcaggggggcttgaaggggttaccg

SEQ ID NO: 575129 - DNA, 333 bp, Homo sapiens
aaaaagggacctaaaggacatgaaacagaatataaaaggatactagaactattaaaataatgaaataacaaactaaaaactcaaatatacatagagtagaatataaaaaagagtaaatatctagatcactgatgacaagttcgctataaagtacatagaagatatatagtgatgcctgctgccctctgaataaaggaatcaaaaccttcttcacaagtccctgaaacgaagagcctcgaatacagctgacaaaaggggaattcattttagccacaagaggtatacgatactggttatatggagacaaaatacttgatgattcctttatagaag

SEQ ID NO: 575130 - DNA, 335 bp, Homo sapiens
gctatccccattttaaactcattctttcatttaccaataggtgcaggtagactcgttagcctcccaaccttagcttaatactcgtgatgttagcctaggttcctgtgtgtgttcagcttgaatcctagacagtttcccttctcttcattaagctgagaagaacaaaaaattatctccatctaggcccacgggaattctgtgcatagactgtttgaattggtctgaaaagtgtgactagctacctaccttttcacaatgcctagaaaatgggctaccagattttgtagtggtcaaagcccgacttcccttgtctgacggtaactgtggttttcgaa

SEQ ID NO: 575131 - DNA, 668 bp, Homo sapiens
ccggactgcaggaattcggcacgaggctgagcatgctgtgtgcttgcatcgcgttgtgcagaaggagtagagatcctgcttacgagctcctcatcactggctgaacctatgcatagttgacaactcaaacctgacctttttggtcttgatctcatttgcaaggtgaattgatcacgtctgctgctgctggcctctgaagctcatttacgtaaagcacatgtacactgttgttcaacaaagcagcttatcttttcatgtacccacctacttacctactacctacaactttctttttccttattctagctgactcttcatacccctaacattttaaataccatcttaaacattctaatttcagaaccaatttccaatcatttattatcgtataattaaatcgatacaccaaccttcttctattacctccactttattacaacacttaatcctgaattttaccaccatctttcaaactttactacttataactctttgctcaaaaattttttcccacttttcaaacttccttgcccctttatgtatattactttacacttttatcattcgctcttcccatcctttaaccattgtcttctcttactctatcgcccttgtctcaattccccctatttatctatcgtttctacctttcttttcctcgtttgtcg

SEQ ID NO: 575132 - DNA, 1210 bp, Homo sapiens
  misc_feature (351)..(351): n is a, c, g, or t
cccacgcgctcggaatagatgagaaattataaccagagcagtaagcatagcgaaggatctaacccctataccttctgcataatgaattaactagaaactacacttctgcaaggagagccaaagctaagacccccgtaaaccagacgagctacctaagaacagctaaaagagcacacccgtctatgttagcaataatagtgggaaggatttataggtagtaggcgacaacatgctagccgagcctggtgatagctggttgtgccaagatagaatcttagttcacagctttaaattagcccacagaagccctctaaagtccccttgtagaatttaactgtgtaggtccaaagnaggacacagctctgttggagcagctaggagaaacaaccgttggtgagacgagaggtaaaacacactttaacagcccgatagctaggccgtacacagagcagaccaccaatttaaggaaagcgttcaatgctcgatgacctcacttacctaacaaaattcgcctaaacatataagcgtgaagcatccatcagcacccaagttggaccagatctatgcaccctataggaagaactaatgttagtatacagtacacatgaaaacattgcgtcctccgcataagcctgcgtcagattaaagagcactgaacgtgacaattaacagcccaatatctacaatcaaccaacaagtcatttattaccctcactggtcacccgacacaggcatgctcataaggcaccggtgacaacaaatggttccaggagactcggggaaatcttaaccccgccctgtgtacccaaaagaattcacctctaagcgatcagccagtattaagacggcgacggcctggcccaagtgaacaccatgtgttagcacggcgacaggaacactaaacgtgcaaaggtggctaatcacgtagttgtcctaataaagagcacgcataaagaaggggcgcccacaggggacgaaggggcatacagtataaaccagggaaagacatacccggacaaagggggagcgaacagcaaagagaacaacggaggaggtgtatacaagagcagacagacaagcacgaaacacagcacaaaaataggggcggaggaaccagcagtacgatgcaagcgacacaaagacacacagaacagagcaatcacaaacaaacagggcgagcaatcacgcaggcacaaacaccaaccacagt

SEQ ID NO: 575133 - DNA, 304 bp, Homo sapiens
ttatgtgtagtaggggtatagggggtacatgaaaggcttcgcacattcgtcagaaatgtagggtgtctcgtccacatatgaattgtcttatgtgtagtagagctagagaagtacttgaagactttgccacattcttcagatttgtagggtttctctctagtatgagttatctttggcctcccatggtgttggggtagcaggcatgagccactgtgcctggctgacaaagctttttaaggaagtcctcaacccttataacacataattcatactggacagaaaccctacaagtgagaagctgtgg

SEQ ID NO: 575134 - DNA, 154 bp, Homo sapiens
tatgcacttgccaacatctgaaataccacatggtgatgaaatcctggttagctggaggcatctggggccctgtgtgctggctaaatgtctctccaaggtgacaatgctggaagtcagcttgaaaaacaatgtggtgagtgtcagtgtgagaaga

SEQ ID NO: 575135 - DNA, 187 bp, Homo sapiens
atcatcttttcattgcgtatggcaatagtggcaagtagaaataggtaatttcattttctgaccatgtgattctccgtgttagtctcctgagtagctgggattagtaggtgcgccaccatgcccagctactcaggagactaacacgggagaatcacttgagcctgggaagcagaggttgcagtgagcc

SEQ ID NO: 575136 - DNA, 960 bp, Homo sapiens
tgacctgttaggagagtagatgcggggagggctgctgagctctgtgtgttcctatgtcgtgaaactcttctctccaagatcccaggcctggagttcgcagcacctatccggctgtgcaactatgaaagtcagcacctggtctggttcgtccagacttgtctcaaatgagtagtccgaaggtgtattctaatgtcgatgctttagcacttgagagagaagaatgaatcgttggagattccttgtgttgctgggaatagatcacgggaggaacatgggtgttagataaatggggtgatcatatatagaagtattttatatgattcggtgtgagtttgagggaacttatgttacatcgtaaataaggtcatgggatgatcgataagatggacccccggtagtctatcttattctaggtgggcctgaattcatattgtctgctatactaggagtagagtttatctacttcatcggttcctaggtacagcatgttagtgcttgtgggacagagatccattgatgacaacggaaatgacttttgaataataagaaataattctggatcaccattgtcacacggatagcgcaccgggtaatgtaatttttctgtattcgtatattagagtgctaggagggtgtaaaaggtgttacttgtcgatcgaattatttatgccgatgttaaggagatgtggccggaattgcatgtaggtgtgttgtgactagaaatgttggcgtgtcattccatgcgtgcaactatcgttattcgttttaacatagtcattaatgtaagatggatcctgggggtctaccaaagttatcagtaagaccgtaaatggggagacgcaatgggaatatagatccggtctttgaagtagcaccaggggtgataatacgccgaaagtttcggggcgcttgtgaaaatcctggggagcgggtgaaggaagaaaagaggggggtgaaatg

SEQ ID NO: 575137 - DNA, 383 bp, Homo sapiens
tgcgtattgatggctatcttgctaccctattctggagccccacaatggatctccacctggctagcccgcatcttcaccgctactcctaatttgcctggttaagcacgctcctgctcattccgccaagcctcgagaagcccctcaaccattaactccaattctcccttggccactatcatggctgtgctcctcatagccccgatgtgcttgttaccgtcttctcatgctcccaacccagcgccaacccatcgcctctgctccattgcttcatcgggatgcccaatccatctgtagtcccaacccgcgagctctggtgctctccccctctctatctctccaatccctgcttgggatctcatggcctctctgggcctgtaccttcc

SEQ ID NO: 575138 - DNA, 227 bp, Homo sapiens
tagcttaggtgcctctcatcatcaaaatgaaaaccttcttagtagtcgcttttctttatgtctttcttcccctttgggagagaatgaattacgtttgctcttggaatatttctctctcttatccacattgatactgctagatactcggtgtctcttgtctcgatctggctctctgggcttcctgtgtctcctctcgccttcttctttataaagccagtacttgagag

SEQ ID NO: 575139 - DNA, 533 bp, Homo sapiens
ggtgacgtgaaacatgtctatgaaaggctgaggacatcacatctgcattcatgcgggcttcctagaacccacagtactcattcatccaaggagatcatgtcagtgcctggtggccacactatacaaggaatcgtggagtatcaggaataaggcacgaccctccctttccttaggacagttccagttcacagggagatgaggcacatacatcagtaaccccaaagtccaggaaggtgcaaagagtcatgtggggctgcccaggcagaggtgacaaatgccactggtgacaggacactggtggacatagagggaaaagtccacacagacaggttcccaggcagacaggaagtcaaggcagttggggacgggagtcaaaacaagtgatgctgggacacagctctgaggtttgtgggcatctctgattgagggagatggaaggtgaggtcagagaatgaggttctcaattcatagatttgggctcataggggtgtgagagtgtgtgtgtgtgtgtgtgtgtgtgtaagagagcaaga

SEQ ID NO: 575140 - DNA, 212 bp, Homo sapiens
gagaactcggagcagcacttggaagacacaatgaagagtccctccattgttggagtcctgtcacaggttcacaggagttaatgtggttgcctcgggaccgtgtcaggtgagcagtcgtggatgtagtagtcgtcgtcgtagcccagcaagcagcgtaagcgtaaccgtgtgaccctcacgtagtattcctcgtcgtgtgtgtacgagtcaca

SEQ ID NO: 575141 - DNA, 150 bp, Homo sapiens
ctgactgcatctgtgctcccaggttcaatgcgattctcctgctcagcctcacatcaccacaccgggctaattttgcatcccgagtagagatgggctttctccatgttggtcaggctggtctcaaactcccaaccgtaggtgatctgcccc

SEQ ID NO: 575142 - DNA, 123 bp, Homo sapiens
agatactcttatcatatagctgcaagaaggcgccgcctctctcgtcttgtcgtctgtggtcccttcttcctctaccctcacctcctccattcactatgggagcctctcagtctacccctccca

SEQ ID NO: 575143 - DNA, 401 bp, Homo sapiens
  misc_feature (129)..(129): n is a, c, g, or t
ccctgtttcagttaccagaataaagagtgaatttgaatgaccttggaacagcctaatgatatcacggaagataggaggagttagtatggcagcctattgagagtcaggatcgaccccggccatggttgncttgtgccctgtaatcccagcaccttgggaggctgaggcgggtaaatcacttgaggcccaggagttcaagaccagcctggccaacatggcgaaaccctgtctcaactaaaagtataaagattagctggacgtggtggcagacacctgtaatcccagctactggggaggccaaggcaggagaatcacttgaaccgggtaggcggagattgcagtgagccaagatcacatcactgcactccaacctgggtgacagagtgagacttcatctctta

SEQ ID NO: 575144 - DNA, 83 bp, Homo sapiens
gaggattggctgtccggggctagggagcgcttctccgggaacgcggctgtgagggaggtggcccggacagtttggggctgcgt

SEQ ID NO: 575145 - DNA, 304 bp, Homo sapiens
  misc_feature (30)..(30): n is a, c, g, or t
  misc_feature (35)..(35): n is a, c, g, or t
  misc_feature (304)..(304): n is a, c, g, or t
ccccgttccttggccaaaggcttaaggaantggancgtacagtttcgcttgtgggggttccttttcctgttgatgcttccatgattgaaaattctagacatttggggcagttttattgggggagaaatttggggcaggttgagaggagagctttttggcatcctggaaatgtgctgtccagaggtttccctttccacaaatgatgcgtaacacacgtgcgcttgagcgaggcccgtgaaaggccttgcattgcttttctgctctggagcgccgctgcacaccccagccctggacagtcttgagn

SEQ ID NO: 575146 - DNA, 319 bp, Homo sapiens
tttctttttttagccattcttcatccagcatttattgggacaaccaccaacatttcaggcaccaggttacctgatgcagccggtatcaggaagctagcagttgacaaaaacagagtacactggcagactctgtggcagaagtgtagtggaagccccacagccctgggagtctctgcacttagcgtgtgtttcatggcgttggggtacctgatagctggccaagagagctattccttgaaatatctcagcctctggtaagggcctatgacgatgtatctgatcatgttatttttaactaattagttttgacgcagttgga

SEQ ID NO: 575147 - DNA, 1063 bp, Homo sapiens
cccaaaataaaggtggtgaatgttgagctgcctattgaagccaacttggtctggcagttagggaaagaccttcttaacatgtatattgagacagagggtaagatgataatgcaagataaacttggcaccaagaacggaatgatgctaaacaatgcagttgacggacatactgtgtactgacgttcagagacaagctgtgtggaacatatgacaacacatttatatgtgagcaggatcactcaaaactctactgagacatcctcacagaaactgaagactggctgtatgaacgaaggcgaggaccaagctaaacaagcatatgtcgaccacgttggacagacttaatgacacaattggcactccagttaccgttcggttctcaggaagctgaagaacggtcaaaaatgtttgaagaactaggacagagcgctgcagacattatgccaacgatagcagcctgacctttcagaaactacaggatgaggacaatacaagccatactatgactgacgtctgcaacattgaaccacaccagcacaaaaaaaaatcttcacggccatcacaaccccgatgcagcacaccaaatcatcgtagcacttgccacttggtctcataatgatcggagaccccaaattcaagaaaaaaacagagaagactatgacgacaaacaccaaaagcagaccacaaaaacgaaaaaaaaacaggaaaacccggaataaggacaagaacaaaacccaggaaaaaaaccaccacagacaactagacaaagcccggggtcataccacctagcataacaaaaaacggcaagaaaccaagaaaaccaacgaagaaaaatacgagttataacaaacaacgactaaacacacagagaaacaaaaaagttaatacaaatagagtaataacaaaaaaaacgataaaggagaaaaacagaaaacagctcagactagatctgggaggggtagacacagtagaacaagaaatgaacataaataaagaaaaatcacagaagaagaaaaaaaacataagacagtagacgaaaatagctagtagttcttgaacaaag

SEQ ID NO: 575148 - DNA, 136 bp, Homo sapiens
ggtgaaacttgtgtctacacaaagttttaaaaattagccagtcctggtgtgcacacctctgtggtctaagctactggggaggctgtggtgggagtaagctcttcagcctgggagtttgaggcaacaatgaaccatg

SEQ ID NO: 575149 - DNA, 855 bp, Homo sapiens
  misc_feature (3)..(4): n is a, c, g, or t
ttnnggaagatgaaaacgagtcacgacccgatatacgccgagttcacttttcgcctgtctttcccccaccgtaagctgctatgcctatttcacgacaagcgtaggtacagatatgtacagggtcaccgcgtcttggaaaatgtgcctgcgtcctatttataagtttgtgagttaagcatagattgttgtagtttgtatgcagagggtgttgtgccgtcgtaacttccgagagttttgttgtaccatgtgatgggtaatccaaggcacacaattggaagcaacccatgtgttgtatcatcaagtcacccgtggagattcggaaaatcatccagtgcgtgatgttgttggtcatcaccgggatacttaaaatatcttggatggggttctactctcccccccgggatttttggaaaggcgcaaggcccccccgactacccgggaataattttgcggaaatggtataagccctctgccttgagctttacttggtacgtcaagccagactgggctcccacgctcccaggggatccccgtgtctccaccctgtctaaaaacttgtgcgtggctttctgaagccacaattttgttttttttttgagacagagtctcgctctgtcaccaggctggagcacagtggcccaatattggctcattgcaacctccacctcccgggttcaagcgattttcctgcctcagcctcctgggtggctgggactgcaggcatgcgccaccacgcccagctaatttttgaatttttgtagagacggggtttcatcatgttggtcaggccattcttgaactcctgatttattcccctcatctggacagggacaaagcccccccccaaaataacaa

SEQ ID NO: 575150 - DNA, 379 bp, Homo sapiens
aatcgcttgaacctgggaggcggaggttgcagtgagctgagatcgcaccactgcactccagcctgggtgacagagcaagaccctgtctcaaaatagtaaaacttaaaattcaggacctcctcaccagagctatactttgagtgcacagtagccatatgtctatactgcagaaaacatttccatcctcccagaaccttctctcatgcagcttctgtgagcctcgcatcagttgtgttcactgaactcatctaactcaaagcacatgcatcaaagctggaatttcagggttatcggtttgcaggtgagagccgtaatggtccagtggaagtgtacagctggaagggaatgtcgtcagctcctcctcctcacctgaaggctc

SEQ ID NO: 575151 - DNA, 840 bp, Homo sapiens
ccctttccctccccttcgcgccaattttttaagcctttctcgccttaattttcccccgccttcctactcaattccggtctagcccctccctgtaaattctccgatagaggcctccattactccgaatttcaccgttaacaatagaagtcctgggacctcaaaggttccaaatttgaaaaccactcgcccaccactggcaatatcactatcgccacaaattcacgcttcctggaacaattttcatcaatattctctcccgaaaaagtcccctgtaaaattataaaaagggggaaccccaacaggagactcacccacctttgttactgccccggcccaaaattttactctcaatactttcccccttattggtttaattctgcactcttttaaagaagagccactatacgacccaccggcttgagcgaacgcccttcaattacctctggactccattatgatcccgggttgtatacccctttagaatacataattttaccggaattcctcggggatctacaaactcggcataactcctgtgcccctggatgacaaccacacctctctacgacattccacccttggcagcaataactcacgttgcccaacttgctggattctcctcgattaagacacgactcgtaacatcttagtaaaccccaccatttctatttcacaacccgatgggattccccgcgcctctttcaaaacgtgttacagtatgattattctctttaacaaagctgccctcgctatcttctggaaagataaatctattgggtacccaacgtatgttcccctacttgcacacaacaaaaaacccttttaaaagtcaacaaaaca

SEQ ID NO: 575152 - DNA, 1376 bp, Homo sapiens
tccacaggagttaaacgttcctcgtaattttcgctctgctcggaacgaacttgaagaaggacaacaaacggagtaggcgacggtacagcttagctggggccctgcaacgactgactgaagatactgacaccttacacaggctggacacggcactgacctctacttcgggccaccacaggcacaaacttactgaaacacagaactactatagccctgcaacagctagcaactgctggaccctacaaataccccacgcaagcctccctccgcctcagctcttagcactcttgctaacacacacaaacacttacattactgcaaccgcgcacataacactaactctcccagctgcggactggctggactgcccccggcatggcacttaacctacggctgctctacgccaaacacactgcgcccaacaacattccactactacgccactctacaacgctctgctaccctttcacacgcacgccctcaacgcaccgactcctacactggaactgctcccaaacacgcacacacacctacctgcaaacgcccttctccccaccaagcccccacccccacgcaaacgggcaccacacaccactcacacaccgacactttacacctttctcctacgcgctggcgcacgtcatccgaatacccttggctccctctacactacttcctcaaccaacccccttctccgtaccttccaaatggcgctctcacagcctgcgctccctttcgcccctctctcacaccacgtccattcgcacccacaatctgggccgatcacgctcactcactctaccacttttctcacacggcctctcaccactcacgccacactctctccccagcgcgctggcgtattgctcgcgctcacttgacagccccgctggggcacacccactctctggctcccacgccacgctcacttcactcgctcagcgcctcactcattgggctttaccgaccgcgccaatcctcccttcgccttctcccccccagcggcctcacaccccacgccgcctgctcgcatgccaccctctttgccctgcctgcccgctcactcctgcgatcgcgacatcaccgctcccactggcacaccaccgccggccccgcttcgccccccactcacccacgccaccccgcatgaacacgcaccggcgcaacagcgcaacaccccggaacgacctccaccgcacactcccacagcgctcacacacgcaccgcacaggccaacaccccccgccgcacggcacacacacccgcgcacgcacacccgcgcgcccgcaccgccacaccgcccagcccaccgccctccccacacacacccgccccaccacctctcgcgccgaacaccagcgccacacgagccacag

SEQ ID NO: 575153 - DNA, 1052 bp, Homo sapiens
ccacagcgtacgaaccgggttcgagacaccggttggggggtggctggtgtgccaccgcccaacgggttccgagcaccggagctggtgctgctccctctttggagcaaagttttatgcaaagagggtgttattgaaactttcggtgcacggtgattatatacttttttacaggtcccataattaggaagagtcgactcgcttaggcccttgtatattccctatctagtgcaaagccacgaatttggcagccatgtttctctgacctttggattaggtcggtttacacctggtgtactcacatttctacaatcgtctcaagtgaccagttagatactcattcatcagcagcactcgtgcgcggaatagatagggcaatccttgccatgggatcatatacttagtgtctaggacatacttcagcaagatcgcccctgaacagcgacctgtatcccatgcaacagcgtaccggacttacgacctctgtgacacttagaccccgattacagagagaaactatgacatcctacatcgcagccacatactaccttagcacctcggaactttcaaccgagtagcgctctgcaattgatcagcacacacattgtcgctcacaaattaaacccaagcaaactatttcggggctatatcaccacttctcccccgatttgagccttaaaggctctaagcctttcgacaacggcggtgccgctcatcagtatcgtggattcctaccattaacacagtctgtacaacatcgtgggccatcaaaccgcaacttcagaacaacatcaagttagtctcaaatgatcggacacatgataagtcagtcaaacgaacacgctcaggacaattcacccatcacaacatacctaattgcggaccacaacaaatgctgtacgtaacgtcccctctacaacacgaaaaggacctccggaactacaagggtgcaacaacaaacgaggttacaactacgcgatcaatgctgcaccaatgtatttgcagtgcgtgggacaaacacaaccagcataggtatctgagcaacgacacgcgca

SEQ ID NO: 575154 - DNA, 695 bp, Homo sapiens
agcgcgagaggcggtaacgatgcctggagttactgtaagagacgtaacaaccatgcacgagttcgtacagtagctctggcagccttcctctaaaaagtccgggaagctgaatgtccccgaatgggtggcataccgtcaatgctggtccaagcacaagagagcttgctccctacgatgagaactggttctacacgcgtagctgcttcctcagtcgcggcacctgtacctccggggtggcgctggggttggctccatgtaccatggatctatgggggacgtcagagtagaacggcgtcatgcccagtccacttcagccgtaggctccaagacgtgttggtcccgccgggttccgtccaatgtccctggaggggctgaaatatggtggaccaatggatccattgtatggcggttcgctaatctgatcatcctcagtggatcaatatgacgactctggatctgcacactcgccggacaggtgcgctagctgcccaatcatagaagccattagcacatcaataacccactgactgtggcttatactaatatatgcccctcatttcggtagacacacaaaacacaaaaaacaacaacacataattacaataaatacaacacacacaataataccctctccttcaataaacccacatttactcacataagacaactcctacaaataaagaccacatactacc

SEQ ID NO: 575155 - DNA, 442 bp, Homo sapiens
ccatatcgtgattaacgaagtagcccaaacggtcatccaccgccagctcctccatcagtgccgcgcccatgcccatagtcattgcgccaatgacctggctgcgcgcattttcggattcaggatgcgtcctgcagcacacacagcgagcatacgccggacccgaacttctcccgtcgcgctatgcacgccgacctccacaaaatgcccggcaaaggtcgactgctggtactctttgctcagtgttccgaattcaatgctctcttccgctgtcagtctgccgcctgcggtggcttcatgtagcgtggcgcttcgggtaccttggtaatcttgccgtcggcaaactgcgactgctcaggatcaaacccgactgccgaggcaatcatttcgcggggttcatacaggcggcgtaacgcggaggtggaggtattcgcgcccattgtcc

SEQ ID NO: 575156 - DNA, 399 bp, Homo sapiens
ttttttttgccgacggactaggaatcagggatatagcaggggacaaaatgcgacaataattcctgtcctgaagtttacattcccctccaatggccacaggcaacagacaggtaaattcttcagtactggcggacaatgtcaagaactgcgcagaaatttaaatcagggagggacatgagggttggaggaggaaggtgattttgttcttttaaatgacacagtcagggagggcctggggagaagatgagctttgggcagaggcctggaggagggggatgaatggggcagggatccggtgtcaggcggccagtgcacaagggaggaacagggacagccagaggagagaaggaggagatgtagccctggccactcgtggggctttgagtcgcgtaattttcg

SEQ ID NO: 575157 - DNA, 527 bp, Homo sapiens
tggaaagtaggtggatgtgtctgaaataggcccttggcatttttctgaaatgaaaaggagcagagtgtcattttctaatattgctcagcctccaaaaatagaagaggggaggcaaaaaattattaatttagtaacagtgaagctcgagtggtgattacttcatgatgtaaaatcagaggttgatctgatggtgagcacggggtgctcagatggtatagagagagaaaagaagtgagggcactatgcatccatacccagctctaccgggcacagcagggtagactggaggccaggagaggaaaggcaccctgaggagagggctctgcagccagagaggggcctgaggactgtggaaccgagagctagcagacgcactttagtgcttatagctctcccggcgggaggaggagggggtggtgtactggaggggggaacggccgcctcaaacagagctggaggccacccccatgggctctgccatggctggaactgaagccacctccaaggcaaagaccagtgccatagga

SEQ ID NO: 575158 - DNA, 141 bp, Homo sapiens
acatgttgccacggtggctgataaacggtcctcttcgcggatttccctttaagcttttctggtaaggcgggtctaggggggataaatccggttttaatcggagaaagtctggatcatcccttggtttttggaaagacagga

SEQ ID NO: 575159 - DNA, 628 bp, Homo sapiens
tctgtcggtgtactatgcactggggttgacagattagaagcaaccaggaacacatactgagtgaaatttttgttgttgggatttcagatagagtctggtttataacaaagcaaacagggccaacgtccacaccaaattcttgatcaggaccaccaatgtcatagggtgcaatatctacaataggtagtctcacagccttgggtgatcgatattcaaagactgttttgctccattccccagtgtgtaacgtgcaaccatcaaccagaactgtgtaggtgaatttgctatttccttcagcctgaattcaccttcatttgaccccatcagcttcagggccttctttacatttccactgggctgatccatgtatgcaatgctatttttgcagtgatatgtgatgtactgggaagctcggctggagagaaagtcgacggaatgccagcttgcacatcaaggacatcttcaggaagttcaggattgccgtagcttaaactgaaaaccaccatccatggactctccaaaccaaaggtgttcttctcagcactagaatcttgtccaccagtgttccgtggaacattcaaggattggccttatgcttgttcccagttcatatacagatacttgtagc

SEQ ID NO: 575160 - DNA, 445 bp, Homo sapiens
ggctcgggttagtggcgcaatctcggctcacgcaacctccgactcgctggttcaagctattcttctgcctcagcctctcgagtagctgagattacaggcatgtgccactacacccagataatttttgtatttttagtggagacggggttcaccatgttggccaggatggtcttcatcccctgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttgggatgaagattctgatttggtggctttgagatgaggcataagattctgcatttctagcgatctccccgggtatgcctgtcctgatggtctgagagcca

SEQ ID NO: 575161 - DNA, 198 bp, Homo sapiens
cagtactgtaatgcacggatgcagttaaacatgtgaagtagtgatggtttaagaaataagctattacaatatagggatcttgaaggctcccgggggtaactattttataacttagataaaatggctagtcatatctgtgtgttagtaaagttatttttttaatattttaagattacaattttaacaaactgaaatgag

SEQ ID NO: 575162 - DNA, 768 bp, Homo sapiens
catgcatactcaccagacgcctcaaccgccttttcatcaatcgcccacatcactcgagacgtaaattatggctgaatcatccgctacttcacgccaatggcgcctcaatattctttatctgcctcttcctacacatcgggcgaggcctatattacggatcatttctctactcagaaacctgaaacatcggattatcctcctgcttgcaaactataacaacagccttcataggctatgtcctcccgtgaggccaaatatcattctgaggggccacagtattacaaattactatcagcatcccatacattgggacaaggacctagtcacatgactctgaggaggctacctcagtagaacagtcccaccctcacagattctttaccttccacttcatcttgccttcattatgcagccctagaagaattcaactcctatacttgcacgaaaaggggatcaaacgaacccctaggaatcaccctcccattccgattaaaatcaccttccaccctttatacacaatcaacagagccctcggttactttcttccacattctctcctttattgacttaaccattattctcaccaagacctcatagggaccccaaacaattattctctaagcaacccttaaaaccctccccatattagccgattgatattctatcccactaacaatctcgatcggtctaaaaataagagggtcttgccttatatcatctatctgatatccatctctatccacaagctatttccatacaatatttgcc

SEQ ID NO: 575163 - DNA, 1188 bp, Homo sapiens
ttggctgcttgtgctgttttgttgtagttgtgcgttctctgtgcgttgtgtggtctgttctctgtcgcgtgttgtgttggtattctcacttcgcgagccttcttctgcggtgtgtttatatttgcctcgctatccggctcggtgccagtgtggcggtttgttttgttctagtctcttctcctttctgctgtctctatcgtgggctcaggctcgagtgctgtctgtgtcactctgtgtaactggttctgctgtcagcgccatcttggtgtggcgtgtcgcgggtccttgggttttgtgttcctgttggctgctcttccgtgtcggtttgttggtgtggtccccttctgcatctggcatgtctctacttccttgctttgtctttgagaagtggatccttacatggttttatatgtcagtgctcatcccttctctacggtgggcctgctgggtccctgtctggcctggtcacatcactcgtactttctggaaacgccatggctgagtttaacaagttcttgtagtttcccaatgctaagtggaatctataaaccagtgagaaaagttgcagagtgtagcttgtgaattgcattcaagaagtacacttctttcccattgctccgtggctcttggagtctccgtgatgccaggctagagtctgattactataataattcgaaattggtaactcccaaggtaatgctttcttccatttcatcaggatctgtttatccccagtgcaccccctccccttctcccttgcctatctggatggcttctcagaagctcggccctagtcctccctgccttggcggggaccagagcccagctactgctgatggcagcactgctctcgtcacgctgtgttgcctttaccaagtgtcttcagagggttatgacgttagagtagctggcctggggatgagggtgcctccctggcgatttgatctttagggtctgactttctgcagagaagatgtctattacagatgctgtcaaatgctgatagtaatagtgcgattgcggggacggaaatccacgatccgcgagaagctgtgttgtcatgcgtgggtgtgcaactgcctatgtgatcctctgtcttaaaatgaattctgtctgtgctccgaaacaaagaacaaggtgaggttattttcttgttcttgtaagtaatataaagctgtgtgtttctga

SEQ ID NO: 575164 - DNA, 208 bp, Homo sapiens
  misc_feature (10)..(11): n is a, c, g, or t
  misc_feature (30)..(30): n is a, c, g, or t
  misc_feature (44)..(44): n is a, c, g, or t
  misc_feature (169)..(169): n is a, c, g, or t
  misc_feature (188)..(188): n is a, c, g, or t
gaaaacagannagcaataattcaaagttanttcaaagtactggncctggccgggcatggtaattcatgcctgtaatctcagaactttgcgtggccgaggcaggaggatcactttgaggctaggagttcaagaccagcctgggtaacatagcgagaccctgtctcaacanaaatgattgtttaaaaatnggcccagcatggtggcatgt

SEQ ID NO: 575165 - DNA, 263 bp, Homo sapiens
  misc_feature (142)..(142): n is a, c, g, or t
  misc_feature (211)..(211): n is a, c, g, or t
  misc_feature (216)..(216): n is a, c, g, or t
cgaggaattatgctaaatatactctgcttgtgctctataaaatggaacaacaaagcctagattacagcacatccatttacagcatggtttactgaatattttgagtagatgctcaatgcagaagcactatggttacgtttgncagtacgccagtttgcatgaattcaaaatgaatctgagctttcccccttccacttttctttcagtttgnatacnagaacactttacctgagatataggccgtgaaggtgtccacttcctgg

SEQ ID NO: 575166 - DNA, 496 bp, Homo sapiens
  misc_feature (50)..(50): n is a, c, g, or t
  misc_feature (61)..(61): n is a, c, g, or t
  misc_feature (220)..(220): n is a, c, g, or t
  misc_feature (316)..(316): n is a, c, g, or t
  misc_feature (377)..(377): n is a, c, g, or t
  misc_feature (383)..(383): n is a, c, g, or t
  misc_feature (398)..(398): n is a, c, g, or t
  misc_feature (407)..(407): n is a, c, g, or t
  misc_feature (426)..(426): n is a, c, g, or t
  misc_feature (468)..(468): n is a, c, g, or t
  misc_feature (476)..(476): n is a, c, g, or t
tctattggtctgtgtgcctgttttgcatcagattatgctattttggttantgtagccctgnagtatagtttgaaggtgggcaacatgatgcctccagctttgttctttttgcttaggattgccttggctattcgggctcttttttggttcccatatgaattttaaaattcatataaaatttaaatttaaatttatgttcatctaaattttaaatttaaanttatataaaaatttcagccagacatggtggctcatgtcctgtaatcccagtactttgggaggctgaggcaggcggatcacctgaggtcaggagttngggatcggcccggccgacatggtgaaacctcatctctactaaaaagtaccacaaaattggnccgggncgtggtggcacatgncctgtggtncccagctagctcgggaggnctgaggtcaggagagtcgtttgaacctgggaggtgggggttncggtgggnccgaggtcacgcaactgcac

SEQ ID NO: 575167 - DNA, 150 bp, Homo sapiens
gtggagccggcggcacctctgttccgcttggactgcacggcgactctctctcgtcactgtcgctctctgctgccgttcacttcacccgcccgaaccggaattgctgtcctctcggtcgtctgctttcgcgttaatagcgcgtatcttcac

SEQ ID NO: 575168 - DNA, 1362 bp, Homo sapiens
gcggtgctctcagaatccggactacgcggcagcggctcttcaaagacggagccgggagtttttggcttacatgttgtttacgatcaccatgagtacgcacactaataatgattgagacttgtagttcttgagagtaagatcattataaaaactagctagggaggatcatacgaggggcgtatcgtgccctaatcatgctagggttgaagcgtgttttctatgtgaatgcatgctctggcaggagatattgagtgtacgtaggcaattcattacggaatgcctgtggacgcgttggtgggtgtcttgggatggtgccctttaacgtagccaaggcgcaattggaacaccagaacctgcgcaaactagtgggcattgcggcgtgtcgcctgtggcattcggtgccgatgcgaactacgtaattgagtgcgttttgccctcgaatgttccctagtgttcatggcactagttgcggctttgggctcagtacgagggagcacactggggcgacgacctttcaggtaatgagaagtaggaccactcagaaatgctaagttatgtaataccgccccatgacggagcggtcgatctgccgggtctcaggaagagtaccagcggatcgtgggaaacgtaactggctctagtttcaaacggaaaacaaagattgcaggaattcgagcggaggttggagtcgtgaccaggcccatcgttcgcaaatgacggagcccaagctgggttccccgagagcctccatggtatttgatccgaccacttatgggttcggttaggcgcgcgatagcgttgtgctaaggactctgccgcacactcgctcgagaattggtactctgtcgaagaaggactcacgcgtagggccagagccgttgaggacaccaatctggcgtgggtagcacacctgacggtcaccttatcaacgaaacagcttcgggtagcctgcactacgccgaggcctagataacctaccaggaggacaaggacaccgagcgcagaacggccaggcttacagcgcagccaggcaaatgcgccgggaaccacgccggggaagccctgactacaaactgggacaagtggctagcccatggccacaggcggacggccgcgcaagggcgacctacagccacgtggaccacggagcccacgtccagcgcgcacgcggtgggaaaccacaccacgcgatgaaggaaaacggtcaagtccacaagtaccaccgccaggagcgaacacctgacgccgcagcggaccacgacggggacatagaatagcacgggctacgcgagccagaaacggctaccgggcatggaaacgagcatgacaatagacgtgaggggcatcttcacagcggcaatg

SEQ ID NO: 575169 - DNA, 181 bp, Homo sapiens
actgaaggactgtatctctcatctctcacctattgatgagatccatccagaccaggctgaaccctcttgtgatcagtgcatgtaagcattccctcctggtcctctacctctaaagcctggaagagatctacacatacaaatagtggtccagatacccattttctctgtatggccttgatta

SEQ ID NO: 575170 - DNA, 556 bp, Homo sapiens
tcaaaagtcattcagcaattgcttttttgtttgttattgacacaaggtctcaccctgatcatccaggctggagtatggtggtgcaatcatagctcactgcaaccttgaacttctaggcttaacggatcttcttgcctcagcttcctgagtagctgggattataggtgcacaccattgcatgtggctaatttttttgttttttatagagacaggtttttgccatgttgcccaggctggtcttgaacttctgacctcaggtgatctgcccatctaggccttccaagtgctgggattacaggtgtgagccaccagtcccggccaaaatttccacaaatttaaatgtatttgactcatccagtgttccacatagctttattttatacaccttacccccacagatatgcctgattggtattcagaaattatttactgaacacctattatggctattatgtggcaagcccacagataataagcacaagggcaggtgtcatgtcccatttatttccatatatcccattgttttgcatgtgataggtctgcgataagaattcac

SEQ ID NO: 575171 - DNA, 565 bp, Homo sapiens
gaaaaccactgaattaacacatgttaagtgcttggagtgatgcctggcacacagtaagtactgtatttgttagtcatcattttattattattgtttgtgtatatttactatatatcatcactgactaactcctgaacaaatttatggttttaatgaaggagcaggagatggcattacaaccctctattgtatgctcatgttaatttagcacacaggcagatgggtcatgtgctgcaggaaatgaacagaatagtaacatccaactcatcttttttgttttgcaccaacctaaaatatatgctcccaaaagaggagcacgttgctgtttgcagcttttctttccctctttccttttattttagacacacttaatgattctctgatgccgcaagaaaactggtattcctaccaagctcttggagacacccaaggctgccctttgagaaatattttcaacaaaatatgtttcttgacagacagaacacaaaggacacttgggagagagagaacccaagctcctgtgtagctgggattgatcccataaaggatgtgggaatatagggct

SEQ ID NO: 575172 - DNA, 545 bp, Homo sapiens
  misc_feature (36)..(36): n is a, c, g, or t
  misc_feature (61)..(61): n is a, c, g, or t
  misc_feature (67)..(67): n is a, c, g, or t
agcccccaggtcttcatgaatatctagttgaactgnctaaagaagagggccctgtaacagnacagancaccaggagcctgaaccccgcatcttctacccttatcctgcatttatcctgcctgcattcaagcctgtccagctgcaccactggaggttaccatggcaactaaacccagaggcagccggtaactgagatacagctgccaagagcaactgatggtggaaaaggccaacagcagagactcttagaaggaagagaagtacacaggaggaggccccagaaccctgagggtgctacactcaaatctaatcctactcacaactcagcaggcagtcaacgtcttgcacaaactgccatatcaccaaccagaggcacagatatggacacaatggggccaatttgcagagatgtttgcaactatggatgcagagtagcacaggtgggacacatgttgtttagcccaaaagcaacgggtcttggtgaaaacgaaaatgggtagggtaccattgctgtttccaatgaaacaatgaattttgtgtacaaa

SEQ ID NO: 575173 - DNA, 521 bp, Homo sapiens
ggagggctgaggcaggcgactggcgtgaaccctgggacggcggacgctcgcagtgagctgagatcacaccactgcgcactccagcctgagggacagagcaagactccgtctcaaaaaaaaaaaagaaattgggaaatttaaatatcaaaactcacccaatgggcggcaagactatgcagcaaaccagtaagatgttatccattttaatttctagaaacgagggtctcactctgtcacccgaggtgggagtgcaagggccagatcacttgctcactgcagccttgaattacccagagatcctccagcctcagaccccccggtagctagaaactccgggcacatgccaaccatgcccaagctattttttttaatatttaggtggagcacagagtctgactacttggcccaggtgggtctccaattcctgagctccagagatcctccaagcttgggcctccccaagtggtggggactacaggtgtgcgctcatggcaatctggataatgtttcccattttagaa

SEQ ID NO: 575174 - DNA, 339 bp, Homo sapiens
gtacctgtgggtatgcatcaataatggaggtccccaggttggggacgagccccaagttgagaacagtatagtgaaccattgttgtactgaaccacttagttacggatgactcgctgatcatcaaacaacctgtgtgtaatatgtattaccttacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 575175 - DNA, 309 bp, Homo sapiens
  misc_feature (19)..(19): n is a, c, g, or t
  misc_feature (227)..(227): n is a, c, g, or t
  misc_feature (255)..(255): n is a, c, g, or t
  misc_feature (297)..(297): n is a, c, g, or t
ggcggctccaaaagggtgnacgtggagatgttgccgctcccgcccagggctgctttgcactcggggagagatcctgggctgaagagatttaaggacggcggaccgcatcgggcgcgaattcagctctgggcccaaatatgaagtgggcatccggtgtgaggctcgactggggcggtgctcgagcgctgctgggggaagcccagggcctccaagcctcaggggcgcgncgaccgaccgcgctgcgctttccaggcnggagctgcgggcttcgctcctggccgctctgggcctgaaagntgtcaccgccac

SEQ ID NO: 575176 - DNA, 1202 bp, Homo sapiens
ggtatgtgggtctgggtggcctgctgctccggcctccggggccttgctggagactacaccccttacagcgtacgctgcccccagctcagctcttacttgctgtgtgcctgctcctgacggctggtccatcctgtcagggactatgctgtgcgcaaactatcgtccattcgcccaaaagcaggcgccgccacctgtggcgcatcgtgggcggtcatttggcgcacgtggtggacgtccagtttgatgcagggactaccaccaattctaaatgccctggcaagtgcacatggccagggagcaccagcactggttttgggcaggttggcccagcataatgggtgagcagcacagtcaaggacttattggctaatgcgatggtccatgcaagggctagggtctagcatgggccatgcacacagtcactgggactcctgtggttgcaccaaatcaacaattccctgtagggatccctgagaccctttgggtgcacgcaactcacttgcactggtcacttgcggacgacaccatactgtggatgacacacgcacggtcccatcaaaagactccaagacacacacttgggctccccagttcattgctgacggcttccaagcagttcatagggaccattgagtggtcggagccaggacacattcttggttgactgggctactcaaggtctgggaccgatcctgctaagcctacacctattgaccacagcgactggccaaacacactttggcgcgcatttctaactgggcattgggcatgcctggcagcttagggccaaaggaccttggtaccttgcactccagtgcgcatgcttcacccttccaactccacactggttccgacccaacatggccccatgttggctgggctaacctcccgtgctggttcttggccggcgactggacctggccgctcaccgacagggcacccctgtttgaacggggtccaacggcacttcaaattgcccccccgtgcacacattcggttctgacaccccttgcggttggtgtagctccaacgatttatcccacccgcattgccacaccccataaacggggaaacagcgctagggacatcattgcgcacaagctttgaattttagccccccccctttgtgtcgtcctcatcgcaccacggggatacgacatcataaccatgggtgggcagagccacatggggctgacgcaacg

SEQ ID NO: 575177 - DNA, 516 bp, Homo sapiens
tggtgatagctgggtgctgtccaagaggcgacagggcgtcgttaggggagcgagtcgtgaccggttgggcacacacgtcaccgtgggacgaagcttcgccatactgtttgactacgatgcgtgcagccatccgcctcggactgtcggccctcgaacaagagcagtgcaccatcggcgcgccattccctctcggcgcactctctaccctggcagcgggtggcaggtcacgacgcggacgaccaaggactgcgacactgggccctggcacagacaagcgcggacccttttcccctgcttcccttgagacgtacacgtacttctggacgtccatcggaacgactgtaagaacgctcggagacactgcacacacctggcgccaacgcgcactcacctcacactcacacgctcctaccacaggcacgtgggcgcctcaggaccggagctccaacagtccctggtctcccgttcatgcattgggtacggacgcgctcccatttcttgcccctctctccttct

SEQ ID NO: 575178 - DNA, 370 bp, Homo sapiens
  misc_feature (5)..(5): n is a, c, g, or t
agtantggacgcttcagagccttctgcagattgaatgacctgtcctgtgagtacaatgttgcctgaggtgtcgccctaaagcatgggtgtacatagatcctcttgatagtagagtgtgtacctgttcacacaccacctttccttgtacatcttcctatagttcaattggtgattcctgctgtgatgtaatcgtatgcaggggtagtggaaaccagaacttcgcctggcgaacagcgtgcaaccagtgtaaggccccaaagcctgacggttccctcccgccatcctttccgcccccgggtaggtgcaggttccatgagtgtcccctcagcctcccttggtgccttcatgggggtaccagacgctcgaatta

SEQ ID NO: 575179 - DNA, 150 bp, Homo sapiens
ctagggaatctgtgctggtgtgggatcgtgctggtgcttgaaatcattttcactcattgtcgtggctttagatgaagaattactcttctggaaggaggtttcttcatctaaagccacgacaatgagtgaaaatgatttcaagcaccagga

SEQ ID NO: 575180 - DNA, 164 bp, Homo sapiens
ccctgttagagaagagacgagatgtacaagagaagagacagatgcttatgttgtttatgcggggaaacgctcatatcgggggcaccgattattaggggaactagtcagttgcccactgcctccgcaatgtgattgggtattactcctgaatgaagattattaca

SEQ ID NO: 575181 - DNA, 255 bp, Homo sapiens
gattccactggtagatatcagatgacattaactgtgagggtattatcacaatgggtcatgtaaccattggaaagttagtaacctagaactgtaaagggaactctttcggggaaggtgtttctaaagaaaaaaaaaaaaaatctacattgggcccatgttgaccttttcacttccggttaattaattcagtcctcagtcatctcactagctttcaatgctcccaaacggtccccacccctccctgtgcccttttcc

SEQ ID NO: 575182 - DNA, 1133 bp, Homo sapiens
aatgtacattggcctgggtgcggtggctcacgcctgtaatcccagcactttgggagtgccgaggcggtgcggatcatgaggtcaggagattgagaccatctcctggctaacacggtgaaaccccgtctctactaaaaagtacaaaaaaagaaaaaaatttagccaggtcgttggtggcgggttgcctgttagttcccagcctacttcaggaggtcttgaggcaggaggaaatggcattgaaccttgggaggcagagctttgcagttgagcccagaatcgcgccacgtgcactccagccgtgggcaacagaccgagacatccgctctcgaaagaaaaacaaaggagagagaagtggtacattaagggaaccaattggttcccccaaaggaagagccaggccaatgtgcctctggggaaagccttcctaataagagatgtgaactctcctgtgcgtgtggaggggtgtgaaaacaccagagcgcgaaatttccccaatttgcacgcccggtggtctccccagtggggtatacccgtgaacaggagattgtgcccactccgaccctgtggtgatctcggggggaagtggggaactcgcgggctgcgacacccattcaagcgcgtaagagccgcttgaaagcgaccaggcaagggggggacacacacaggggccgtgtaaacgcgacgcgataaactctgcgacagtcatgggggaacaacacccgcgggggagtggggtccacactccgaagacgagtggcacctgggcgagctttaggaagaccaccgcgcgggtgtcgggcgacgcgaaccattggggggatattaggggcacaccacagaagattgtgggcgcacccgtgtgagagcgacgagatggtggtgtgccactgttacgcaccacttgtgcagagaggaaattgcggccccctgcagcagcgcacacccgcgggggggggcacgcttttgcaccacatgtccggtgtgtaacccccagatttaacactaacgccatttaactaaatgatccaccactcgttgctgcggaaaacactgggtgtggacaaaaacgatgtgcaaacacagcgcttcacggaagataggagggataccaaggcgtgtggggcaacgttaac

SEQ ID NO: 575183 - DNA, 919 bp, Homo sapiens
  misc_feature (5)..(5): n is a, c, g, or t
  misc_feature (13)..(13): n is a, c, g, or t
  misc_feature (15)..(15): n is a, c, g, or t
  misc_feature (17)..(17): n is a, c, g, or t
  misc_feature (23)..(23): n is a, c, g, or t
  misc_feature (39)..(39): n is a, c, g, or t
  misc_feature (42)..(42): n is a, c, g, or t
  misc_feature (47)..(47): n is a, c, g, or t
  misc_feature (65)..(65): n is a, c, g, or t
  misc_feature (69)..(70): n is a, c, g, or t
  misc_feature (78)..(78): n is a, c, g, or t
  misc_feature (83)..(83): n is a, c, g, or t
  misc_feature (92)..(92): n is a, c, g, or t
  misc_feature (102)..(102): n is a, c, g, or t
  misc_feature (108)..(108): n is a, c, g, or t
  misc_feature (118)..(118): n is a, c, g, or t
  misc_feature (123)..(123): n is a, c, g, or t
  misc_feature (128)..(128): n is a, c, g, or t
  misc_feature (158)..(158): n is a, c, g, or t
  misc_feature (161)..(161): n is a, c, g, or t
  misc_feature (164)..(165): n is a, c, g, or t
  misc_feature (167)..(168): n is a, c, g, or t
  misc_feature (173)..(173): n is a, c, g, or t
  misc_feature (197)..(197): n is a, c, g, or t
  misc_feature (199)..(199): n is a, c, g, or t
  misc_feature (206)..(206): n is a, c, g, or t
  misc_feature (209)..(209): n is a, c, g, or t
  misc_feature (212)..(213): n is a, c, g, or t
  misc_feature (221)..(221): n is a, c, g, or t
  misc_feature (238)..(238): n is a, c, g, or t
  misc_feature (241)..(241): n is a, c, g, or t
  misc_feature (257)..(257): n is a, c, g, or t
  misc_feature (265)..(265): n is a, c, g, or t
  misc_feature (287)..(288): n is a, c, g, or t
  misc_feature (290)..(290): n is a, c, g, or t
  misc_feature (301)..(301): n is a, c, g, or t
  misc_feature (304)..(304): n is a, c, g, or t
  misc_feature (306)..(307): n is a, c, g, or t
  misc_feature (318)..(318): n is a, c, g, or t
  misc_feature (337)..(338): n is a, c, g, or t
  misc_feature (344)..(344): n is a, c, g, or t
  misc_feature (353)..(353): n is a, c, g, or t
  misc_feature (362)..(362): n is a, c, g, or t
  misc_feature (393)..(393): n is a, c, g, or t
  misc_feature (400)..(401): n is a, c, g, or t
  misc_feature (407)..(407): n is a, c, g, or t
  misc_feature (425)..(425): n is a, c, g, or t
  misc_feature (428)..(428): n is a, c, g, or t
  misc_feature (430)..(430): n is a, c, g, or t
  misc_feature (437)..(437): n is a, c, g, or t
  misc_feature (441)..(441): n is a, c, g, or t
  misc_feature (912)..(912): n is a, c, g, or t
cgcancccgcagngnantttggnggcgccagagcggagnaangcacncgagtttgtgtttgaggncaanntgaggatnggganagctgttcntttgggctgnagaaantccgctgagnagaanttgcngccagaatgctcctcctgttgctgagtatnatngtnntnnaagtngcggtgctggtgctgctgttcgtntncaagatngtnagnnaatggatngtgggcaatggaaaagnaantgatctctggcagaantgtagcanctcttcctcaggaaatgtccannantgtttctcatnatnannaaaagaatggntgcagtctgtccaggccannatgatnctgtcgatnatcttcagnattctgtctctgttcctgttcttctgccaantcttcannctcaanaaggggggcaggttttanatnantggaatnttcnaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgcttttatgttgaccatcagcctcgtgttgagccttaaagaagtagctaaggaactttacatcctaanagtataa

SEQ ID NO: 575184 - DNA, 217 bp, Homo sapiens
  misc_feature (127)..(127): n is a, c, g, or t
ggggaacccctttgggttttgggccccaatttttccttttggtggaaaaggggggggaggttttggcccccccaggggcaaaatttcctagggggggtacccctttgggggtttgtccatttatccngttgttttaacccttggccccagggttggccccgcccaaattttttcctgtttttaaaagtttttataaacccccccttttcgggcccca

SEQ ID NO: 575185 - DNA, 294 bp, Homo sapiens
gtgaatgcagctgaaagacagaggtggctggtcgctctcgggagctccaaagcatgttttgactgatacaagggacttaaaaaaggaaaaaggaattaggtgaaaccagtgaatcgttgaaaaccaaaatgtctgaacttcgcctctactgtgacctctaaatgcagcaggttcatacaatacaggaatttgttcacatgatgagatcattcatctctagtgcagagtctttgtgtaatttttcagacatgaatgagctctctctcttggtgcacgtgtacacatcatcacacg

SEQ ID NO: 575186 - DNA, 505 bp, Homo sapiens
ctaggttgaagcgagtactgttctgctggctgtgggggggacccgggtatgagccccggagcctgctgaggtgctgctgtgctgtgctgctgtgctgtgctgctgtgctgtgatgctgatgctgctgctgtgctgctgctgctgctgctgctgctgctcagtcttgtgtcccggcgtctggctcagactgactcatgttgggcagcagagtggaataggcctccagctgggagctgctgtgatggagtggtggctgctgcggtcgagtgcactgaactggtgacggggttggcggttggggggatcagctgtgatgggatgaagctggcataggtaccagtgtattgggaggaccaatgaagtggaagggtgtgcgtcaggtgagcgtactggactgggtacaccggtggtccctggctgcggggagtgcgtacgcgggaggcaagggtggttgccacggggacagaccttgggacgctgggcgaggagtagtccagccttgtga

SEQ ID NO: 575187 - DNA, 1041 bp, Homo sapiens
actcccgctctcgttttccctccttcgccgactccgtctgcctgccgtctctctctacacagtccgtgtcgcatcctcggggctgctctcggcgcccgtgcttggcgctcggctgctgccgcgcggctgtcgagccggtcccgcctcgtgcgcctgtcggtcctccacgcccgccacctctgtcctagcgaggcttcgctcgtgcgggctccctctctctgcttttctccgcctgtgctcttccgccattccgcggtcttgccgtctctgcggcgcctgtcttccccgtcttggccgtctcgtgctgctgggtccgcctctgccctccccgccttggcgcctgtcccgctcgtgcgcggccactgccctcccccccgccggtgctcctctgccctcgggctgccgcccccggcgtcgccgtccgcgcgcgcttccggactcggtactcgccgctccgccgcggttgtctggtcgcgcggcgctcgcgccctccggctggcggagggaactcggcgcggtgtgacgcggcgtcgcctctcctctccttccgcggccgcttcatgctcgcttctctttctcggccgcgtgctcgctgtccggccctcccggcgtggcgcgcgtcgcccggtttcgctcctcgtcttcgcgttctcccctcgccctcctgccgtcccttccctctggttccgctcgcttgctctgctctctgtcctgtctgtgcgcctggtctgctcagcattgccctttgtggccgctgtcctcccgctcgcgtggcggctcgcttgtggggcgccgtgctcgtcttggctccgctccgcgggcgccttctgtcgcctgccccgtctgttcttccctcgtcccgtctgcccacttctttgttttttcttctggtgcctgtctggtgcttatcgcgctgagcgagtcccgacgagttcagatttaatgaatcttcctaagttgaagtaattaaattctttgaactgaaaagaccaataaaaaaaaaaattaataaagatagtactaaatttagatataatataa

SEQ ID NO: 575188 - DNA, 492 bp, Homo sapiens
  misc_feature (339)..(339): n is a, c, g, or t
  misc_feature (410)..(411): n is a, c, g, or t
  misc_feature (447)..(447): n is a, c, g, or t
  misc_feature (482)..(482): n is a, c, g, or t
  misc_feature (487)..(487): n is a, c, g, or t
ctttcccagggtcacgtcattaggttcaaggtcacagagctagtaaatatgtattgagccaggattagaattcagctctgtctggcattacagcctgagcttttaaccagtatgatcttttttaaaggtttcttaccaagaggttgtgttatttgttttgaaagatgaaataaccccatggtttttttttcttctttcttttatttttttattttgacatggggtctcactgtgttgcccagcttggagtgtagtggcacgatcttggttcactgcagcctccgactcctggggttcaagcaatccacccatctcagcctcccgagtaactggggactnacaggtgtggcaccaccatacttcagcagattttttatatttttggtagagacagggttgtgccatgttgnntcaggctggtcttgaactcccgagctcaagcaattntccacctcagcctcccaaagctggggatacaggtntgagncacca

SEQ ID NO: 575189 - DNA, 288 bp, Homo sapiens
agtcaatcactgggacttattcatcagaggcgggcagttgatgatgcggagtgtgaaccagacccagctacgcgaaatcttagcatacgcctcaattacccacataggatgaataatagcagtgctaccgtacaaccctgagataaccattcttaatggaactatttatattatccgaactactaccgcatgcctactactcaacttaaactccagcaccacgaccctactactatctctacctagaaaaagaggaccatccctcattaccaccattccttgttaatt

SEQ ID NO: 575190 - DNA, 241 bp, Homo sapiens
aggctccagtcttaacgatatttggaggtcagcacggtgctcacgtgtcgacggaactatgtacatgggaggcatgcaccggcagtggtgaatacacagtcgacctggctgcatgtatgcgtgattgggaggtgagctacggtgctcatgtatacgagcggaacttgtccagggaggcatgcaccggcagtggtgaatacacgtcgaccatggaggcatgcatgcatgctcgggtactgga

SEQ ID NO: 575191 - DNA, 429 bp, Homo sapiens
ctttcccagggtcacgtcattaggttcaaggtcacagagctagtaaatatgtattgagccaggattagaattcagctctgtctggcattacagcctgagcttttaaccagtatgatcttttttaaaggtttcttaccaagaggttgtgttatttgttttgaaagatgaaataaccccatggtttttttttcttctttcttttatttttttattttgacatggggtctcactgtgttgcccagcttggagtgtagtggcacgatcttggttcactgcagcctccgactcctggggttcaagcaatccacccatctcagcctcccagctgctcaggaggatcacttgagcccaggtgttcgaggctgcagtgatctgtgatggtgccactgtcctccatcctggttgccagagtgagaccctgtctcccaa

SEQ ID NO: 575192 - DNA, 287 bp, Homo sapiens
cgacttctagaggatccacacagttgaccaacagaactgggtctgcgttgcttaaccagcttgccacccttcaggcctgtgggccccagaagctcagggcacccattgtcttaaggaaccattgggaggacagtctgagagcaggaacttcaagctgtgattctatctcggctcagactttgggtgggaaaaagatcttcatggccccaaatcccaggaaacctgccttagaccctggtgtgagcaggccaccaggttcctcttgtcaagtccagacttgcttgatt

SEQ ID NO: 575193 - DNA, 139 bp, Homo sapiens
  misc_feature (6)..(6): n is a, c, g, or t
gattanaactgtgcagaggacagtggtgagaagggggttggtcccccactttccataaactataaacagaaacatgaacacagagaatcacaaataagaggtgtctttcctcaatgtctccatctcaccccgattcttc

SEQ ID NO: 575194 - DNA, 252 bp, Homo sapiens
tacagcaggtagactctactattcaggtaagtgaaagaggtcacaaacattataggttgtgtggagcagtaaaaatgcatcacagcaattctaagcacaacaagttttctgtaaggccttctctgaaaaaagagaaggaattacttattaaaactaagcacacttagcaacttctttcccaatcgctatctttattcgttagccgggatgccacaattatgctggaccctttttaaatatgcaaagccttac

SEQ ID NO: 575195 - DNA, 246 bp, Homo sapiens
cttagctattacggtttccttcatgggagagccctcatctctatacagatatgattcagctgggatatacattggtccctttatttgctggcaaatggtttccttaccatccgttatttgaccaacatctcctttctggttcttaaaatatatcactcttagaacttgtcccctttcttctctgattgaatgcataatatcctttaacagtggtatatatgctctcaaggaattttaaatctcttc

SEQ ID NO: 575196 - DNA, 211 bp, Homo sapiens
tgtctagcggatcccgttggtcgatcactgtactccagcgtgggcacggagcagactgtctcacaaaagcacaaaagcaaaaaaaaaaaaaaaaaaggggggtcttcctccagattctttcggttaaaaaaaaccctgcattttttttaaggttgaaaaaaaaaccggggccaggcattccggtgttcgcccaggggttccggacctcaat

SEQ ID NO: 575197 - DNA, 112 bp, Homo sapiens
ctaccttcatgcttggcactaaccccagatgaatccatcttccaccatgcagccaaaaaggccttcaaactctactcccactaatagctttttgatgacttctagcaagcct

SEQ ID NO: 575198 - DNA, 154 bp, Homo sapiens
cacgaggtttatctaaaagtgcacatgtgggcttaacgctgccaaacagcacgcatatctacatcaacaagggcttctattccatctacaacttggatcgggggaaaagggacatgtaggagaggaaggaaatcacaggggaaaaatataccat

SEQ ID NO: 575199 - DNA, 575 bp, Homo sapiens
tcaggttttagtagcctgaagcaacaaaggtgtgtgttcattggggattcacagttcattggccaggaggaaccacacggctgcaaccacaagaggccaggaagtgccccacactccccgagggaggagaactggaagtctcggttgagcagcacgagggatgccacaccagcacgtagccaggcagcttgtgctgtgaaccggccacctttgctgcccaggctttccctcgattttcctcctgggcttccctatctgcagtaggagagggtgggctgtgtgacacttcacctccctctaggcctctgctccaggaggtggtggagtggacggggcaggtgctcggggagtcagaccagggagaatgtggcctctgctctctcagcaccttcgggcgtggcgtttggcatctcaggatctttttgtaaattaaactattgtgaccattgtaaattcacatacagttgtgagaaataatacacagatcctgtgcactcttcacccagttttccccgtggtagctttgtgcagaacgaggacagtagcacagccagcggattggccgacgcggccgc

SEQ ID NO: 575200 - DNA, 121 bp, Homo sapiens
gcaggatccctagacagccggaccccaccaccgggtatgcaggcggcggggggcgtgggcctcccctcacatgctgcaaggaccctccacttgacttcacgcaaggcggcagcttgctgca

SEQ ID NO: 575201 - DNA, 620 bp, Homo sapiens
  misc_feature (311)..(311): n is a, c, g, or t
  misc_feature (324)..(324): n is a, c, g, or t
  misc_feature (327)..(327): n is a, c, g, or t
  misc_feature (368)..(368): n is a, c, g, or t
  misc_feature (420)..(420): n is a, c, g, or t
  misc_feature (424)..(424): n is a, c, g, or t
  misc_feature (445)..(445): n is a, c, g, or t
  misc_feature (545)..(545): n is a, c, g, or t
  misc_feature (590)..(590): n is a, c, g, or t
tcccccgaacctgtcgaggctagagctttggggagagaaggggaaagacagatgggacagaaaagaactgagagaggcaggcgatcctcccacctctgcctcccaagtagctatgactacagccacatgccaccacaccaggctaatttttgtagagacacggtttcgccatgttgcccaggctggtctcaaactcctgagctcaagggatccaccctccttggtttcccaaagtgcagggactacaggcttgagccaccatgcccggcctgtatagacactttctatcccacttttaaaacaggcatgtnctccctatgcttnaanatgcctttaaaatatttctaatggtgctaattctctaattngggagtgtctaatttgcttccagtttttaaaaactattttttattatagtanttanccttttaaatacatgaatctngggcatatttttaatgatttccttaggagagattccttacagtgaatttcttgagtaaaaggaggttaactgtaagattcttgatataccttgctaaatngtcttctagaaagcttgaaccaagttctgcacattttagcaaagnatgaaatgtccttctctccatatcttcatc

SEQ ID NO: 575202 - DNA, 839 bp, Homo sapiens
tgtagaagcgccgtgttgtggcgtcgagagtggttcgccgcaattggttgatatcccccaggtcgagattcgctaaggcgccaacatttgaagggttgggaattttgataacccccgagaaccccccaggcgtatcccgccgaaagagttgtgttaggccagtacttcctctttccgagttgtacccgcaccctctaatggaatgggagtatagtagccccggttttttatgcccgggaacaatgtccccgtttataaggtggcgccactttttgtagaatgtttaagccaatgttgaaatgagttaatgccgtgaacgcgtaagttttgccgcacaaatttcgctagctatagtcacaactgtaaaacttccagggcacccacgcgagcccgtatactaactattttttcgacaccgcgtgaaaacacacagggtaaaacaatgagctataccacccccgttaaagttcccactccacccgctccgtttccctatggagggcctgcccccgcgtaaaccggctgtttgtgcccacaaatggggccacttaatcgaaagaaattcacccacaaaacacaatatgcgctctattctatatccccaccccacatcaataagcgcacaccatcaccctccttaacctctaactttctacctacgcctaatttactccaccctcatatcaccacctacttccccacatatttaacacaacgtgataaaataaaatgagcacgtttgagaacaataccacaaaacccaccccattcctccccacactcatcgcccttaccacggtactcctacctatttccccttttatactaataatcttata

SEQ ID NO: 575203 - DNA, 933 bp, Homo sapiens
  misc_feature (271)..(271): n is a, c, g, or t
ggctggtactggtcctgggaggtttgggatctcagaatgtggcaaaggcgacgcctgctgtggcaggcgcttttggaaaagtaacactgcgtctatcctttatttttttttatgccatgatgtgtgttacaatagaaaagtggtcacttccacaaaagtgcccttataaaggtgaccaccgaaatgggctaaggtgcattatggtattcatccataaatcagcaattttctttcacagaacagtgcacttcgagacatttaaacaggtcanaaaagtgcacccgtgtataggcatgggggcgaactacacacgatttatcagcttaagagggtctcaaagcattattaactcggcatcacgttgatgccttgcaaagctgtgttatacaagcaacccgtggcgttacaaatacagtgggtatacgagcgcctttcttgccaccaacacaaaaaccaacaggtagaggggaccacatatcacacgcgaacgcggatcaagacacgctcaagaataccagacaacgaaacatcaccgttgcgggaatatcacacagttggcccccaaagcgagcacccaagagacaaacatacaatgagggacaaaagcatcacatcaacatccacgcacagagagacagacaagacgagcagcgggcgtgaagggaagaaaaacacaaccgacaagagaccacacaaagaaggggcacaccacgggaaaacaagatagacacggagacaccagaagaagaaacaacacaaagagggaaaccccaccagtagtgccaccaccagacaagcgacagacaccatcaccccaaggatcacaccagtacaaacaaaagaccacaaccagcacccgaacaacaaatggagcagacgacacaccgaacggaaacaacacagcgaaagagaacagaggagagaagaaccaac

SEQ ID NO: 575204 - DNA, 911 bp, Homo sapiens
gcccatgcagcaggccaaggctgtgctcaagcatttcaacgtgcgtgtcacccacgcagacatcttcagccgctgccaggcctgtaactgtgaccagtacctaaaggtctccaggacatgatgaagcagctcatgtggctcagcagtcaccaggaggggcccaggagctcaggtgacgaggccacccagagccaggcggtgcaggagccaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccgactgctgggcccatggccgtgaaagcatacctgataccgaaccaaccatggagcgtgggacttcatatgtgaggccagtacttcatctacggaatcttcctgaacaaccgtgggtggtctgccgcagggagtaccctgttgggggaccaggtcaattgcagaacgactcatcactggttagaacagcagaaggaactgctcttcagtgggactttaattgcattgaaaagtgggctgcacattgatacattcataactaacgctggtgtgagcaactacgcacctgggacaggcacatagagacagacacacaacttggagggggggcagacaaagctgggatacgtccagag

SEQ ID NO: 575205 - DNA, 804 bp, Homo sapiens
ccccgctggctgccaagccccatccctaggacagtcccggaccagctctcttccttgactgacaggtgacgaggccacccagagccaggcggtgcaggagccaggcccagccccagacgcagcccctgagggctgcacctatgaccgcccctgccgctggctgcagatggctgacctgcgggcggagacaccggacatgctggccgacggcacccggctgcagctggcaggggtcccggtgggtgtgctgaggacacctgggctgcggtgcttctactgctgcacgggctgtggaaaggtcttctgggacggctcccacctgggtcgtgttgccacccacttccgagacatgctggagagcgcccccagcccctgcgagccgagcccagcccccagcccggccagcagtcccttctgaggacagccagacaataaacatggaaagtgcccgactgctgggcccatggccgtgaaagcatacctgataccgaaccaaccatggagcgtgggacttcatatgtgaggccagtacttcatctacggaatcttcctgaacaaccgtgggtggtctgccgcagggagtaccctgttgggggaccaggtcaattgcagaacgactcatcactggttagaacagcagaaggaactgctcttcagtgggactttaattgcattgaaaagtgggctgcacattgatacattcataactaacgctggtgtgagcaactacgcacctgggacaggcacatagagacagacacacaacttggagggggggcagacaaagctgggatacgtccagag

SEQ ID NO: 575206 - DNA, 313 bp, Homo sapiens
gtatccccctggcaacccacgcatggcgtagggtggtcggggattcattgaattgtggttggcaggagcaagccctgcgtcacactctcacactcgcaccccgaattgtcaaacgatacagattgtaaaaatctaccatccctcagtctcactcactatatataaaatcacatgtcccctacgaacccagagtcagactacatgctgtagcatttggcagggacagtcataaaggagacaatgtaaaacggtcagatcgactcaggccgtgtagattagactgagggtagagtgaccatcgggaccctgtctg

SEQ ID NO: 575207 - DNA, 172 bp, Homo sapiens
gacggggacgtgacgagacacacacaggacgggtctgacgacttactcactccgctgagggtggagctgactgctctgttctacggactctccctcttctcggtacttttcttcctcgggttttaaactggatacacagaactgttagacatcagggtgtggtctccctcca

SEQ ID NO: 575208 - DNA, 121 bp, Homo sapiens
cacatttagtatggaaggacatgggatcaggtgcatcaaagccaaatggggaaaaaatcaaggatttaatacaagggcaaatttcaaacagggcacaaagggctaaagtggctctctctac

SEQ ID NO: 575209 - DNA, 265 bp, Homo sapiens
aaaaacccccccccccccccccagggggggtttggccaaggggccccctttatatttttggccccccccccccgggggtccccgggggggggttttttttttccccgtttttttttttttaaagggggggggggcttccccccccggggggcctttttttccccccggggggcccccctttttggggggttttttcccctttttcccccccccggggggggggttttttttgggaccccccccattaggggggggggtcccccca

SEQ ID NO: 575210 - DNA, 111 bp, Homo sapiens
cggcattgcagatccacagtatggggtctggcctgaggagggcggtaacagagcatggattcaaaatcagagcagagctgggtgccgtggctcatgcctgtaatcccaaca

SEQ ID NO: 575211 - DNA, 313 bp, Homo sapiens
  misc_feature (238)..(238): n is a, c, g, or t
  misc_feature (252)..(252): n is a, c, g, or t
tcaaaaaattagctgggcgtggtggcaggcacctgtggtcccagctactcgggaggctgaggcaggagaatggcgtgaacccaggaggtggagctttcagtgagccgagattgcgccactgcactccagcctgggcgacagagcaagactccatctcaaaaaataaaataaaataaaataataataataataataataaggcttgtggtgtccttcaggctaccggagaaggtggttnctggtgggcgcgantgctcctgactgttcagaaagggagctgctcagtggttcacggctgtcatcccagcacttt

SEQ ID NO: 575212 - DNA, 652 bp, Homo sapiens
gttcagtgccattttatactttctctctgtgttctctgtattgtactaaccaacctcccaaatcgctgagctgcttgtttaaaaaaaaaaaaagggaaaagggaaaaagcaatgacatttgtgtatcgatttttggttgttgaccaaaatcacacacttggaaaccttgtaattcaacagagtggggaaagctagcagattctgggcttagtattactaataggcaggattggtacaatggagcaactatcagattattcctttcaggggttcttatgggcatccaaattactggaataacattattaatccattaatcagtggaatcaaatttatgattacaattatcaaattgaatggctcagcattaattggaaaactggtttggttgaaacatggtttacccagaaaagtagcattctataaatactattaaacaatttagctatattattttcaagtattacattatttgtcaagcagttaaagtgaatttcagagtaacaagtaaggcatgtttctgagcaacatggataatttcttaattggcaaatttcttctaatttgggtactgggaatatagtgtggagattttaatttctaaattgggggtatcttctattacataaatgctttgacaattataaaatgg

SEQ ID NO: 575213 - DNA, 342 bp, Homo sapiens
ttatttatttattttgaaacagggtctcactttgtcacccaggctggcgtgcagtagagcaatcacagctcactgcagctgcaacctccctaggctcaggtgatcctcccacctcagcctcccatgtagctgggaccataggtgcatgaccccatgtctggctaattttgtatttttttttagagatggggtttcatcatgttgcccaggctggtcttgaaactcctgggctcaagcagtcagcccacctcagcctcccgaagtgctggcattgtaggcgttacgacgtgtgccccgccacattctctatcaaggctttatttaattgcttttttttcttct

SEQ ID NO: 575214 - DNA, 701 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (44)..(44): n is a, c, g, or t
  misc_feature (46)..(47): n is a, c, g, or t
  misc_feature (50)..(51): n is a, c, g, or t
  misc_feature (53)..(56): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (67)..(67): n is a, c, g, or t
  misc_feature (71)..(72): n is a, c, g, or t
  misc_feature (74)..(74): n is a, c, g, or t
  misc_feature (77)..(77): n is a, c, g, or t
  misc_feature (80)..(80): n is a, c, g, or t
  misc_feature (82)..(82): n is a, c, g, or t
  misc_feature (91)..(92): n is a, c, g, or t
  misc_feature (96)..(96): n is a, c, g, or t
  misc_feature (234)..(234): n is a, c, g, or t
  misc_feature (240)..(240): n is a, c, g, or t
  misc_feature (281)..(281): n is a, c, g, or t
  misc_feature (320)..(320): n is a, c, g, or t
  misc_feature (332)..(332): n is a, c, g, or t
  misc_feature (410)..(411): n is a, c, g, or t
  misc_feature (462)..(464): n is a, c, g, or t
  misc_feature (488)..(488): n is a, c, g, or t
  misc_feature (504)..(505): n is a, c, g, or t
  misc_feature (521)..(528): n is a, c, g, or t
  misc_feature (537)..(537): n is a, c, g, or t
  misc_feature (539)..(540): n is a, c, g, or t
  misc_feature (549)..(549): n is a, c, g, or t
  misc_feature (551)..(551): n is a, c, g, or t
  misc_feature (560)..(560): n is a, c, g, or t
  misc_feature (569)..(569): n is a, c, g, or t
  misc_feature (591)..(591): n is a, c, g, or t
  misc_feature (596)..(596): n is a, c, g, or t
  misc_feature (600)..(600): n is a, c, g, or t
  misc_feature (604)..(604): n is a, c, g, or t
  misc_feature (611)..(614): n is a, c, g, or t
  misc_feature (618)..(618): n is a, c, g, or t
  misc_feature (626)..(627): n is a, c, g, or t
  misc_feature (659)..(659): n is a, c, g, or t
  misc_feature (683)..(683): n is a, c, g, or t
  misc_feature (701)..(701): n is a, c, g, or t
ccgccctctcgtgacagctcagcccctcnnatgnanatttggangnngtnntnnnntananttnaanaaanntnacntantntgaaaaaannaaanaaaaagcaaacaacaacagcaaaaaaaaaagaagaagaaaaacaaggaaacaacaagaaagaagcagcaaaaaacaaagcacagcaaaagcaaagacaaagaaagacaaggaaaaacaaacaagcagcaggagacgcngagcgnagaaaagacccccgggagcccagcccacaccaaaagcccancgccgaaacaaacagccagcaaaagaaacccaaagcggnaaggaacacccnaaaagggaagaaaaaggaaaaccccagggggcgcagaagcaaaaagccagcaaacccagaacggcgcaagccaccaannggacccgagagatggggagagtgtcgtccaacgtgtcgtgtgtgtcaaacnnngtaaagtgtgtagtagtgtagtcnggtgtgtcaacaagtnnttagtatcccgtcagnnnnnnnntgtattaantnntgtaaagtntngtggagttngtcagtttnaagtaagtttttgtaagttaangtccntctnaaancgttgtnnnnaaangttgtggnnaaatgtttatgtcgtattcttataagttgttnttctaattcttattgttctccgtngtttttgttttagttgtn

SEQ ID NO: 575215 - DNA, 316 bp, Homo sapiens
gcgggggtttcaccaagacttacactgttggctgtgaggaaggcacagtgtttccctgttaatccatccccggcaaaaagaagaggggcactcattggttggggaggggccagttcctccaaggttatgaaaagggcttccagtcccgtccccttgcctgcctgcctgggaagccagggttgtgcacctgccagtccctggggtcccagaaagcatgaatcctgcccggagtggaagtttaagcctgcacagtgtcccccttgttcccactcccattttttttccggacaacgaaataaagggttcccccccagca

SEQ ID NO: 575216 - DNA, 1260 bp, Homo sapiens
  misc_feature (125)..(125): n is a, c, g, or t
  misc_feature (435)..(435): n is a, c, g, or t
  misc_feature (539)..(539): n is a, c, g, or t
  misc_feature (562)..(562): n is a, c, g, or t
  misc_feature (632)..(632): n is a, c, g, or t
  misc_feature (748)..(748): n is a, c, g, or t
  misc_feature (761)..(761): n is a, c, g, or t
  misc_feature (767)..(767): n is a, c, g, or t
  misc_feature (784)..(784): n is a, c, g, or t
  misc_feature (788)..(788): n is a, c, g, or t
aggagctctccagcctcggctcctgggcagagggcccggaaaccctcggaccagagtgtgtggaggaggcatctgtgtggtggccctggcactgcagagactggtccgggctgtcaggaggcggnagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggttttttttttggtttttttttttttggtttgtgggaacgtgccccagaattgaggcagtgggcaaacttctcaggacaatgaatctccttccngttttccttttaattgccacacagggcttggtttttcataccggctggtcttaattttagaataattttagaaaaccaaaacaagaggcggttttccctaattngggctatgaaccccccttgtgtnccaatatgaagacggctatcacgaagcagttccaaagaggaaaagctggggcggtgcccagcgtgcccgntgcccatcgacgtctgtccgggggacgtggagggtggcagcgtccccgcctgcaccagtgccgtcctgctgatgtggtaggctagcaatatttgggttaaactcatgttggtgacngtacccattggtntgaatnttttaaagaaataaaantccnggaaaaaaaaaaaaacacaacaaagaacacacacacaacaacacacaccaaaaaacaacaacaaaaaaaaaggggggggccccaccaataaaatcccccgggggggcacaataaaccacccactttttgtaaaagggggccccaaagggagcgatctaaaactcagcgagccgggcggcggacacaccacacctgcggggcagaacatcagtgccgcgattctgggacaggcccaaccgtggcggggaggactggaggcccacctcagaaaataacgccccagggaacaacactctagtgtagcgcggaccccactattttctcggcgggagatggccgcggatgataaaataaggacgcgagatcaaagcgactcacaccacaccatgcatgagtccaacacaagcacatcgaacacaagcctcacgacaaatccacacacgtaccacatctcgcactagacgacgaacga

SEQ ID NO: 575217 - DNA, 336 bp, Homo sapiens
gagagtggtgaatcagatgatatgactagagagaagatagtagggatgacaagtttgggggatagcaccaggagatatcagcggtgatggctgggagaggaagtgtaaactggcagtgtaaacaaaagtagagcatctatgagtagttgagaatggtgaatcagagtatgactagacagaagatagtagggatgacaagtttggggggcacagtcaaagtagtgggggtgactgcgtagagccctgctgtaaaaagtagtagggtaaggatgaatagacctaatagaataaaggaatgtattaggctcatatgggttattactactcgggaaagtg

SEQ ID NO: 575218 - DNA, 695 bp, Homo sapiens
  misc_feature (125)..(125): n is a, c, g, or t
  misc_feature (435)..(435): n is a, c, g, or t
aggagctctccagcctcggctcctgggcagagggcccggaaaccctcggaccagagtgtgtggaggaggcatctgtgtggtggccctggcactgcagagactggtccgggctgtcaggaggcggnagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggttttttttttggtttttttttttttggtttgtgggaacgtgccccagaattgaggcagtgggcaaacttctcaggacaatgaatctccttccngttttccttttaattgccacacagggcttggtttttcataccggctggtcttaattttagaatacttcacattaaccaccccaggtttttattccctaattgtgcaattaacctcttttgtttcaattcagactgtattcttaacccgctcacgccgttcgcccgtgctcatcgcgcctctttctactcacgtctggctctgcccccacttgtccgacgttttcaccatttcttcatattttctctttttgtgtctcccc

SEQ ID NO: 575219 - DNA, 107 bp, Homo sapiens
gcgagccgcttgttccaatgccgctggacctctacatcccgccggatgcgctggaggtcttcctggaagccttccagggcccgctggacctgctgctctacctgatc

SEQ ID NO: 575220 - DNA, 270 bp, Homo sapiens
accctaggcgcacttctccacaattggggaggcgatagagagtgctaccctcacacatgatattcatgcattattcagagccacacctgaatattgtgtgcacgtactctgagaggtatctagactgctccaggactctctaaggattacatggccggcttgagtcacctaccacaatctggaggccttcatctctgataagagaagactatggcctacaggctgtggaagcaggtgttcacttcggggccccagaagtgcgcctgggtt

SEQ ID NO: 575221 - DNA, 529 bp, Homo sapiens
gatcggcgctgagacagggatacggcaacttgacttcgacgggtcgtcaccttgcatagacgccaaatcggtctcagttcggaagtacggtagtagccgctctgttacttgaagcttagttcccctccttctctgatagtgtagcctttcgacagtaaggtcgctgtacagtagtagcagaagacctgacagtatagtctctaaggcccatataggaggagttagtagcaggctggcccttggaccttgatgttatcttgggtgtgtccttttgcaacatacctgtggtggagacaacataggaacagtctttgtagttggtttaagcttttgccatccaagggttgtcagaatcctttagcagagcactcttgagcctgcaatcaaattagtcacatctgcgactggcatcctttgtagcaggctcataagcatggacacttagatcaatgttaataattagtgccttcagcagtagcatatgcaaccggcattgtctctctggatggctgctgtttgtttcgagcac

SEQ ID NO: 575222 - DNA, 338 bp, Homo sapiens
agcgcaaggctccgtctcaataattaaaaaaaaaaaaaaaaaaaaaggccgggcgcagtggctcaagcctgtagtcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctggggtacgagaatcgcttgaacctgggaggcagaggatgcagtgagccgagatcacgccattgcactccagcctgggggacaagagtgaatctgtgtctcaccaaaaaa

SEQ ID NO: 575223 - DNA, 101 bp, Homo sapiens
cacctggttttccagtgagactccagggttttaaacaaaggccagttttggcccctcccccccccccccgggggccccaataaagggttggatagctccca

SEQ ID NO: 575224 - DNA, 325 bp, Homo sapiens
aaatccatttggaatcaaaaaacggtggattttggcaaaaggtccctgggcccccccccctcatccctggtttggtcccctgttgcctatagcccttttcccttagccccccccccacagaatgggggccagcccccttgcctgcctgtgtttttcccccaacccccttagatggggagggaaaaggaggaaaggggagggggcctgccccctcctcagggatttgggagggccctgcccccctgggcttttcccttccctggggggtttttcccccacccctttgtttaaatccaacctgaataaaaattccagttttatatta

SEQ ID NO: 575225 - DNA, 182 bp, Homo sapiens
ccccacagagagctctgcacgtcaccaagtaaccaggccccagcctccaggcccccaactccgcccagcctctccccgctctgggggggtgcattctaacactcgactctgccgctcatgggaagacagaattgctcctgcatgcaactaattcaataaaactgtcttgttgggagcttggt

SEQ ID NO: 575226 - DNA, 483 bp, Homo sapiens
  misc_feature (56)..(56): n is a, c, g, or t
  misc_feature (202)..(202): n is a, c, g, or t
  misc_feature (299)..(299): n is a, c, g, or t
ggtcaccagtcttggcccagtacaggaaaaggaatccgctttgtggccacagatgngggctggggagaagcggacctcagatcctgcatctcttcacccgctggacacaggagggctatgaaccactgtgccgtggtgcaccactggctggagcagagccaggcctgggagaggcaggtggccccatcggcccctgctctgnaccacccctcccagatgacagagccatatgtcttccacgtgtctacacactcacagactcacgaatgtaatcgctcagtctcacaacaagcacacgnagtcacacacctgcccacaggcacatacgccacataagcatgcctgtatgctcacacagtcatactgccacacgctattacacattcacagccacagccacacatgccttgcaatccattcaaagcaccagtggctactttgtcagacacagccacaccacagtcctatgcacatccgtactgg

SEQ ID NO: 575227 - DNA, 225 bp, Homo sapiens
ttgcaggcgagctcttctccagcacggtcagccggggcctccagctgggagatggcctggctgcagctctggtaccacgccacgcagactcgggttctccacttccagacgggcaatccggacgacgagctcaccggggtctccgcgggtgccgcgggaggcccgggggcctgagcttccagccagggatttcgggatgttctctctggctctcgcaaggtcacg

SEQ ID NO: 575228 - DNA, 968 bp, Homo sapiens
  misc_feature (636)..(636): n is a, c, g, or t
ttgactgtgggatagaacagagtcccagatagtttgccggatgcatatgatgagtgtggcacgaacagatgtgaggggtccgacagaagagtatgtctttcaaagtacttaatagttgtcgctttggagtatgtgaacatacattgcttttgccggtggtgtggtgcaccggagatccggtgattggagaagaagggttattctcgaagatgagagtctaactttgtattggggattctaggtggagctgaagtgcattgaattccagtcgatgttcgtgtatcagatccgaataaggatgacgaggatcatgtggctcattgtgcaagtggtagacattctggctaaatattagttatgtagatactctaagattaatatgataacttgtgtaggcttttcagtcataagtaatcggactgatgtgagagtgaaaatgagtgaattaagccttgtgtgtgatgcagcggtacggatttggtgaaccatgtgcagttgtgtcaatagagtccgtttggaatagatagaagcaataggaacgatgccctagaatgcatttcgacgtttgtgacctgatatgacattcccggttaagatactctcgcgaatagagtcatattgtggtacacagtttcntttagttgatgtactagtgcttgtcaaggatcgtttgagtaggctctagtatgacgttgtatgcgatgagttattctgcaaggaattgaatatgacggggagtggataggaaacgaagctccaacttagtgtgattgatcaacccaggtggataaattatgtaccaaggttcttcttccagaaaaacatggggactttctggaatctattagttaggatggtattcaaatggtgaggttaaccagtttgaattaaatgggttcaacgtgtgggggtgaccgaatcttgcaaggctagattaaaaggcaatatgttctaaaaaaaacaaaaaa

SEQ ID NO: 575229 - DNA, 1306 bp, Homo sapiens
  misc_feature (1293)..(1293): n is a, c, g, or t
  misc_feature (1306)..(1306): n is a, c, g, or t
gcagtccctcggttgtccgatcgcggtgatcgttgctagctggagtgtacgatggtgcacgtggtcatgcgatgtatgcagtcgctcccagggctctggcattgtaccatcaagcttggaaggacatggatcaaggtggtgcatggtttcgtgcttgatcgttgcagaatcttagaagtggaggctgtagcatcttgaggagaggagagattcggaatagggctgcgatttacaggtaggatattaagtctcaagatgtatagaggccgtagtgcattcgtaggtggtctttggaatggcaaggatggattgaattggaatcggttgggagacagttcgtggaagtggacaacgaagatgttgtgttaattttgcgcttattatcatgtggatttaccatggggggaaaccccaatgaatcaatatgactagaggaaaagggcaatttgggactttgtacaaaggctctcattgaattgaaaaaagactggggggcacgaagtattacgagcttgaacaaggtgatagtacacctgcgcgcgagctcgtacttttggaagaagttgcgccgagtttaggtattcaacgcaaaaaacctttttattctcaagaagtgcgcatttgcgtattcaaaagtaaattacttcgggatagtttcaagggcaattagatcagttacgagttgattattggaggtataggctttctattggactatggttggagggttagattccctctgttgggtgagttgtagccattctcgacgggtgacgaattatctccaatagagtggagggactttgggaagtctagacggttttatggaaaacaatggggagtttccgttgggagatggagaaaggtgctttatagcgagtcgtggggtgcaacatgggaacaagccccctatataaggaagagggtacaccattttaccggtcgggaaacatttgcgcagcggttgcgtcacacaacacagtcggatatgggttgggtggtgtcccaaaaggaagcccgtcggttgggcttgcgggcgccaagaggatacacccttaggtgaacaatggggtccccacacagtcgctatttggtgtgcccccccagaggcgactctgttttgcaccacacatgcaataacacccaccggggcctcttttcgtgaaccacactcgtctttttacacaaccacactcctggaggacgggacactaaatacttataccaaccactacgacagacacacaggagacgagtccacacgcctcaaacactacactccgaactatgcgngccctccttacan

SEQ ID NO: 575230 - DNA, 118 bp, Homo sapiens
  misc_feature (23)..(23): n is a, c, g, or t
  misc_feature (57)..(57): n is a, c, g, or t
gaccgggccaggagcgcctggcntacagcctgcagaagctggaggaggccgagaagnggcttgactgagagcgagagaggaatgaaggtcatcgaaaaccgggccatgaaggatgagg

SEQ ID NO: 575231 - DNA, 302 bp, Homo sapiens
ggggggttgggggggcccccccaaccaaattctttcttgtttggaaattttttttggggggggggggcccccttttccccccctttggggggggggggttggggcccccccttttttttttccttgggggaattttggggtttttttttttttggggttttttttccctttccgcgcccccttcccggggggcccccccctttttttcccccccctttttttttttccccttggggggggggcccccaacttttttttttgcccccttttttttaaaaatttttttttgattttttggggga

SEQ ID NO: 575232 - DNA, 111 bp, Homo sapiens
aaacaccgcaatcttcactattctcacattccttaagagctttctcgcagattaaatgtgcataaccggggacaatgtttttttccccatcacgactcggggtaccgagct

SEQ ID NO: 575233 - DNA, 270 bp, Homo sapiens
tagtcacaggcgctcctagctctcctatctctcccagtcctagactgctggcagtcactatactagctatcagaccgcaacctcaacaccaccttcttctagcccgccggaggaggagaccccattgtataccaactcctattctgatattacggtccgcctgtaagataatattcttatcctaccaggcttcggaataatctcccatattgtaacttactactccggaaaaaaagaaccatttggatacataggtatggtccgagcgga

SEQ ID NO: 575234 - DNA, 790 bp, Homo sapiens
  misc_feature (280)..(280): n is a, c, g, or t
  misc_feature (343)..(343): n is a, c, g, or t
  misc_feature (435)..(435): n is a, c, g, or t
  misc_feature (503)..(503): n is a, c, g, or t
  misc_feature (704)..(704): n is a, c, g, or t
ggtgaaggaatgacttctcaccatctgggcctgagctggcaggactccagccactgctgtctccttagctgctcacatatggatactttcacagttcacgattccactgcaatgagctgtgtggaggaataatttctggatcatcttatctgtggcccatcatggcttgtctcgtgctggagtcgtgggacctcgagtccctgatacgtggtgtcatgatcaatcgtggcaagcgtctagcacagacgcgcgagagcacaatgcgcgcacagattgccgnaacgcctgcgttgaaacgaacaagccatagtcatgagtgcacaagcaagacacgcatccgtcntcgcaacgagagtgtctctgttaatgtcgacggtccgaccgagtatgcaatgttacccgttcttcctggtcacctgcggaggaacctcgggncttcctcctagaagcacgtcgttcccacagcatggtaagtccccaacgttcagcccgcccgagtacantaactcatctggctaaattaaagattaaaaatactaagaagactggtgttccattctccaagtcgtacaattgaggcctgaaggatgactatgacgatgttgaaattccgctgcagaagtacgtgaagaatagggagtcagttgtggaacacagcgcatttctgtcttttttggcaagaactggaagagggttcacacaangttatttgaaaacaatcaagaatggttgaacttcagtaggtctctgggccctgaaagccagtggtgattttatgaagctctataag

SEQ ID NO: 575235 - DNA, 351 bp, Homo sapiens
  misc_feature (15)..(15): n is a, c, g, or t
attcgcgggcgcgtngacttttttttttttgtagtagagacaggatttcaccatgttgaccaggctggtgttgaactcctgacctcaagtgagccaccaggcccagccttgcccagttattatataaacaaggtctcagtatgttacccaggctgatctcgaactcctgggctcaagccatcttcttgcctcagcctctcagagtcctgggtttacaggccactggacccagccaccttttgccattttaaagttggtttggttgggtcgttgagttgtacgagttctcttttatagattctgggtattaaccccctcggcagctatgggatttgcaaatactttcgttcg

SEQ ID NO: 575236 - DNA, 326 bp, Homo sapiens
  misc_feature (56)..(56): n is a, c, g, or t
  misc_feature (176)..(176): n is a, c, g, or t
taaaatcactagatcaattaagtttaggtgaaccacgtttattagaagttgataancgttgtgttactccttgtgatactaacattcgtttttgtattacatctgctgatgttattcatgcttgggcattaaactctttatctgtaaaattagatgctataagaggaattttaagnacatttagttacaggtttcctatagtgggagttttttatggtcaatgttcagagatttgtggagcaaatcatagttttataccaattgctttagaggtaacattattggataattttaaaagatgatgttttggtactatagaataattt

SEQ ID NO: 575237 - DNA, 636 bp, Homo sapiens
caatcacatttaaagcaaaatttcaaaaaagtgctaccctcgcatttgtgaagatatcacgacttagcaacccaccgtagaaggataaggtgttcaggagtggttctgattaaagccgcaggattgtcggagcgtggcatgtcctattacagacatcgtcagaggagataggcgctaagatgctcacagttctctgaagagtattgttgcttctcttcccaaccatcgctcatatactggctgtgtcagaaatgtggataggaactagaagacatgatgagaacaggatctacaaacaatgtttagctgcttgccatttactatgaagaaaatatatcataggccagcgcttaatgactgccatgtgatggaagacactgatgttagtatccgtgtagaatcaaagctgagtagagaagattcttctcaacatttctgcagactgctcaacagagtgatagttccttcctcagagatcacctatgggatggtcgtggcagacctgtgccactccttgtgggagtcagtgcagaaccttgtgtataacagattcagagcgcttgcgtgtcagatgaacaacatgtatccattagcaacaagattctccctcctggtattttatgctgacggttgtca

SEQ ID NO: 575238 - DNA, 188 bp, Homo sapiens
acttgcagcgacgcgagaagcctcggaagcgggcgtaaaggcggcagaacagtcatggtggtggtcgtaagtcctgaccacacgggcagtccgctgttccgttcgttaacaaagggcattcatcatgcgtgcgtccattgataatcagcgcggcgagccagctcgcaggccgattgtagaagtgcaaa

SEQ ID NO: 575239 - DNA, 238 bp, Homo sapiens
tcaccggtgctagccaggatggtctcgatctcctgacctcatgatcctgcccacctcggcctcccaaagtgctgggaatacagggcgtgagccaccgcgcccagcctcatcagtcacgcttgatgttcacttcaaccacaaatttctcaaactcagagcctcctcctcacctcattttttttttttaaataaaaaaaaattagaggtggggccgggcacatgtgggctcacaccgtga

SEQ ID NO: 575240 - DNA, 152 bp, Homo sapiens
tcgagtagtaggaatgcggtagtagttaggataatataaatagttaaattaagaatggctatgttaggggtgtacggtagaactgctattattcatcctatgtgggtaattgaggaggaagaggaaggggagggaagcttcccaagagtagc

SEQ ID NO: 575241 - DNA, 332 bp, Homo sapiens
gtatgcccacgtcctgttcctacaattgcactcagtggaccctcgctgtcgccgactgtcttcaccagagtgccttcctggtacggccacaccctcatcctagcctttcatgttcgcgcctgggcgatctggtacccggccatggcacccaaccccgctgtgtcgcccctcagcagggtcttttttgcctcctggaggttcgtgctggaaagtggcattgaccccatcctccgtggcctcatggccacccctgccaagctgaatcgtcagaaccaaattgcagtggatgagatccgggaacgattgtatgagcaggtcatgaggattgggct

SEQ ID NO: 575242 - DNA, 597 bp, Homo sapiens
  misc_feature (589)..(589): n is a, c, g, or t
ggagcatcgggagagccgcatctgatatccggaaaaatgcctgggctaagcccctaggcgcggtctggcctgccatagaggtgtccactggacaatgggtggcgcgtgggtcgcatcccacagtggaacgttgggctgtcttggggccgactcgcctgtttgtcattgtggggtgtgtggcagcgtctctgatggtcagttgcttgccctaggaacttgatccatcctaggttggtctgtccatccctcctctgcacaccctatggaaccctgcctctgcgcatccccgaacgtcccccgaggctccgctgtccactgcgcctgcccgggtctaggcgccgcctccgtcgcagggttaggaggagtcaaggattagggggtcgtgcagccacagaccagcaggagggactgaggccctgctaggaggaaagcaacagagggagggggccctacattcgcttcagacgccagttttcccccaccctccttaccccgcatgggctaggtctccgccagggctggcctcagtgtctcctcaacaggcctgggggcagcccttccctgccagtccccgcctgagtgccagccntacccccc

SEQ ID NO: 575243 - DNA, 1707 bp, Homo sapiens
gttatactttggacacaaaagcatcaaataaagaacatttaatcaaagtaaaaaaaaaaaaaaaaaaaaaaaaaaaaaaaaaaaaaaaaaaaaaaaaaaaaaaaaaaaaaaagagggggggcgcgcgccgccaagaatcttctctctctccttaggggggccccactcttccgccggccccccggtttttatgttatcaagagaggggcccacctataatggggagagggtgtattattatatataagaagaagaggcgcgcgggcgcgcgcggtgttttatacaaacagaagaaggagaagtggtggaaaaagagagcgcgaaaacgaggtggatctctttggagagaaagagaggacccatctattatctgtggagtggaggggaggggagagaacaatataggtgtgtggagagacatatatatctctctatctagagagagagtatatatttatagaagaaggttcatgaggaggaggaatatttatatataaaaatatattatagacagagaggtgatatatatagagcggggggtgatgataccacaacacataaagcagagggggagactactaatgtgctgcagctggagccgcaagggagtgtagagagaacaaaataatatgtgtgcgcgcatatcatcgtagagagaggagtatcatgatgatgataatctactagtgtgtagaaataccatattttattttttactcatcaccacaccgcagggagaagcagctcctatgagcgtggtgggtcatagtaaaagagtaagcgcggggaagaaggagcggagaggagagagggccggcgcaaaagccggtgagggaggcgaagccagagaaaggaagcacagaggacgaagcgagccgaaggggccgggagcgccagagcagaggagtaggcgatggagagggaggaagggacgagggagccgggaggcagccgagagagcggtaggccgcagcagtacgaagacagaagcgcagcaggcgcggagcgcacacgaagagagaagaaaagagaagaagagagcggagcagagaaagcgaggaaggaacagcaagagaagagacagaaagacagaagatgcagagcagacacgaaggagacggaccgagagtcaggagagagagagacggtggacaaaaagacgacgtcgagagaaggaagaaacgacagagacaacaacagctcagaagagcgaacagaggacgggagaccccgagccacatccacacgacgaaccccgaagagagaaagacgaccacagacgacgcgcgcaagaagggcagccggaagcagcatagagacgggaagggggacgagccagaaagaccgcggaggaggcagaggccgaagcaagagcgagagcgggaacaagacgcaggagcagcgaggaagcgagcggaaggcacgaagaaagcagcgcgagacgagaaagagaacaaccaacgcaccacaccaacacgaaccgaaaaaacaaccaccacccagcagagccgaacaaccgccacgaagacacccagacaacaacaaaacagacacagccacagcagcacccgacaacccaagcacccacgtcccaacacgacgcgaccaaccgcgcgaggcgacgcgccccgacagaaagcaccacgacacaccacccccgaacgacagcagacggccgagaaccacacaacacacaagcacgagccc

SEQ ID NO: 575244 - DNA, 378 bp, Homo sapiens
atagttttagttgtagacaccccaccttcagcttgtacttgaaagctttatctcggtataaataagtgcacggtcaattaggggaagtatgtccggtggctaaagggattctcaaacctgccatccccaaggaaaatcatgtattagtatggctaaatgatggtctgtatcttcttggtttggaaggtggctagatgtaggcggtaaacttgatggggagaattatattcttaaggtttacacccccttataagcctaaagccatttaaatggataaactgagagagcatactagatttggctctagggtataaaatccattatctgatcatattcctgacctccccccgactccaagtaaaggtgctgaagggtacc

SEQ ID NO: 575245 - DNA, 1172 bp, Homo sapiens
gcatgtccgcccgggcagcatctgcgaggcagcggctggagagggaaccatggggactgtgcacgcccgtgagtatcggagcctcttccatcaagtggacctgattcatggcggattaggagaagaagctgaatcagtatgaagttgagcctgaagctaaacaggaacattcttgaaaacacaacatgtggatagtacaacatgtgcattttgatggacttggaaggactaaagatgcatcatcatcactttgtgaaattggccgatgttactcaaggccaaaaagctaattgcggtcatgcggaaatctcatgaagccccgtgcaaaaaattgctaccgtacttggaatcaatagacaagtggctgtccacgattgacacatgtcacggtgatgacgcacttccaaatgggttagacgtaacctttgcaagtacactgacttgaggacgcatcacgaggcagtaataacaaccatggttgggaacaatgaaggcagcatggtactttggcctcaagcttcctactctgcttggacagtgcagacaaggtgaccctctccagtttaccctaatggagacaaacgaagcgttcgtatggcctgtaccttcttacaaccaaggaccggaaaacttcggaaagaaacttctcgtgtcagcctatttcacggtacttggcacgaccctttgacctcactgcggatccgcccgaggcatgctcccgcagatccagtatcccatattggaagacacgccaacgtcacgatggacacggcaataggagaactggcgtgctctcagagagcagcaacgtgagaccaaaacgagcaaacacgaaacatatctcgacgcacggccacagacgcaactaacaacaccacagacggcgccgcaagataaagcggacaccacaagagcgcagtgcgctctagaagctgagcaggaaagaacaataagcaacgataccaacttcacatcacacaaacgaaataaacaacacaatctccacatatacagcgaccacatactcccgctccttcccacaacaaaacactaaaacaaccaccacacaaccaacaactcgccaccaacccaacaatcccacaaccaacatacccattaaccatacaaaaccatcaaaaaataccacaaaacaacacacacacatcaccact

SEQ ID NO: 575246 - DNA, 189 bp, Homo sapiens
atatgaaggtcgatctagaggctccctcatattctctccaaatggagcttcttcaggaagacttctctgaccaccctatctattctgggctccttacagggatgagacccctacctaagacatgcatgtatctgcatacttatatatatctgtactcctattctaccgacaatctgacagtgaacacag

SEQ ID NO: 575247 - DNA, 273 bp, Homo sapiens
gtgcggctcattagcacatcatgcacctcagcaaggtctggagtgtgaagcagcactcatgggcactgtcgctagagagatttcaaccctgaatctcaggatgggcaacgcttccttaggctgagagtgggtcacgaagcggcatcgaccaggtagtctctgcctcgaacacctctcttcttcctccttttcttcaaccccccttattcccatctgtacggcaaggaaaaggtcagtacgcacagccctatcttggtattctctccaaagctc

SEQ ID NO: 575248 - DNA, 369 bp, Homo sapiens
attcggcatgaggactcagtctcctgggggtgggcagcccctgctgagcccaccaaggtggatgcagctgagggtcgtccggcgcacggtgcgcgtgtattgagcgggaccctatgagcatcctgagaggctgcggcagttgcagcaggagctggaggcctttcggggtcagctgggggatgtgggagctctggacactgtctggcgagagtgcaagatgcgcaggaacatgatgcccgaggccgttccatcggcattgcccgctgctactcactgaagaaccggcaccaggatgtcatgccgtatgacagtaaccgtgtggtgctgcgctcaggcaaggatgactacatcaatgccagctgcgtggag

SEQ ID NO: 575249 - DNA, 192 bp, Homo sapiens
tcatcagtgtagttggggtgtctatcaactagcaagcgtatattaggcacagtaagtagactacctttctggatgttttcaccagggagagcctttgtgtagggtatttatttgaagctgactttgtgtctctggcttcaaagggggttatgttagtgaggcatttttggtgttgaagttttgtgtttttag

SEQ ID NO: 575250 - DNA, 393 bp, Homo sapiens
tattaggaggtagtctggcaaaactcaccacacaggctaatactctgggattctaaataaaattgaaaggcattctaggccacaaagactgcaactcctaagcaattcctagagctgttccaggctcagagcaagtgtacttgggggacacgtgaactagtaagacaccaagctggggtggccaaagatgttgcagctctgaaagagactcctttcttttttctgtagaaggagagggaagagtaaagaggactttatcttgcaacttagatactacatcaggcaacagtggggcagtggagtaaggcactgggcagtctttttttttttttttttttttggagacagggtctttctctgtgtccctaggcgggagtgcgggggcacatctcc

SEQ ID NO: 575251 - DNA, 419 bp, Homo sapiens
  misc_feature (77)..(77): n is a, c, g, or t
ctagaggatcctgcaggagagagactgggttacttatgtgttgcgtgagcaagttatcacattttgagcctcctgtntcattatctataaaatgctgacacgttctcagggagacgtcggtgtgaagatgtatataaagtgtttagctggggttttaaaaaattttattttactttaagttctgggatacatgtgcagaatgtgcgggtttgttacataggtatacatgtgtcatgatggttagctgcacctatcaacccgtcatctaggttttaagccccacaggcaggggtatttttcctaatgctctccctctccttagcccccaccactcaacaggccccaatgtgtgatattcccctccctgtgtccacgtgttctcattgttcaactctctggagcttattaaatagggcttt

SEQ ID NO: 575252 - DNA, 210 bp, Homo sapiens
tcacacttgtactgcatgtgctggtcagtgtgcacgatgaactgctgtctgagctgtgatcaaattagagcagcatacctcatccacgattctatcatctcgtgagtacacatggggcatgtacagtgtgcacggtacggtggaattcgtatgacggggtctctatctgaactacacttactgaacagctacgaatgcctttcgccttct

SEQ ID NO: 575253 - DNA, 211 bp, Homo sapiens
ctgctcatacctgttatcaggggagtctcacctcgcacggtggatgtgcatgggaatcatctggagcgcatctgaaagcatacgtgccaggccccttccattgtggccgaacagtctcatctgcaaccggactcaggactggggcttcatctcctgggtcatctcccacccaggccaggtatccagcgggacttggccttgccatatgcaa

SEQ ID NO: 575254 - DNA, 799 bp, Homo sapiens
gatctgcaactgtgtgaaagagacattgagaattgtgaactgactctctcagtgatgatgtagttgaagcctttcatgcaatttatctgttagaactctccggagtaagatagtggacttagtgtggttctttgatcatgaaaagcctgggatggagaatgtcaggatatggagagccttatgttcgaggcaggatgtgggttgtatgagtatgactacatgatgaagtttgtgcaaatgttgttcaggataaactaatgggcatctaatgggcatctcatgtagagggcatgattgaagattagaggtatcatggagcacgtggcacatgaaatcgaagaagtgagtgaatctgatggaatgtctgacctgtgtagggaaaggttttaatatcaagatcgattgctgagtgctctaaaagtaatatacagcttgaacagttaaaactctattgtatgttggactttcgggttgtattagtaaggatttgcacagaaaggttcttggtgtggactagaatttgtctctaaaagagttgaacttgttgttcatatggcgagctgaatcggagataagctacagtgaatgtgggatcctgcgagagatccagtggttgattaatttatcaagtggttaacccttggagcctttagatgtcaatgcagaggtctgtgctccatgaacagttgttggggggggatgtgcaggattcaagcacggaagatggaaggtcgggtgagatcttctggtcaagttcaatgacgcagatttgttttgaaccagaagtcggaatggttat

SEQ ID NO: 575255 - DNA, 526 bp, Homo sapiens
gtcttgctcttgttgcctacagtggagtgcgatggcacgatctcggctcacgtacaaccgtccacgtgtaggcaaccaagagcaagactccagtctcaataaaaacaaaagtaaagtgaagtgacagcaaatgtgacttccctggggtgtttcataatccgagattattcgcttgtgagaaagagcaccagatagctcctatagttagcatattttccaagtgtcttgggtcctcagacaacatgcaccaaagttaagccaggttcatgttatctggaagagggcctttggctccgtcacaccaagtagcctcccacaaatttgtctaggaagtagcaaacctctacagcgagaacatgtacgaatgcttgtggaaaccgtggggcttctcaagagataacttagggaatttactaagtggtacaaagggaccgggttatagccttaaggagttggacattcgctttaaacaagctgtggcacaaggttagacagacgaaaaggtaacaccacaatgtgggcacaa

SEQ ID NO: 575256 - DNA, 377 bp, Homo sapiens
gagagaacctagtttcgagtttttctatatatttttatacgcacaaaaagcttttattcccaccagaggaaatcaggaaatgctggaggcaccctcgttagctgtgtaatcagggacggggacatagggcggaaacccgtcttcaatccatgtttgggcagcttccctaaccccaccaaggtttgtcctgggtctacacgagaagacagcttttagctgggagctcgcgcagtagtagtagttctagacacagcgaacgagtcagcgcctcacacacaattagggagtcctatctcgtggcaccactacgagaacacggctcaacacatcctcaggtgcaccaaccaacgctagcacaactacacacacaacctcta

SEQ ID NO: 575257 - DNA, 342 bp, Homo sapiens
ggagttcaagacctactgggcacatagggagataatgtctctattaaaaccaaacaaggccgggcgcagcggtcacgcctgtaatcccagcactttcggaggccgaggtgggcggaccacccgaggttcagagttcgagaccagcctgaccaatatggagaaaccccatctctactaaaaatacaaattagccgggcgtagtggtgcatgcctgtaatcccagctactcgggaggctgaggcaatgagaatcgctcgaacccgggaggcggaggttgcagcgagttgagatcgcgccatttcactcccgcctgggcaacaagaacaaaaccccgtctccaca

SEQ ID NO: 575258 - DNA, 248 bp, Homo sapiens
tgccaaagcggtagtacccaaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggtactacgctttggca

SEQ ID NO: 575259 - DNA, 333 bp, Homo sapiens
ataaaaaggtaatctctcagctctgtgtcctgagagctgaagctctcctaagttgaaacaatgctcttcttgaactatctcctcacaaattggaagcacagagttctgtaggtcttgcaccagagcttagacatgtagttaataccaaggcaccatgtggctgggcaatatggtttctgtcccagcctgtatgacgtcatatatggatttgtcatttgcaccatggaaatttcacatcaggacaaaccaccatggtttgtgaacatgggacatctctgaggaacacagaactttcatatggccacggagtgtggttcttctctgtgtgaactc

SEQ ID NO: 575260 - DNA, 355 bp, Homo sapiens
cttgacatcatcctctgagcccgatccagatactcataatagtatcatctacatttagcatgctgctgaaacaagtgctgagtatgtaatagactgtgtaagtaatctggcacttctaatcatcagcgcaggctcttatcgtcgagtgtgcataagccctgcaccagcaattcctaatgggtccttctgctttgactgcgcgtaaggatctccattccacatattgtgtatatactcacagatgtctccagttaatctgttctatactgtgtaaagtttattcctaggctgtagttaatgacacgtatatatcatgagtgtgttgctgttccacaccgttatttgtccatgacac

SEQ ID NO: 575261 - DNA, 379 bp, Homo sapiens
tgatattggaggcaggagggaggaggacagtgggcacatggggctgtacgatcaaaactgcattccatcaaatcacaattacttttgcaccaccctaatacaatagctccacttttacctatgtcaaaagggtttttttttaaaaaaaaaaacaaaaacaaaaactttttttgagacaagatctcgctctgtcacccaagctggactgcagtggcaccatcacggctcactgcagccttgacctcctgaacccaagcaatcctcccacctcaatctcatgagtagttgggactataggcatgttccaccatgcccggctactttttaaaaaaaatttcttacaggtggaatctccctatgtttcccacgctgctctcaa

SEQ ID NO: 575262 - DNA, 186 bp, Homo sapiens
tcccgtctgtctctagagcatcgggaatccaataacccgacttgggagcagcattgggccctgcctcactggatcaccattgcagcagataccctgctggatccggaggggtgtaagtcagtggtggtgtctgcaacaacagcaatcagcagtggtagatagcgagcgaaagctcagttcgaactc

SEQ ID NO: 575263 - DNA, 1382 bp, Homo sapiens
agacgaaatgaagaagaagagggaaatggatgaacttaggagctattcatcactaactgacaacgttgacacacactactgtcttcaaatcacggactggcaactgacttcagatgacacgttcatgtaaaacggacgacacacacggacgacacacacggacccttctgacaacgactgtgacatgtacgacgaccaactctgcagcaccgtttgtggtattcatcgtgtgcttctagcacacatcatcaacaatcaccacacacaacacattcataccctatccatccctcaccacaacgaaacatctccatcgcactactcacaaagattatacacacacacacaccacttgtcacacgatcttctacacctagccatcgcacccagccacacaacagcgccatcccacgcatcatcgctcatcaacacaatcagctctcgcacacctctgccaccacgcccattcattacacgtatacaacagctgcacccacactagtaaatatatagccccaacgcacacccactgctcctttgcgttaccacttctgctgacacaacagcaacagcgccattgacatcacataatgaagttacacatccagcacagcaattaagcacacctcatatcaagcacaccttcggacacaccctacgatcttcactgaacacgaccaaagctaaccatacactctggacaatcgctccatcaatggcaggttcccataacataccacagccagtggaacaacacaaacccacggcactaggtttcccttcttcggcacaaccacgccgagcgctgtcgtcgctcgccagttcatatccgcccttcatcagcgacgcagcactacagacgtctcttatccaccacccttattccactccggtttcacacccgacacacacagcgaaccacctactaggatttagtcagctaggcagccgttcagaaagttctctacacttcggctcggcacgacctcgggtaaaccagcgaccccatcaggacatccccaacccactaggaggtgtctctacgccattcacggcaatatcttcacagcgcggcacgttcacacttgggcagcgatatcacatcgggccaacgcaccagcgtccaacgcgaacgctcgcattcaccacccggcacaccagccacgtcacgggtcgcaaacagacacaggttctcacccgctcataagtttccccacttggacaatcaccccccaacctcagcacacgagctctcgacctctcctatgcgcgagcatccaacacaggcatacaccgcttcagcttacggtattgaaatcgcaccactaccaaaggtctagcggcaagcacttgcataacgacatgcacccacgacagcggtc

SEQ ID NO: 575264 - DNA, 252 bp, Homo sapiens
aatggtaaacgtataggtctattctaatttttttactcctttttcccctgcacattttaatgttaattaccttttagaattccactttaactgggtaccgactttttatgcatacctatttccatgatctatgtgcaagtgctatagggaatacagtatacactcaagtgcttatattctattgaaggtttttttaaaatagatttattgtggtataatggatatgaaacaaaggtcgacgcggccgcgaat

SEQ ID NO: 575265 - DNA, 206 bp, Homo sapiens
attgacttcccagagatcccatgggtttctggagaaggctgagcctgtgagcccaggatgtgtgaagctggcagggcatgagggcctggtggagactgtgctattgatggagccatggtgcgatgcgcttcctgcagctctaccatgaggaccttcttgcgggcctgggagacgtcgctctcttgccactagaaggtccaggtatg

SEQ ID NO: 575266 - DNA, 105 bp, Homo sapiens
tctacctgaggatccctgaatcgacggttctctggagctacagatagcaacaacaggctgaggatcgggcgtcggagctgtgccaggctggcagcgtgtctgtgc

SEQ ID NO: 575267 - DNA, 536 bp, Homo sapiens
ggctggcctgcccagccctgtcaggacattaagatgagagccagttatttctctacagctacgcctgcgagatgaacagcattatgcctgagctctgctgtacctccagatcacttcataatgggcaataacacgtgcacacgctgtcttataccagaccaagcccatgcctcccgtcatacagctcaggacttacgtgcgcacactttcttgtctagacaacctgctagccccaggcattcaaatggccgctgactagctaatgcttattactggtgcagacatgttggttgcatactcagtctacaatccaccctgaacattgtgctatcatgcaatgggttactagacgacactccgtatcatctagatacaccgtttcagaaatttggacacaagtcactagtaggacctaactaatggccacatcagggccgcgctataaagtgcaatctctcaagacccaaatagcaggtgcatcaactcgtcatcaatgcgttggattgcatacccagtgatatttacactctggtttc

SEQ ID NO: 575268 - DNA, 124 bp, Homo sapiens
aaactgcgctagacccaacttatcaacttcttcttcatcttcatcttcttcatcttcctcctcctacctcatcctcttcatctatcctcatcttcctcctcttccttctttttcttgctctctt

SEQ ID NO: 575269 - DNA, 229 bp, Homo sapiens
ctcgatactccagacctatggtcttggtcagagatggtcacaggaggtcatgaggaggcagaggagaagtctgtggtgctgcttgtatgtaaacggtctgtagcccacctcagccatcttcgtggaggtccttgcaagcatgcggcagatgggttggcccaggtctgtggccaatgatgatgtcccgcatacagatccagaaatgcgcgtgatagtaccttccggggag

SEQ ID NO: 575270 - DNA, 1182 bp, Homo sapiens
tcggacttctgcgtctccgttcctctttttttcctcctttggttgcttctcgtctcctgcgcttttcgcgtctccttttttcttgctgtttttctcgcttctgcctctctctctcttttgcctggcttggctgtcttcgttgcgctctgctctttcgcttttcttgcgctgcttgtcttcgcttgtcctctcttgcctcttcgcgtactactgcttcgcccggtctctcctcgcgtgctgccgcgcaccctgtctcttttgttggtgtgtgtcgtgtgtgcgtgtgtgtgttttgttgtacgtgttggttgtcgtttttctggttcttctgtctcgtgtgttgtgttcggttcttgttttgcttgtcggtttttgtgggtgcgtgaaggtattcagtcgtggtcgtacagaggcagaaaaggaggaacagtggacctttttcacatgttcgttggtaattgcgttcctcccggaattttggttcgggagctttgggcccctttaatgtccccagaggtgtagaatatatgtttccgagaaactccactgggtcgaaaaagagtgcacagggtgtgcttttaagtccatctttttgtccgcctcggaaaattgttgggattgaatggttaagggtgccataaaatttgtggctacaggaaatctgttttgcgcatatcaactttgggcagtaagcgttgtggcagcagaacatccccggcctggaagatagccgcctaagtcgctccttgcaccagatctatggggaaagataatgttgtcgaaaaacaaggaccatgcgcgggtcactttgattatgcgaagagagcgtaggtcccccgcccatagaggaccggtgagctttagctttcccctctcgttagacttctaaatttccccgctctcgccgatccctgtttagatatctcacactgggctttccccctccgggctaaacaactttggtgtgttggaatccccacccgaggtaaagaggaacgggttttatcttctcttaaatgtaaaattattaatatcccactatcattgtgtcccctccatacgagatagttcttttttatttatacctattacacacacattatttcatcttaaagcagtacattttatccacttacacgggaaacatattttcccacactttcccactcaataaacaaaaaa

SEQ ID NO: 575271 - DNA, 252 bp, Homo sapiens
agtgcagattcagaagtatgaggcgccatagcgagtgaaacgtagctgtaatgatgcagccataataatacgtctcgaagtgatgatgggcgataagatgaaaaggcggttgagagcgtctgtgtgagtagtgcatggctaagagaatagtcctgtggatgcatttggaggatcagtgcaggcgcacaaggacgtgagccgacagtttcatcatgcggacgatgttggactcggccccgaagaggcgagggt

SEQ ID NO: 575272 - DNA, 783 bp, Homo sapiens
ggcgctggaccgaaggcctcatctcgggctccagggtgtgggctggggagccagacagctggatgtgaggcagctgactagaggtggtgcttcacacgggcaacgtatgatgagctcatcgtctgctcccagcgagatcgctgtcagcatgggccagttggatggcaggcactccaaggtgaaggccaatgagcacatgcccccatcctgtagcgcggctgctaggtaattgttcgtcgcagcaggtccaaatgaggaggtgctgtgcaagtgtggtggtcgtccaccaatgtcaggctcaggacgcagattgaggacagagacatcgcatggatttctccggctctgtctcctcatcaagcttgatagaagcaggagatggagactgcatggtgcgtgtccttggagctggtaggaacgactgctggatggtcgtgaaccagcatgcgagcgtgggggcagttgcgtgaagcattgcagcgtacgctgcgtggcttggggctagtcagggcacgccactggaagagtgaggtggatcagtcgcggctgcagacactgacacgcccgaaaagatggtagctcgcccaaggagagaccgagtcgcgagcgcaccagtagaatcacctaggtgtggcgacccctaggacacgtgagcgcgaaccgaggctttgacctaaacaactggatgggcatcatagccgagctcaaaactcggttgaacctacgtagtgccgacccgaagggcgtccatgcgaagggtcgtgcttggttgacacgtgcctg

SEQ ID NO: 575273 - DNA, 432 bp, Homo sapiens
  misc_feature (133)..(133): n is a, c, g, or t
  misc_feature (205)..(206): n is a, c, g, or t
  misc_feature (222)..(222): n is a, c, g, or t
  misc_feature (273)..(274): n is a, c, g, or t
ggctgtgcgaatacggcacgcggagaatctcatgacacacctcgtggacgacaggggatacgcgtctgtgccacgagagagtgaaaggggagacacgatgagcgcacgaaaatgcgacacacatctcagagcncagagcacacacgagatgtggacacctgtgctctacaaaaaaacccacaatataacacacacacacacacannaaaaaacatatatatnatatttcctatattgtgtcatatacatatgagtcacagagagagtatatannaaaatattttcacatatagacgtgtgtgtgcgtgtgatactctcttctctacatctgagacgccacagagagagctcagagcgtgtgatatgaggcgtcaagtagacacaacacactatgcgacatcttatgacgctcgtggtgagcaacgaagatga

SEQ ID NO: 575274 - DNA, 121 bp, Homo sapiens
gcctcagagaagaggtcatccagaagggtcccagctccccatgaggaatgaactagggaaactaagggaaatgagcaaagacccaaggggtccggcagcataaacctatggtggacgtgag

SEQ ID NO: 575275 - DNA, 179 bp, Homo sapiens
ttgtgaaggggtagaagatctatgaaacttgtcttgagattgacctcattccctgttccacaaacccatatgtatcctttcctatacctcatcctttcccaattaatttcaaccattgttcgatgtttgggcttgtgtacgttcgtaaaaagattaaagatgttctgagttggggtgga

SEQ ID NO: 575276 - DNA, 929 bp, Homo sapiens
  misc_feature (873)..(873): n is a, c, g, or t
cagagattataagattaaaaaaaaaaaacccaactatatgctgtctacaagagacacgttatagtcaaacacaaataggctgaaagtaaaatggtggataaaaatataccataaaaactataagcattagagagttggattctatattaatatcagacaaaatagacttttaagacaatgattattattagagaaaaagatggatattctataataataataagactcatcttaaagcttcaaaatacttgaggcaaaacctgacagaattgaaaggagaaatagactaatcatcaagtacagttggagattttaatattcgtctcagtaactgatagaacatatagacagaaaattagtaaggatataaaatatttgaacaacactcttagtcatcttggcctagctgatgtctataaaacacccaacaacagcaaatgttgtttggtgttgaacattcaccatggtagaccatttgctgagttacaaggcaggtctgaatatattaagtcttaaatttatgaatgtaaaagaattgaagtgacacacgtatgtgttctgatttgcaactgagttaaattagaaatcagtaaccatgaaaaatctctaaataaattaaaatgaaaaagcccactagtaaataactcattgatcaaagaagaaatgaaagactgtcttaaactgaatgatactgaaaactcaacatgtcagaacttgtgggatgcagctgaagcagtacttagaaggaaatttatagttttaaaggctaaattagctgggcacagtggcatatgcctgtcattccagccacttgggagactgagatgggatgatccctggtgctaggagttcagggtggcagtgtctatgatngtgcctgtgcatagccactgtactctagccagggcaacatagtgagaccggtttct

SEQ ID NO: 575277 - DNA, 363 bp, Homo sapiens
  misc_feature (15)..(15): n is a, c, g, or t
  misc_feature (25)..(25): n is a, c, g, or t
agccaatggtagttnggaaaatacnggttcccccgagtcctgcagatcctcctagatgtcctcattttattatgcagtattttaaaaatcaccactaatctcagaaaagtttttaagttttgggtatcgatcaagttgaagttggaagatacaagttttcccaaaattcctaattatcacttgaaagacaaaattttattgttggcgataaatactgtcgttttacttgaagtgacagtctcatttttttcattttcaagaaaatatctgcagatacccacttctggataatagtttgtctttatttacagtaaactgtttacagtactttcaagtaaaaatgttttccatgaaaaaaaaaaa

SEQ ID NO: 575278 - DNA, 190 bp, Homo sapiens
  misc_feature (2)..(2): n is a, c, g, or t
  misc_feature (42)..(42): n is a, c, g, or t
  misc_feature (92)..(92): n is a, c, g, or t
  misc_feature (166)..(166): n is a, c, g, or t
gnactgcttttatttacctacttatttttatagagttgaggnctcactatgttgcccaggctggtctcaaactcctaggctcaagtgacctncggccttggcctcccgaagtgctgagattacaggcatgagccaccgcaccacctgcctgtcttactgtgtgagnaaaaaaataaacggtgatgtgatt

SEQ ID NO: 575279 - DNA, 237 bp, Homo sapiens
caggtcgtctacgacggctcccctgtacgctcaagccactgcagtgacagactctagaaagacatttaacagaggaacttctcttttcatgtgtgacggagccactaatggatagcagtgtcaagctagatagatgtactatatttattctgtatgataactacatactgcactcctcttggggaccattctactatgtgagcatagcgttttatattttttatgaatgctgatctt

SEQ ID NO: 575280 - DNA, 1042 bp, Homo sapiens
tgctgttctcttttgtttcctgtggtgtgtgtgcttcgctcttgctcgtttgttgtcgtgcgctccttctccggttgtgtcttttgcctgctgctctttttggacgttgcttgggttgttcgtcgctttcggtggtggtggtgttgttcgtttgtgcttggtttgtgtttgtggttgcccgttttcttttcgtgtgtttgtgtgcgttttgtgctttgtctcgtttttgctcggtgtggtccctttttatttggtcagctggttggtgttttggtgtgtttctcgttgtttcgagtctcgtgtttcttattgttgtcttttgctagccctgggtggggtggcttctttggtgggcttatgttctccttggtgtggtttgtgttcatccttgtttgctggttactttgggttccatcccttccttggttcttgtggttttccttggtgtctgcgctttcttctcgggcccctcgttgcgcgcggggttctggtttgcctgtgtcaggatttgctgaggcctttgtgcactagtgatatgtattatgacgctcttatatttgctcttttgggcccttgcacccggctggtcttagcactttgtcttgtgtttgtgagacctgctgtccggggagttatggacattgattgggactattgtggaaccaatgcttgtgactagtatttcaccatgaccctgcctgttagacccttgactaggcttgttgaccgattgccaagggtaatgggacattggctgagctcttgacctttgctaggactgttggacttgtgcctggctgtttagaacagtgactgtgctgtttgaactagtgactaggactgttgaccgtagctagctgttgaccgtgctggctgtcgaccgattctgggtgttgactatgctagctgttgactgtgctggctgcttggctgtgctaggtctgttggctgtgctgactgttgactgtgctgactgttgactgtgctagctgttgggcttggtgttataggcatgtctttactacttggacattacattttt

SEQ ID NO: 575281 - DNA, 351 bp, Homo sapiens
actcgacacgtcagtttgcgcgcaatcattggcttgagcagccagcccagggcgcctgcaaagcgcgggaagcggaagtgggtcaggatgtccagaaaggccttgtcactgaacaggcgcgccagcactgccgggacttcgctgtcgttgtaaggtcggatggtatcgaattcgcccatcatgctctcttgttagaaacggctagggtaagtaaaaggaaatgtcagggtgcggtccgaataaggggccggccaagaatagccctgtaaatagaccggcgattatacgcacaagtcacctaggagactgcgatgctcgaaactgcgctgtacgattgtccttattgtggcg

SEQ ID NO: 575282 - DNA, 1192 bp, Homo sapiens
tgcaaagctccttattattttctaagactgtttgttcatcagtatcactggatgaggcacgatagaaacacctaggtaactaacaaagatttttttttattatttttctttttctttggggaacaacacaacgtgggcgatccgcgcgggggtccttccacagcgcggggagccgccaggaggtatttgcccagggccgaaactattttcgcctccagtggcgacgccgctctgaaacacactctgcgctcccagagaagaggtgatcactgctctctctttcttgagaacactctttggtgtgacgatgtgaagcgggggcgttggcaccagaagacttggggaagactctcttttcttcgtgggaataataatgataatggagacaagacaaattattatcgggggaatcaacacagttgtggtcagaacgagcggttgtttagggtcagccgcagagagacatttattccgcgtcccatgcgcgtaacacatcattggtggccgggggtcgcgggagataaagaaaggcctctaacgtgccatcttctctcttttgcgatttgtcgcaggagacttctgcacaccaggtgcgtatatttactttgttgagtggttgtgcgagcaaacccatcaatgaattcacgcgcaaaaaagaccaaggtagagcgtggaaataccgtcgatgtaaatgaggagagagagagcgctgcgtgtgggaacgacatctctctcgtgttgagccccccgataatgggtttcgtttgcctatctacgaagctagagtattatttgttcagacagacatctctcctgggcgggggggtggatacaatggcgagcagacactaccagtggcttgtttcccagagagagaggaagagctcccttcaatgcgctggcggtgctcctccaactatagacatgatcacagacgggggcggatctaaataacagcgcacgatatacattgcgtgggggcggcgacaaagatcccttgatagggtgggggcttccccccggtggtgagccacaccaacgtcttggtcggggcctcttacagaggaggccgcacttcgtcggctggatttatacacataaacttcttttcgttagtccggtgttagctacaagaacgctctgtgggcgtttctcttgtggtggcccccttgctgttttcaccggaaaaaaa

SEQ ID NO: 575283 - DNA, 390 bp, Homo sapiens
tcgtgtccgtgacttggtgctctcggacatatacaaggtatgaatgcggctcaccgatggccctgccgagcaggtatgtctcaggaggcttgtcgccccatgaattgttatactgaaaaggtattcataccttgcatagagatgatgtgtacttttgatcctactttaactgtctcactttgtacaaactaattgttggaatacagctcatcacggatcaattctgctcacttgttgactagtacctactggattctgtgtagatgcgtgtttggacaaatcggggctgggggtaggcacgggttatgttacgaatttctagaaccagagcttctttctgtggcgttgtaacagctgtgctttgcctcctagagtcttagagagcctcct

SEQ ID NO: 575284 - DNA, 262 bp, Homo sapiens
  misc_feature (45)..(45): n is a, c, g, or t
  misc_feature (60)..(60): n is a, c, g, or t
  misc_feature (83)..(83): n is a, c, g, or t
  misc_feature (85)..(85): n is a, c, g, or t
  misc_feature (110)..(110): n is a, c, g, or t
  misc_feature (227)..(227): n is a, c, g, or t
  misc_feature (242)..(242): n is a, c, g, or t
catagtgagaccctgtctcgtacaagtacattttaaaaattaacntggcatggtggtgcncacctgtagtcctcgctactagngnggctgaggtgggaggatcacttgancctgggagtatgaggctgcagtgagctatgaccttgccactgtactccagcctgggcaaaagagcaagactttgtctttaaagaaaaataagtagtagtaaagagtataagattccncagggtgaataattntgaccaaaaaacaccccaaa

SEQ ID NO: 575285 - DNA, 493 bp, Homo sapiens
  misc_feature (66)..(66): n is a, c, g, or t
  misc_feature (488)..(488): n is a, c, g, or t
  misc_feature (491)..(491): n is a, c, g, or t
tttggggataaagtgtcctgattgcctgtaaccttccaaagggtccaacaaccaccgaaacgatgnttattgggtaaagtattatatatagagaaaaatattaaccatttttaaaaaatttaaatgaaagatgtaccaggagtgtgctgtactggtcttcccgtttctctgaatgtatgaaacatttcccataatagaaagttgtggggagcccaggcatgctggttcacacctgtaatcccggcactttgggaggccaaggcaggcggatcacctgaggtcaggagtttgagaccagcctgaccaacatggtgaaacccctgtctctactgaaaatacaaaaattagccgggcgtggtggcaggtacctgtactcccacctactcaggaggctggggcaggagaattgcttgaacctgggaaatggaggttgcggtgagccgagattgtggcattgtactccagctctgtctccttttgagacagcnaantc

SEQ ID NO: 575286 - DNA, 412 bp, Homo sapiens
agagacagggtctcactctgtcacccacagtggagtgagtgatgcaatcatggctcactgcagccttgaactcctgggctcaagcgatcttcccatctgtctcctgaatagttagaactacaggtgtgtcccaccacgcctagctaatgtaaaaaatatacatttgcagagatggggtctcactgtgttgcccagactggctcaaactcctggcctcaagtgagtcttctgccttggcccctcaaagcgttggtattataggcctgagccagtgcacctggcctcacatgacttttattgcattatactgttataactggtctcttttattattagctgataatcgcttaccgggcctattttataaattaaatcttatcatatgtatatatgcataggaaaaaacatagca

SEQ ID NO: 575287 - DNA, 296 bp, Homo sapiens
cccccccccttttttttccccccccctttttttccggtccccctttggggaatggaaaagggggtttccaaaaatttttgcctgcttgggcccctgtgggttttggggatatggtattaacgggtccccttttcccccccaattggggggggatttttttggcttttgagggtcccctttttttaagtgggtttaatgccccatggggggctgtttttttgttttttaagggggggtttaacccaaaagtttttgggggtttgggttttttaaaaaaataagggtttgggccccca

SEQ ID NO: 575288 - DNA, 188 bp, Homo sapiens
tcagtgtctgagtaaggtgtagaggctggttagcagtcttgtgatggtttctgggtggtcttggccagctggtcatggctttctgccccgcctctgtggcctggtcaccacttgctgagctgccgctccggccgctgacacggcttccaggcgccatctagcacagcctggccctgatctccgggcag

SEQ ID NO: 575289 - DNA, 480 bp, Homo sapiens
gagagagagagagagagagagagagagagagagagagagagagagagagagagagagagagagagagagagatatagagttatagactgcttcatatactgacacttgcctgtctcctcctaagcctttttctcttctcttttccttcttttatcgctctttcctcctcgccctctcgctcttctacccttttgttctcacttatctctctctctcctgtcactccttctttcgtttttacctctgtgttctccgctctgcttttctttctcttaaccttcttcctgcttttcatctctctccttttcatctctctgattgccctttttgctctcctcctcttcattcctctttctgacccttcttttactgtttctctcttcttcctccttctatgctttttcccctccccgtgttcccctctttattccttctcatttccttctttcccccctcgatctccttgtttcctttccctcc

SEQ ID NO: 575290 - DNA, 690 bp, Homo sapiens
agcgggacttggacgtgcgagtcaacaaggtacaggacacatttctctccggggaaatcttgtgtgggcgccgaggcccgggacgtagcaaccaaacgtcgggaagaggcgccaaataggatgctgggccgtggtctccttgaagcccgggttagcccgtttgtgagagccacaagcgaagaaatagaaatctagcacagagggggccactatctgcggcgagatacgccctctcgggcgctcctccagctcccaggccccctccctactcgaacggatggctgcagctcctccaagttactgtactcgttgccttccctccaagatgctacaggatggtctggatggtatttcgggaaaaattcagcccggcccagagatgaaagtgcaagaggttgtgtaattcatcgaggtgctgatcagcgaaccggagagcaaggtggaggtagcacttacatgtcaagtcgaagcaagttccgaaggacctatgccattaatgataacgcagaacccgtctggctctgggagaagtagaaatgggagccaatgaacatggatttgtgcagtagccacatgaaagccatcaataacgagagaagccaacttgccagaaatagaatgccttgctgggggatggcatctggtcaggcttgggataagaaagaaggggaacagagctaaagaagccta

SEQ ID NO: 575291 - DNA, 1561 bp, Homo sapiens
gcctggatgtgattccgtcctgcgctggttgtatctctggagcagcgtactttatatctaccgtccgccttctctcctacctaagtgcgtgccgccacccgatggcacgattcgatggaccatggacattgagccccctgaggccccagaactatcttttcgggtagtgtgacctaacaggcccgacacaacgattatcactttaacgggtggcatacctgcatgaacaattgagcaccacgtatactcttctcaacgaacggctcacgttcaagcgggctggctgccaacagcgcatgacgttggccacactgtgctgtcgaacgccacgcagcgcaccctcgcaatctcacgaatgggcacgtcccaaatttcacactgtaaaccatctggggcccaacctcttggccacacattgtctcctgtccacatgccccaacccgggcttccccccctaatggcggcggcccctctttggaaaccatcacatcaccccacccaagttgcgctacttcaacaccgcggttcttgcaaccgctggatcgggcatatatcaagcgggcccaacgttggccaattaacttcacagttgcggaaccaaggccaccttaaaaggtcaggccctgtgtgggccacgcgcacaacccactggcacacgacaagcttccacgcgaacccgactcgcacccggcaggccgaaggcgcagcagccatctgcttggccgacaccctctcgctctaacaagcataatctactccttggggcacaaacagccccgggtcttcctaggcccgcccccttggcacatcgcgcttggcgcatcacgcccacacgcgcgttctccccaccacagcggcaccaccaccacatgcggttacacaacactccttcggccacttggcctcggcactcgcacaccgcactattgaatcagcacgcgcgagtggcaatcgatctgcacacgccagcgcacctgcacctcgacatccgcaaccagcaactggaccgtgactcgggcaactggactgcgacctcactcggacctgcacacgccagcacaaccgctgcgaacacccaacacacgcgccgcccccaccgtggcaccggacgaactcgtaataccgcgcaagcaactacctgtccacagcgcccacacacaacgtgtgcccccacaccagcgtccgaacacactcacggaccggtgccgagacgccctcacgacccccccgctacacccttcacaccccgccagccactccacaccgtgcgcgccccacaacaccccgctcacgcgaccaccccgcggtcgacacaccgctcgtcacacagcagctgacaagcgtgcaccaacctccgcgtagagcagcaccatcacaagcccaaactctgcacgacgccgatatatcaacacaacacggggggcccactaccccgaagcgggcgccccaagccaacacacgtgaagcacgctgcccgcaacgcccacgcgcgcaacacactggacgacgacggcactgtacccaacgctcatcgtacccgacatctcacttccctgcacga

SEQ ID NO: 575292 - DNA, 461 bp, Homo sapiens
  misc_feature (64)..(64): n is a, c, g, or t
aaagagctgaagaataaaaatatgctgtctggctgacattaatggccaatatttaaaaaacttncatatccccttgcagtttatagctcttagatttttaaatatttatttttttacatacaaaaatacttggggttgtttatattaacaatttgaaaaagatcctatatacaatgtataaacagacaagaaggaaacctactaaaatgttagcgattaaaatctctaggtggtgagagtataagcgagtttattctttacagttttcttaggtttccaaatattctcccatatgaatgtgatatttttagactcagaaatgaatatacaagtatacaaatttccattttcattgtgactatggtgagtttttttgtgtgtccttatcctacattccttgaaattttctctaaagagatttgtgttcttattgaaacagtaaattttataaaaataaaaaa

SEQ ID NO: 575293 - DNA, 773 bp, Homo sapiens
gaggcagaagaattgcttgaacccgggaggcggaggttgcagtgagctgagatcatgccactgcactccagcctgggtgacagagcgagaatgtgtctcaaaaaaaaaaaaaaaaaaagaaatttaaaataaggtctttatcccccttaaaaaaccttccagaattatttttcaatgtgagagctcagtgaagttagcatgtgttatttcgggattataaacgcattttttgggttaactgattggtaaatttttttccacattgaacagacatttttttaaatcttctaagtttttagaactaagccattttaatttggtagtagtgtctcctatcctggggggatacatttccaaaaagcccaggggattgccttgaaaccacacattaggtaccaaaccccacattattacggttttttccctaatattttacattacctattgatcaagttaaattaataaatttacgacacagtaagagatttaacaattaaataaaatagagcaatttataacaatatacggtaatacaaagtttatttgattgtgagctcttgttagcatatcttggtaactttactcaccctccttaggattgaagtgaacgtgtataaagatacctcataatgagaataagtgacgggtgaatgacataggccgctgttgattgtagcatagaggctacatatgtccttctgaccattctgtccagaagggaggttcactctgttaggggctatcctagaatcattgacgcatgacgattcgag

SEQ ID NO: 575294 - DNA, 107 bp, Homo sapiens
gcacgaggagctccgcatgcacgacaaccgtatccgtaaggtgcccaagggagtgttcagtgggctccggaacatgaactgtatgaagatgggcgggaacccactgg

SEQ ID NO: 575295 - DNA, 106 bp, Homo sapiens
tacttctgagtagctgggactataggcacatgtcaccatgcccagatacttttttatgctttttgtggagacatggttttgccatgttgttcaggctgatctcaaa

SEQ ID NO: 575296 - DNA, 321 bp, Homo sapiens
taattttttgtatttttagtacagatggggtttcaccatattggccaggctagtctccaattcctgacctcaggtggtctgcctgccttggcctccccaaagtgctgggattacaggcacctgccactgcaccctgccagtttttcttttcttctctttttttgagatggagtttcactcttttgcccagcctgcagtacacattttaaatttgggtgtgttgtattggtctatgctgctggagacctgggtctgtacttgactcatccagctgaccactggaaaggatttcataaattcgtgtttgtcttgtcatcagtt

SEQ ID NO: 575297 - DNA, 198 bp, Homo sapiens
ccccgcgcatgacataagcacggaggattgagataagcacgtgtgtctggttagcatgaaacagaggtttagcatagctgctttctctatcaaagcctccaccatgtcattcttcagagcttctagtatagatttgtctgcaaaactctgcacagacctcagcccattgaccatttcctttgtttttccacagtatat

SEQ ID NO: 575298 - DNA, 501 bp, Homo sapiens
  misc_feature (238)..(238): n is a, c, g, or t
atcagcatagactattaccgttaagtacctggtggctatattagtggagaaagtaaactagggcctcttcggatgcatctagctatagatggaatccatgtagaaaggcaccaaatcttggcgtgaagtcccataggttctctacaatagatgtgcatagtttccataaaacactgacactggaggttaatatacctattgtgggccaattccgcataaaatacactcgctgttatgntaatcgtgcaagctgttgctcacctggattactaaccaaaagttaccacgttatgtggtaccacaccacactttgtgacaaatagttttaaaaataacacgcaacaactatggctgttatgcttttaatggaagcagatacaaaattcatcaatgcaaaagaatgttttacatactcattaacatagtgattaatgtaaattatattttgacttgtaaaatacagtgtgtttggcctcaagaaactacagagctgcaactcaa

SEQ ID NO: 575299 - DNA, 176 bp, Homo sapiens
  misc_feature (58)..(58): n is a, c, g, or t
  misc_feature (97)..(97): n is a, c, g, or t
  misc_feature (109)..(109): n is a, c, g, or t
  misc_feature (146)..(146): n is a, c, g, or t
atttcctgcctgcaggccccaaggtccaccctgtttggccacaggcaccgcctccatnccatgttccgcccagccccgcccccaacccaaggtgttnaaagatttccanctgcacaggcccccgccccagggggtggccgctgttncaaaaacaataaaccctgatgggcatggca

SEQ ID NO: 575300 - DNA, 268 bp, Homo sapiens
ctggaactaatggttttaccccccttcccccccggcatcccccctctccccaaggtgaagggagggtgctgtggtgacctgccccctccaaagttccggtccccctgggggggtcaccctcccctgccttcgtagggagggaggggagttttttttgtggtttttatttggggtgtggggggggcgggggggttttttataaactgtatcattttctgctggggggggggggtcccccccttttaatcaaggggattgtgattttgac

SEQ ID NO: 575301 - DNA, 389 bp, Homo sapiens
caaagggccttttagccctaatgaccttttggatggggctgcaactcatggctatcctgatattaaaaaaaagggctttgtttattttttcccccatagctttgctgggtaggtttacattttactcagaatccctacacattcctttagttttcctccaaggtccagagccattgggacaaatgctttatttaaacttaataccttattccccccaattagatgaaggcaatatagaagtccgcatagttatcataattccgttccttggccggtttaggcagctcagtgggttagcccagtcaaaccaacccccagctttcctcccgacttcaaaattttatggtaatttttttggatttttccagttttttaataagtgtttgagt

SEQ ID NO: 575302 - DNA, 250 bp, Homo sapiens
tgacttcaccttcgtctgccccacggagatgggcgacctctccgaccactaccaggagctgcaagccatgggagtcgaggtgttctcggtgtccaccgattcgcacttcgtgcacaaggcttggcataccgactccgacaccgtcggcaaggtgaactacaccatgattggcgacccgaaccttcagctgacccgcaacttcgacgtcgagcgtgaaggggccggacaggctgatcgcgccaccctcctc

SEQ ID NO: 575303 - DNA, 1018 bp, Homo sapiens
aaaatatttgctgtatagctatgctaataggttgtttccttgtttaggtatatgtaaccagtacctatattattaaaatagatggatatagaagccagcataattgaaaagcacatctgcagatctcttttgcaaacgtagttaaatcacagaacattaactactttatgtgtaatgtgtaaattctataccatattttgttatattctgtgagtaatgtcgactatgatttacggattgacttaaatttgggctcttgtttaatgatcactcacaaatgtatgttgcttttagctggccagatactgtttgagtatagcccctatagtttgaacttgcatctacaaatgcattgtgtcttttaataacattggccctacttgtgcttgatgtctcttgtcatgtattatgacagtaagctacctgggtccaggttgtgctttccttttatttagttgcacacgaaatagatgggttcgaggttcagtggtcttcatcttccgatgcatcattactaaccaagtcagacgttcagcagaatcttgatgttaggaaaaggcggaatgttataagatacatcagaaacttgaatgtagacgagtgttcacttgtagcaacggagttgagggttctattctaagactctagaatctgttacttgagttacagaaaaggtgtcctctagcctgggttttcctcactgttttgggaaacatcctactgggtttctcacagaggggcctttataggagccatctcggcttaagacaagggccaacatacggcggcagtggacagcaaacattcagggactgcagacgggaaaagcacggtagagaaggtgcatgggtttcacagagattaagggtaacaggtctgaagaaaagggcagccaatgcgtagacaaaacttgcccgggggacgaacacaggcggacactgaacagcacactggaaacaaggggaagaacgcgcaaacaaggagacacaaggaggttcacagacacaaaccagattct

SEQ ID NO: 575304 - DNA, 204 bp, Homo sapiens
ctatgattctgcaaggaagatgtagtactagctacatacatctgtaatatatgatattattatgttatcatgctattcgctgtctgagcactttaagattaaacctggtattaagtgcagcatactcaactagatgtagacttcacttcatagaatttaaatctgatggcactatatgcatacgcatgatacttgtgtgtgttg

SEQ ID NO: 575305 - DNA, 1210 bp, Homo sapiens
agcgtggtgtacgcaagccagctcgtagggggctgggcggtcagcggggtcaagggacagccacgctgggacggaggacggggacaggggagcccctgcaggcgccacttcttcctctccgagtcctgtctgcccttgatggagccactggtggggttacttgcttggcggtcggccactttcgcccctccctcgccagcccgcagctcccgtaaggtttgagtggctctcactgtcagcaccacacctcagtgttgagctaagtgaggacgtcccccagcaaaactgtatggacggaaggaaacgctgtgcggcgaggacggcggacgacaacgtaggccaaccggggctcaagtggtgagaagaggcagccaggcagggctggccacggtggggtgtcgccagccttgctgggtgtcccaacctgtgcctgtaggcgagcgcgctggcagggtacgtgtgggcgtgggccaggggcgggccatcattgctcctcattcccacctcactctttccccaggaaacacaatccaaaacactacttccaacgccccctgtgtgtgcggctgctgcgccaggcagctcaacccgtcctcgcatgtcttgcacgcgtcccactagagcgacacagaccgcagaatctactaagggacacccagggtgctcgcgaattgccctgcccaagcggcggaacggccaggctgggcatagcagagaagcccacgcaccacattttcccaaaatccaaacccatgtgcgacatcttgcagacagataccgaccaacaaccaccaaacgtgaacacctaccagaccgtctgcctgggcaacggtgagggcacaacggcagagcgaatcgcctggaagcgggaatgcctcggtcggtcaaggacacgcacaaaccggaaggcaccaaggcgccgccgtaacgcggggaaacacacacaggtcaaaagcagggcaaccgcacccgccggacacgctcactcaaaacgtggtgtgcccatggaggacaccagacacgacctaacgagagagaatgcacatactcaccacaccccgtgagcaggctaacgaggagacccgtacagcggcaccgcaccacagagcgcgatccacaagaaggcacacgagcaccacacaagaccaggcgcaccccacacggggccccataccatcatacagcgaccacgcagtcgcgccacagaaca

SEQ ID NO: 575306 - DNA, 635 bp, Homo sapiens
  misc_feature (494)..(494): n is a, c, g, or t
  misc_feature (510)..(510): n is a, c, g, or t
  misc_feature (568)..(568): n is a, c, g, or t
  misc_feature (591)..(591): n is a, c, g, or t
  misc_feature (613)..(613): n is a, c, g, or t
aaagtatccgtcctataatttttttttcttttttgggacacggtctctttctgtcacccaggctggagggcagtggcacgatctgggctcactccgcctcccaggctgaagcaatcatcccttctcagcctcctgagtagctgggactactcctgagcccaagcagtccgccggccttggcctcggcctcccaaagcgcagggattacatgcgtgagccaccgcacgcagcctgcgctgtgatttttaaacggtagtttctaatgtcccgtacacgtcttgtttggatgtggtccaggctgggaacatagccagcacctacaagcatatttctaggggaaaccacattctgaatttcaacttggtctgtgagttcctgctgggtttcccatctagcccttccgttttgaggaagaaaaagatagaatgatgcattttgccaattccttttacataaagtttttgccaagattgtttggaaaccacatggaaaantggggtgcaggtattnagcttaagactcaaagaagatgccaggcagcaatttactgtgtagaaatgcagctgancttgactaatcggaattgacttnggttgcaagggaaaaaactcancttcattttgggtggacaaaag

SEQ ID NO: 575307 - DNA, 136 bp, Homo sapiens
tttgaggatccgcatttctctgcgcttcacattgtccggtgctcctatcccagtcgtgcctcgtcctgcttgcaggccaggagagttggggaagctgtcacgcttgcacttgagcagtcaaataaaagccttcagg

SEQ ID NO: 575308 - DNA, 781 bp, Homo sapiens
tctttatcgtgagtaggcctagaaataaacatgctagcttcttattccagtgctaaccgtgaaaataacccctcgtgccacagaagctgccatcaagctatttcctacaggcaaggcgaaacgagatccataatccttgctaatagactgatcctcttgcaacaatatactctccggacaatgaaccataatcaatactaccaatcaggtactgcatcattaataatcgatgaatggctgatagcaataaatactaggaatagctcccctttcacttactgaagtcccagaggtttacccgaggcacccctctgacatccgggcctgcttggtggctcacatgacaaaaagctagcccccatctcaatcatatagcaaatctctccctcgactaaacgtctgccttctccctcactctcgtcgaatcttatccatcatagcaggcagtgaggtggattataccatacccagttacgcaaagtcttcgcatactccgtcaattacgcacataggatgaatactagcagttctaccgtacaaccctagacagaatcattcttagttgtagctatttatattatgctaactacgtagcgatgcctactacatcaacttaaactcagaccatgaacctataaatatctggcagctgaaacaaggtaaggatgataagagcctttagttcatcaccctctctccttaggaggctgccccgtaacgggtttggccaaaggcgatattggaagaatccgaaaaaaggttttattccgcaattaggccg

SEQ ID NO: 575309 - DNA, 1774 bp, Homo sapiens
caaacccactccaccttactaccagacaaccttagccaaaccatttacccaaaacaaagtataggcgatagaaattgaaaacatggacgcaaatagatcatcagtaccgcaagggcaaagcatgaaaaattcataaccgaagcaatcaatcatcagcaaggcactcaaccccatcatcaccgttcatgcgatcaatagacactaaaaatcagcaacatacacttatgcacaggcagcagaccgaacagcgtaaaagacgccaccagaacacaccaagaagcgagcatacatatcaagcaacaccagccatcaacaagaagcaacaaccacagaacgtcagtagatacgccaaagaaataagatgcggcaccgcatccaacatcagagctcacgacaggcccgcaccacacacacctaacccagacgaccccatcggaccgcacatcagaacaaggacgaacgaacaccacgcaaagagaaccatcctaacaagcgtcacacacaccatcagacaaaacaacgtccaagacacacaacacgcacacaacccccgatccagtacaaacacatccacacacccagatggagacgaacgaagagacaacacacgtgggctacacagcacacacacaaagacgacacagagaccaacgcaaaagacgtcacaacgcacagacaaacaacgacaacaggagggacaaacaacgagaccaccaaagcgtcacacgacacgcaaacaacagagacaacaaacgcacaaacagctacacaaacacacaaacaaagacaagagaaacggagacaccaagccacaacaacagcaacaaggacgaccaagacacgaacaacagccgccaacaagcacaaagacgcgacgacaggatcacacaaaaacgagacaagaacacaagacgagaagacccacccacatccgagcgcaaacccgcaacgcacgaagaccggagagaaaaagaacgacccacgacgagcaaccgacacgctgccacggacagcacacgacagcggacaacagaacgagtgcgcaagaagtacgcagcacacgaagccacaccacacgaaaccaaccgcggggcgacgcacagccaaagcaggcgagcgagatgaggcgtaccagacggccgcccaggagtaatatgactagagaatacacgaaggacagcgagagagagaacacaacagatgagggactgacaagaccggatacacagtaaagcaacgacgggagacaccacaagcaagatggaaaacgacaccacacagcgacgtgagaacgagcgccagcaatcccacggcaaccccaagactaccaagggcccccactagcgacgagacacccaagcgagcacagcacacacaacgtagcgaaacacacgacgtgggacaagacaccagcagcgaacaggagaaccggaccaccgaccagacagacgaccagacaaccaagcacacagtcaaaccacccaaagaccgagacacaaacaccacgaaagccccaagaacgcacgacagcacgcagataacgaacgaccgccgacgcaaccacacacggcagaacccacacaccagacacgacgaaccacacccacagacgagaagccgcgcgacgctcacaggaactaacagggacacaccgacccacgcgcataccagcagacacacgacaaagacacgaaacagcacagcacgactagagcagcaagcgagaaagcgaaacagccaaaaacgagacagcagagcccacgaacgcacgact

SEQ ID NO: 575310 - DNA, 256 bp, Homo sapiens
gttgcatctcctgggactccgctcctgtgtcctgggatgccaggtgctcactaccctgcccagctcatttttaattctgtttttggtaacgacagattctcgctatgtggcccagacgggtcttgaactcctggcctcaactgatcctcccacttcagcctctgaagagctgggattacaggagtgagccatcgtgcccagcctaaatatgggatataaggcattaagcagggacaggtgtacggttgagcggaga

SEQ ID NO: 575311 - DNA, 866 bp, Homo sapiens
  misc_feature (491)..(491): n is a, c, g, or t
  misc_feature (701)..(701): n is a, c, g, or t
  misc_feature (705)..(705): n is a, c, g, or t
agcggaggcgcggagctgggaaaagggaggcagaggaggcggaggcagaggcagaggcagagcccggtgcctgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaagtgcgccttcaacagccggaccaagacaggccaccatgaccgatgaattccactgtccgcccctgcggccaaggcccaatgcgggccaaggccatccaagaagtccacagaccaacccaatgtattcagacattgatcgtggctgccatccaggcccgagaagaaccgcgctggctcctcgcgccagtccattcagaagtatatcaagagccanctacaaggtggtgtgagaacgctgactcgcagatcaagttgtccatcaagcgcctggtcaccaccggtgtcctcaagcagaccaaaggggtgggggcctcggggtccttccggctagccaagagcgacgaacccgaagaagtcagtggccttcaagaagaccacagaaggacatcacagaacggtagccacgccaaagaaggcatccagnccangaagctgctccaaagcccagcaagaaagccaaagccacccggtcaggaagccaagaagaagctggtggcacgccgagaaagccaaaaccccaggactggcagggccagccggcaaggatccaagcccaaaagggcaaaccagtggaaccaagcaaagtcca

SEQ ID NO: 575312 - DNA, 1347 bp, Homo sapiens
  misc_feature (37)..(37): n is a, c, g, or t
  misc_feature (94)..(94): n is a, c, g, or t
agaaaaagcagtgtggactatagacaccagtgtttanaaaaaacgcaggcatggtaccaggatccgagatattcaccaggagagtagtcagatngcaccactactgcgatcctgcccgaagacaccacatcacaccgtatacatacgcatgcacaaccgctatacgcgcaagacacacttgtcacccgaacaataacagatcatagagcagactcagcacaatctgcaacaccgatgggcgctacatagcatcatcagataccagccacaggtgcaacagcatgacaacacattatagccaagccataatatagccaaggactaaccccatataccattctgccataatgcacattaactagcaacataactttgcaaggagagccaaagctaagacccccgaaaccagacgagctacctaagaacagctaaaagagcacacccgtctatgtagcaaaatagtgggaagattcataggtagaggcgacaaacctaccgagcctggtgatagctggttgtccaagatagaatcttagttcaactttaaattcgcccacagaaccctctaaatccccttgtaaatttaactgttagatccaaagaggaacagcatctctcggacactaggacaaacacctgtacagagagtcaaacaaatcaacaaccatagtaggcctaacagcagccaccaattacagacagcgtcaagctcaacaaccactacctaaaaaatcccaaacatataactgaactcctcacacccaataggagcaatctatcaccctatagaagaactaacatgttagaatcaagtcacatgacacaccttctcctacagaataacgcctgcgccagcactaaaaccacttgcaccggcaccatcaccagaccaaaaatctcacaaatccaacgcagcaagaccggcatcacccatcacacgtcaacccaacaacggcatggccacaacggcacggctaaaaaaagcaacagcgaccggacaaacatgaccagacggatgaccaaaagcacatcaagccacacagagcttgcaggcacgcctggaccaagaaacagttaacgcagcacgagacccacaaccgaaagaagaaacaaaacaacaaggaccgcaaacagggcccaagagacaatgaaccacaacgacaacacaccacacacagcaaagacaaacacgacgaccaagacagagcatcggaagcgaccccacagacaacacatgctgcgcgacaagcgagaaaaccagcacgcagccgcagaaccacggcaaagaccaacacaacagagacaggaaacactcacgcgacgaagctcagaaacacacaaagaaga

SEQ ID NO: 575313 - DNA, 1154 bp, Homo sapiens
  misc_feature (329)..(329): n is a, c, g, or t
  misc_feature (354)..(354): n is a, c, g, or t
  misc_feature (366)..(366): n is a, c, g, or t
  misc_feature (384)..(384): n is a, c, g, or t
  misc_feature (386)..(386): n is a, c, g, or t
  misc_feature (437)..(437): n is a, c, g, or t
  misc_feature (903)..(903): n is a, c, g, or t
  misc_feature (915)..(915): n is a, c, g, or t
  misc_feature (954)..(954): n is a, c, g, or t
  misc_feature (1005)..(1005): n is a, c, g, or t
  misc_feature (1020)..(1020): n is a, c, g, or t
  misc_feature (1056)..(1056): n is a, c, g, or t
  misc_feature (1060)..(1060): n is a, c, g, or t
  misc_feature (1080)..(1080): n is a, c, g, or t
  misc_feature (1097)..(1097): n is a, c, g, or t
  misc_feature (1120)..(1120): n is a, c, g, or t
  misc_feature (1128)..(1128): n is a, c, g, or t
  misc_feature (1152)..(1153): n is a, c, g, or t
caccttgtccatctataggggcccataaagttggccattcagatttcttaaggcacgttggaccaaggcggggcgatccttacgcaaggtctgggaacaaagcggcgcgcaacggagagtgaccgcgtgtcagggcgcatctaaagatagcgaacgccttgcagcccaaggagtaatagatcttctgaaatatgtggtgaattccttctaccctgtgtatcaaacgctgtggatgtaataatttgtacaatgtgaacacgagcaaacaatgtcattagaagactgaagtgactgactaacgtgcagaacgatggagcaggagcagcagntccggaagaaagatgagactaatgngaagatggagtntgaggggggtgcagagantntgttgaggaggggacctactggatgatgatgataatgaagatcggggggangaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactggctccaaaataatctcttggtatgcagggagtaccagtcttttcattcatacataagttcagtagtggcttccttaactgcanagggcatctcantttagtgagtagctcttgggaagcagctttgagtagaangtatgtgtgtacacccttacattagtgtgctgtgtggggcagtcaacacanatggtacatgtattntgtgatgagagtggcatgtcaatgcatctctagaanatantagtgtatagcttaagattngttctaaagtgtactgngggtatttgtgacagcctgtgtntggacttnttcctcaaatacagtctattaccnng

SEQ ID NO: 575314 - DNA, 184 bp, Homo sapiens
gctggctgctcatccggggggcatcgggtcgtgtgggaccaagccttgctgttgcgccaatgttggtcgtgttgtttgctggccagccaatgcaccttcgcagcgattgcttgccatcaactgtgccttccattctggtagtcggtttcactcggggcgacatgggttgagtgggctcgttgtc

SEQ ID NO: 575315 - DNA, 170 bp, Homo sapiens
tggtcggtacctctctgtggggtgtggtttggaaacgaggttgttcataagctgctctggtggccaccatgcagtgcaacggtgactgtcagaggccacctgcttgacatctccatcaccaaatctccagtgaagaccctgtttcctatgtgaggccattgcccagccca

SEQ ID NO: 575316 - DNA, 609 bp, Homo sapiens
cctgtccctgtgtatcttgtccccctccgtgttctgttgttgcccatcgggctaccgttgtcctgggcactgggcgcgccttcgagccctcttccgtggaccgaggtaccgtttgcaccttctgctgcaggtttcgcacattcccacgtcagatgtcctgctcttggcatgcttcggggcatcttgagtgcggagtcatgtgtgacctgatcctgggaagcccctgaccaacatcccggcccggtgcccgccctcctccccaggccacggttctatcgacggaacagcagtcagctcggagcagggccctcgcaggaaagcctgcaccgctgtccacagagcccaggggcccaggatcccctcgccaggacaccccgcaagcccccggtccacccagctcctgaagagcagctgcgcctggctctggagttgtccattcacgggatcaggaggagcgggaccggcgcgggcagcaggtaggtaggatggacttacagcggatcctgcagctgtcactcactgcagcaatgagccatagtccccgggagggctggccaggccacacctcctgcccgcttgtgtaatttatttatttataaactctctgcc

SEQ ID NO: 575317 - DNA, 958 bp, Homo sapiens
cacttggacccggtcccgtatgttagccgcgtaaagtgctctggctttaccccactgacctacctggtattcaatctctctacgcgtgccggtaatctatgtcgcctcttctgttgtcttagcctgaagggagatctgtccgtacctgcacatgctcactgtggcgtaacatgttgagactaaattagtgttttggatgtgtcctttctcttctagtagaacaaggttcacgtcttcatgcccgtgcgagtgctcgtattgcccaagtgtttgcaagagcattagtgcatctagtgttctaagcataaagtaaacttcgctagatcatcaaaaatctcgtagctcttcgccaatcttcaagacctgtccatgaagttatcctgagggagactctaccagagacagagcagagaactcgatcctagatgcatgagtcatataatggtcatgcactcgtgagtctcgtgagcatcgagttcgagagtgtgagagagagacgcgcgatgatgctcactctaatgcttagatcccatgtcaggcatgtaccatactctgcactgtacgctgcaagccatatgccttgctgtgctctcaactattttcccgatagttggtctgtggattagcgggttgatgaggtcactggcctgtgttcagagctcgcaagattattgctaaaatgcttcaccatagataagagtctctggattaatccactcctttaaatgaagccatggtaggaatacagaacttgtaacagaggatgcaccgtagaatcattaatgatggccaagagagttggggcgggggggcacgcagaaaaagttggaagctttttttgcccctttgagaaaactttctggccattttaaggtttctaatctttttccagggccaaaaacccaaatggggtattccttttcataccaaacaatttttcaaattgaaacccttatga

SEQ ID NO: 575318 - DNA, 170 bp, Homo sapiens
gtgacccctaatcctgcccgccagagaaacaacccccctttttcctttacatacccaaatcctataaaacagccccacccttatctcccttcactgactttcttttcggactcagcccacctgcacccaggtgaaataaacagctttattgctcacacaaaaaaaaaaaa

SEQ ID NO: 575319 - DNA, 149 bp, Homo sapiens
ccgagcttatacccactcttaatgtttccatgtcaggtagcatggcgggccttaacacacacacctctgctgttccgcaggactgcagtgaaacaattccaggccatgcccccaggcagcaatgtgctattgaaacttctaaaactagg

SEQ ID NO: 575320 - DNA, 225 bp, Homo sapiens
ctgaggtgggcagctatgaattcactactctgaccactgtggctgcgtggtgtcatcgagatacaaaggtcgcaagatccagctcctgtgatctcccaggtattattgaagggtgccaggcatgcgaacggtagaggtcgtcaagtcattgcagtgggccggaacctgtaacttgatcttgatttgtttcttggtgtcctgaaacctttgggacgtaagaagata

SEQ ID NO: 575321 - DNA, 352 bp, Homo sapiens
tatgtggtgctcatcccccccccctctaaaaaattaaaaagttagctgggtgtggtggtgcgtgcctgtagtcctcgctacttgggagggactggggtaagaggattgcttgaacccaaagaggtcgaggctgccgtgagctgtgatcacaccactacactccagcctaggtgacagagtgagaccttggctcaaacaaaacaaagtaaaataacaagatacaattttaaatcttggtcaacttagtaaagatagcaaagaaagccagccgagtgcagtggctcacactgtaatcccagcactttgggaggccgaggcaggtggatcacgaggtcagggagatggagaccat

SEQ ID NO: 575322 - DNA, 374 bp, Homo sapiens
gccccaaattaaatcacacacctacagccaactcatctatgacaaaagaggcaacaatatccaacagagaaaagacagtcccttcaataagtggtgctgggaaaactcgacagctacatataaaggaatgaaattagagcacttatcctaacaccatatgcaaaaagtcaaaatggattagtggcctaaatataagaccagatagtataaaactcttagaggaaaacataagcccaacactctctgacataagccccacagcaaaatcttgtcagatccacctcctattgtcaacctggaaccggtacgattgataacgtgtacgacaatgtgacgggcctggtcaaagcggtcatcgagatgtccagaaaaat

SEQ ID NO: 575323 - DNA, 218 bp, Homo sapiens
tgacttagaggatcccaagctccaacaagatgagctgcagccccccagagagagctctgcacgtaccaagtaaccaggccccagcctccaggccccaactccgccagcctctccccgctctggatcctgcactccaacactcgactctgctgctcatgggaagaacagaattgctcctgattgcaactaattcaataaaactgtcttgttgggagctt

SEQ ID NO: 575324 - DNA, 420 bp, Homo sapiens
  misc_feature (284)..(284): n is a, c, g, or t
  misc_feature (376)..(376): n is a, c, g, or t
  misc_feature (403)..(403): n is a, c, g, or t
  misc_feature (417)..(417): n is a, c, g, or t
tcagaaatcttgggtaaccaggggcattgtcaataaacagtaatattttgaaaggaatattttctgagcagtaggtcttcaactgtgagcttaaaatattcagtaaaccatgctgtaaacagatgtgctgtcatccaggctttgttgttccatttgtagaatacagtaagtctagatttatcatgatttttaaggccctagaattttcagaatggtaagtgagcattggcttcaacttgaagtcaacaactgcattaggtcctaataagagagtcagcctgtgnccaggaaaggtggccgccccctcgcccgttcacggcaatggcatgttcgtgggggaacctgggtggcttaaactatttcataggatggaccntgcttctggggttccgggtttttgttntgtaggcagagcgnctt

SEQ ID NO: 575325 - DNA, 1138 bp, Homo sapiens
  misc_feature (307)..(307): n is a, c, g, or t
  misc_feature (1138)..(1138): n is a, c, g, or t
tggaaacggattcccgctctgtcccccaggatggagtgcaggtggcgcggctctcggcttcacgtgcaaccttctgtgccctccgtgggtttcaaaggtgattctccgtgcctcagccctcctgaggtggcgtgggaatgtgcaggtgtgcccaccaccacacccagcataattttggatatttgtgggtaaagacagaggtttctcgccagtgtgtgtggccgaggcgtggtctccttgaaactctcctgtgaacctcgagggtgaactcccacccaacctgtcgggcctctccccagaggtgtgncttgagaatgtgcgagcgctgtgaagccaccaacaaccttagaacatgagcggtggggtggtaactcttgtgaactcacacatagtggggcttaagagggtgcggtggtgtgtggccagaggggtatctctctcccactgtggtcaaaatatgtgcaggaaactatttctccgctgtgtggtgacaaaacttacacaccagagaaaactcttctcgccacttttgtgaaagagccgtggtgtgtgaaaagtgatctttaaatcttcttttaaaaaaattttgtgtgcgctataagggtgggattttctaaatttttctcgcaatgttcatctacgagaggatggaaatctcggtgggcggctgataatataaaccggagggggtattataacacctggtgtataaggtgccttttgtggccctataaaaaaaaaaagaagcagagagtaaaaagaaaaaactgctgggaggagggggcaatctcttataatgtgagatacagggggtgtggcgggcgaaaaacaaacaacggaggggtggtcaatacttgagacaagtcgtggggcggcccccacaaggtgggtggctcaaaagaaaagcgatggtgtgtactcccagatggagaagcccccacaagggtgtttccgatcttttggtgtcacacaaccagggggggggggtggaagaagaatcactgggcgcgcgcggggtgtgaccccccccccattaaaaaaaggacgagacggacggcaaagaatcaaaacacttccgcaacgaataaacaagcgccaccggtggtgtacaacccacggggggactataatctagcan

SEQ ID NO: 575326 - DNA, 434 bp, Homo sapiens
tggcggagggcaaggcgggagacgagaggcctgaaaggtcgcagctgatgctggagccgccggtaggacctgaagaagaaggcagagaaaagcctgtgaaaaactaaagactgtttcttccagtaatggacggggaaagttccagtcgcagcgctgagaagcgatcagcctgacagcacacgaaagcctgggccggaaccctccccaaacaaaaaagtcctagcaaaagatcgtccaaggttggatttgccataggtagtcagacgacaaagaaaggcattcaagcccaataattcgcaagttcgaaaaagcgttggggggcaatttccaaaagggttcaaaaggcccctttaagaaaggaaaagagcgtgggttttccccaaaaccttccttgacttccctaaaaagaactcttttcaggtagcagacacgct

SEQ ID NO: 575327 - DNA, 193 bp, Homo sapiens
tcgcgtcgttccctgtgccccggccttgtgtgccgtggtgtgcatccgctctctgccgccttgtccctccgtgcagctcccagctgcagttccgtgcctcgtgctcccggaggcagctgggcacccaccaggccatgtgcccacccaccgctggcccacatttttcccatgttttcagtcacagcacgcagca

SEQ ID NO: 575328 - DNA, 2203 bp, Homo sapiens
  misc_feature (660)..(660): n is a, c, g, or t
  misc_feature (1925)..(1925): n is a, c, g, or t
  misc_feature (2050)..(2050): n is a, c, g, or t
  misc_feature (2104)..(2104): n is a, c, g, or t
  misc_feature (2112)..(2112): n is a, c, g, or t
cccagcagcccacatgtgttcaggacgcctcccttgccagcgcagcgtcgcgcgtgtacgtatctgatcgaccagtgatacagtgttgtgccctgtgatgcgtgtggtgccagcagtcgcctgaggcatgcctcgagccgaggcgtcaagtcgtaatactaggtacgagtcatcatgcggctcatgtacgttaccacttgggcgcggaagtatccacgagtggtcgtagtcgcctgtcgactatacaacgtcgctactatgcgcacaccacctcatccactggacttacgtatatgcatccattcaagactcggggttgcgcgaggatactctgtgtgagtggagccaagtccttagcgtgcaggccattggggacatgggacactgggagacgggcaagtggattcactccctactcatttactagccagtgcacgagcttccctagtgcggtagagagtgcccatgtatcacgcccgcaatgttcccccatcataagccacaagcgcccataggcatacgtcttgcaaatttgggctaaggtcagtatgggaggaattccatgcgtctcaaaaatcaatgctcgtccaaccgtggttgcggcagggcatcccgtaattctcgaaggcaatccactaagtgcacctcagaggacctttntgtccgccaacggagcggagtccgcaggacggcactccgccgtggggccttaggtgaggacccactaagggggcgacaaaccttttgggcgcagtcacccaaacgcgtaaccagagccggacgttgccaaccaacacaacctaaagctatttgagtgttggtcgcgtcccattggaggaaaacacacaccgcgccaccctacgtctgaaccaaagagttgcatgtggttatgagacaacatacgggttagacaacgagatgacctctcacatttggaaccttcggcggtctcgcaaataaccacgggtaagcagccaatccaccccaagagacaggtacttggtgggcgacccaaaccggaagggacaccaagagacaaaaacggcaacagtcgggcagcacaaagaggacacgggactgggtacgacatacgatacacgcccacagagaggagagcagaacacgcgcggtggagcacaagggggacacgccaccccaagcagatatgtaacgaccaccgcgacaggcacccaccgggggcggtaactgatagacagaggggagacgcaccaccgccaagtgggagggcgaggatcggactaacacaccaagacaacaatgagactacgggtaaaagagggactaattggcgacacaagatcggtgagagaacaccgaacgagccatggtgtagaaagcagacaacagtaccgcacggaactacacacgcgacacaaaaacaaaggtcagcccaaaaaagacgaccgacagacacataaccgctccacgacatgagcgacaccaactcacacagacaacacgagcccagccagcgaacacaccaaacacgacgtacgccagaacacatagacgagcacaccaacagacacaagaggaacgagtcgaaacggacgccactcgaagcggaacacaccacgacaacaaagacagagcccagcacagcgaagagataccagcgccatcagacgaccgacagaccacgctgactgcggaaacacacgaaggatgccgactaccacacacagaacagagcacgagctgcgacacaaacgacacgcacagcacgacagacactgcgagacacgcgcgagccaccaagaccaggtgccggatcaaccgacacagcaacgcacagcgacaagacgatgcgacggctacacgagacgcacacgacacaccaccacactcgaggctgggtgcgaacactgacctgcagagcagctagcacgacacgacgcacaganagacgcagacgacatggagcagaagacacagacaaccgacacgacggacggacagacaccacacgagcctgctccaggtgagagaggcagcacatagctagacactagagcacagacgaagagangagtcaccaacagagaaccagcagcgcacacgcaagcgacgacagcggcaaccncacgagtngagcaagttgacacagccacactactaccgcagcagacactatcaaggaccgcgtagagctgacgagccaaggcgagactcagaacagcct

SEQ ID NO: 575329 - DNA, 104 bp, Homo sapiens
gccgatggatgataattgttgcgcagcaactacgtccacaagatctgattgagagaagtgtatggtcattcggcgtgtgcatgtatggatgctcggcgtgtgca

SEQ ID NO: 575330 - DNA, 470 bp, Homo sapiens
atcgggggtttgattgaggcgactcctgggctttatcagctcccctccgggcccaaccatgcctggaaggccaatgccataggccggggtgccaagtcagggcgtgagttcctggaaaaaaactattctgccaaagccctttgcacagatgatttgcccctttagctgggtgatcaaggccctcctggaagtggttcagtcaggtggcaaaaacattgaacttgctgtcatgaggggagatcaatccctcaagatttttaatcctgaagaaattgagaagtatgttgctgaaattgaaaaagaaaaagaagaaaccgaaaagaagaacccaaagaaagcctcctgatgaataaaatgtctttgcttgtaatttttaaattcaaatcaatcatggatgggtctcgaggggtgggcctttcccttccctttattccccctgggggtcccccaataaacttccgtttttttta

SEQ ID NO: 575331 - DNA, 190 bp, Homo sapiens
  misc_feature (42)..(43): n is a, c, g, or t
  misc_feature (116)..(117): n is a, c, g, or t
  misc_feature (183)..(183): n is a, c, g, or t
agccagtatggagagattgcaagattacctagaaagttaccnnaaggctatgctctggaatataaagaagaagctgggatcaggcttgcttcctacaggagaagcaagaagaaggnnaggacccagaggacacccccactgctagcaccccagagagtgaggagtggagcagcagccagcctngtacggt

SEQ ID NO: 575332 - DNA, 588 bp, Homo sapiens
cagacctagaggatccccattgatagcggataggggtatatcttggaatgtgtgtcgagagtaaactcagcagcctctcagctgcagctcctggagtgtattaggactggaaacgactcagatcatttatgaagtctatgctttccgttatagaagagaaaactgagggctaatacaagggctatgacttggcccagggtgcttaagcccaggagcttgggctagactattccaagctatcctgcagtttggttttgtcacaaaccccaggcaggaagttgtctgacatacagacttagctgaggaattctatattcttcaaaacagagagaattctggaatgagaaagagtggcctttcaaattatgggccttgctgggggaaggacaggggcccttcttctggggtggggaatcctgattcatttgtacttaccttcacagcccttagggctgcgtgttgccatgcggtgtgagaacccaggagtgaagtcaccatgtgctcgggttccttttgtacctcaattggtgatgtcagaaacaaaacaagcagcactccgtctactggggtgcaggctttttcgggggg

SEQ ID NO: 575333 - DNA, 467 bp, Homo sapiens
  misc_feature (222)..(222): n is a, c, g, or t
cggaacttagtccacccggatccggtggacttttggagggccgaacttgagccctggcccgcccgcccaccaatatgggcccccgaattttgggaatatcttgaccccggaattcggcacatgtgatcacgctacacgacttgtcacccgcttcgagcacggcgcgcctattccgccacacgcttttcaccttaagggaatcccccatggttttgcgcccgnactttcgcggagtctttttttcgcgtggtgcccccgtttgtagtgttttatcttatctacaccactgggggactcgaacgagtttcgagagatcccaagaggagagaatccacgctgcctatgagaaatgagccaatgaggccacgcatcccggatgacggttccctgtttttgaaagacctttttttggaagaggagtctgcattgtagtgtttccaagacaccataaacttcctatggtctta

SEQ ID NO: 575334 - DNA, 160 bp, Homo sapiens
ctccataatgtgtgcccactaggcactcgcattccacgcccggctccacgccagcccagcactttcaatttccttcaagaactttacctttgcattcacaatgtgactaagtgtttagcacaagagacctagccttcagccagtcttgcattttgacatg

SEQ ID NO: 575335 - DNA, 109 bp, Homo sapiens
gatacaatcgagccggtaccctcaagtgattctgtgcctcagcctataagtagctgggattataggcacatgccaccacgcctggctaattttgtatttttaataaaga

SEQ ID NO: 575336 - DNA, 428 bp, Homo sapiens
tctagaggatccctgagagaccgtgtgaatgttatactgataaaaggttctatacacacattatagagatatgtgtgtgtgtgtgtgtctgtgtgtgtgtatatatatatacttttttccccccaagatggagtctcactctgtcgcccaggctggagtgcagtggtgcaatcttggctcactgcaatctccacctccctggttcaagtgattctcctgcctcagtttcccaaagtgctgggattacgtggcatggcactcgcggccaagacagcttcgtatcccctaggttctgatgaggttctctatggtactgctctcagggtataactgcagactagaagactgtacagcggtgctctagaactggcttcgtccgcaacagtgtacctgtgactggcatggcaccagcggctctcaggtaccga

SEQ ID NO: 575337 - DNA, 194 bp, Homo sapiens
ctgcctcagcctctggagtagctaggactacaggtgcgtgccactatccctggctaatttttacattttttgtagagatggggtctcactattgttactcaggctggtctcaaacagctggtctcaagggatccatcccgccaaatggttccaaaagtgctgggctcacaggcattagccacacgttcggctgt

SEQ ID NO: 575338 - DNA, 184 bp, Homo sapiens
ttggaattatatctgcgaattcgggagtggcattacatatcaatattgaacaagatagcaactatattgaccgagcaacaacaaggtggtcgcaaatttgtctcaagggaagaagcaagccatacaacctttcctggttctttgataccctcccttgcctgccacttagaaactgaaacggaaa

SEQ ID NO: 575339 - DNA, 81 bp, Homo sapiens
ttttcccccgcccccccccttttttcccccaaggttttgcccctgtgtttttgtttaaaagggttggggaggggcccccca

SEQ ID NO: 575340 - DNA, 373 bp, Homo sapiens
tgaatcatttatgggtaagttaaatactttatagcccccaaaaattcattgttttttctccaaagaaaaggctagtctcttaccaaggtagtaactcgatttcatggctggatagttcggatagtggtcgtgaaacctggacatgtaacatcagaaatctgtacaatttgcagtcttaaaacatctgatggtgttaaaacatcctccgtccttcctttcgcggatagcatagaacccaatgagggaagctcaaatgtgcacgtctatagagccactgtacagcctcagcgagctgctcactatcagaaaaaatctcgcatgatgatgtgtatcctgtagcttgtcctgtcagtgattattctaatattgggac

SEQ ID NO: 575341 - DNA, 251 bp, Homo sapiens
ttatctaatatctctagaagaacctgtagatctgggttggtgataaaatattaaggacggaggaatgaaggaaaaaaaaaggtttgaggaaatcaggcatattaatttataatttacattagatcttttctattatattctaataatttggttttcctaacttcataacaaaaaacttaaactggattatggattacatattacaaagtcctaaatgtggcatatggatatacagtacattctatgggtgt

SEQ ID NO: 575342 - DNA, 137 bp, Homo sapiens
  misc_feature (22)..(22): n is a, c, g, or t
  misc_feature (71)..(71): n is a, c, g, or t
  misc_feature (94)..(94): n is a, c, g, or t
aaaacccatcccagtgaccccnaacatggggccctgtcagccctcctaatgacctgcggcctagccatgtnatttcacttccactccataacgntcctcatactaggtctactaaccaacacattaaccatatacca

SEQ ID NO: 575343 - DNA, 91 bp, Homo sapiens
gcatcctttcctcctcgccggtgctggacgtgtcgctgctgctgctgacgtgccgtgccgccgccgccgccgccgccgctgctggagctcc

SEQ ID NO: 575344 - DNA, 1059 bp, Homo sapiens
  misc_feature (163)..(163): n is a, c, g, or t
  misc_feature (409)..(409): n is a, c, g, or t
ggagagcccggtttgaatgaacataagaatgaacaggatatggcgaaggccacgccatgcgtgctgcaaggaggccgaaggaagaattcaggtcaccggtcgacgtaatccatagcacgatacatcttccctgactctcactgcgagggcacctactctactncacgaagatgatctgattggcgttacaaaggtcgcgctagtaagtggtgcgttagattgactgagacatcgcttcgtgagaatggcagatgtttccgtgattacttgagcacaacgacgagatacacgtggaaggaatacttggtcgggagggataagctggaggaacgacgagggttaggcagcgagctaggcaggacgggagaacagcctagtcgtcgcgttgggtccttgttaatcatcgaangcgattatccctcccgcatgccccgcgaataaggaacgcgtgaatttgagtccctacagcatcgtggggttggtagtattgcggtgatccagaacccccgaggtaggcggggcacgcgactggtgaagatacacgacgtaggaaggatcgcgtgcgattcttgtatcatggcttgtgccgaggttgagagaaacataggtctaacgaagataaccaataggccaaacttgtggctcacctttaaacttataagagaaatttccaggggtggagagaatgggtaaatagagagagataggccaaagaaaagggaaaatccgtgcgtgagggagctaaatacaaaaatttgcccgggcgagatgcgcgatggaaggaaagggagaggttgcaacgcgcgaaacgagtgggtccccatccgtgggcccaaaaatacgagggaggggtaccacggtgaagccccagaatgggtatattactttgtgtgtcaccccaagggcgtgggatatgccaaactcttttgcccgggcgtaactatccccctattaaataagagtgcaccgctccgggtattataacatttatctggggattcaaacgcccaagggggttaccaacggctgtgtcgatttataatggaaccgtgggggcaa

SEQ ID NO: 575345 - DNA, 555 bp, Homo sapiens
atatttcagtactggctagcgttcatttacatcactgactcttggctgtcgatgatacactattatcgaggcatgacaatgactcatagcacagacataagtctccgtaattcgagccgatctagccagcaatgtaacctactagctaatgagcacatctacaacgtaatcctgtcacagcacatgcatgagtaataatcttcttcatagtaatacccatcataatcgagtaggtggcactgactagttcctctaataatcggtgcccccgatatgcgtccccgcataaacaacataagcttctgactcttacctccctctctcctactcctgctcgcatctgctatagtggagggccggagcagagaacaggttgaacagtctaccctcccttagcagagagaactactcccaccctggagcctccgtagacctaaccatcttctccttacacctagcaggtgtctcctctatcttaggggccatcaatttcatcacaacaattatcaatataaaaccccctgccatgagcccaatacgcaaaattaaccccca

SEQ ID NO: 575346 - DNA, 440 bp, Homo sapiens
tgcgggaccctatcatcctcggtggcctatgagctccgtaccagccactcaacatagtgtctgaacagaaccgctccgctgactggtagctgggtctgaggattcaggattgtggcgttattctgagaggagactttgtaattcctcgatggctggcaatgtgaagtccaggtgcctctggtggagggtcatctgcttttctcagactgtggttgtgaaccggctccttctccaagaaaggttgcatgctgacaacatccagaggtgagactcatacaccttgaaagtgactgccttcagggaggtttaacgagttcttcctgatcattccacttgttactggtttcgatactttgcccacgggtttgtttccccgtcctcttcttggaccaggctcctggtatttcaggggctggttggctgctctgaccgcccctctt

SEQ ID NO: 575347 - DNA, 1402 bp, Homo sapiens
gaattagaattttgtctttgtgtttgtgtttcgtgttaagtgtcttgtggtattttgctttatgtaaagtaggttgaagtggttgaggagttggacgtgttttgtcttttcgtggtggttgtgatgtctttgtgcctcttaattaatgccttgtgacagtgtggtagtgtgtctggttagataggtgatatactgtagtgtcttttcggtatgtttgttatatgtattagtttgttactgactatggtgttgtatgtatgaaaattttttgcatttgaggtggttttttagttgtaatgttgtatacgttctgttaagggtggtatagcatgtaggggtatgtgtttaagtgcgtttactatatattggtgttgggaagtgggcatatttggatgattgttattgctttatatgtctgatggataggtagttatttgtattggttgtttgtatgtcctattggttgatcatttgttatgtgtataaatgtctctgtgggctattgtgtgtttttacaaaaggtcgcaatggttatgtattcccatagttagtgtaggggataatggtttttttaggtcttggctatatcttagttgagtgtgtgtagtcattcgttttgagttaggagtgtatatggctgaatcgaggtattgtgccattgagacttagagtaggttttgattactggtgtgatgtgtaagctagctagtggtgataatgtttataggttctaaggaatgtgtttacgtattgatatgtaatctaagtgtgtatctggtgaatcgttggttgtggtttgattcgtgtatgtgatctctgcgaatattattcttagtgcagaatttatacatggtgtttatccatggatagggtgtgtgcagtgtatatagggatatgtgttaggtccatcagtctgaggtgcatagccgtctaacgttatgcaccaggttagtaatatatctagggtccaggacgcagtgtattatcatattgtgtacaggtagttctagtggctgatactaccttggatactcctagtaatcctagacccagcaggtgtagactgcgttcacagcatctcgtgggttctgagacaaagctctggaaaacactcacacttcatgttgtcatgtgtcatgctgaggtgaataatagcaaaactgttttcatttcccgttaagttgtccgtttcgctaagcattatgtaataggtttggccattaaatatcattgcccgtattttccctattactgctagtatgctacttcttacatacccaaaagaaagttcagttatttattgtatatttattgtattcataatatgattgaaataaatggcatggatttattttgttcctaactatttggattaaagatatagtggttcagcgcaaacaaa

SEQ ID NO: 575348 - DNA, 337 bp, Homo sapiens
  misc_feature (252)..(252): n is a, c, g, or t
aggccgcacgcgcggtcaaatatctatagatccagtttgtacatattccacaggtatactgataaaatcatctatgatgccatttttttaaatggcagttcttatatagctcgaacattaagatcaacaaattctcagatgaagtcacattaataagacacctcagaagtgaaacaaagcctagtttttactaaaagcgatgggataaacggtagtgtctaatgctgaagagcagcttcaacttgtttcccncacgagaaaaagcgccaagaatttcttggaggataatttaacaaactaagccaatacaggccaggcacggttggctcatgccttg

SEQ ID NO: 575349 - DNA, 215 bp, Homo sapiens
gccattaacggtgctagacagtataaacgtcaactggtcatctgcaggcaggccagtcacagaggaggtcctaggatttatatatcagagtcacattctttctgcagtgatattatttcttatccggatagcagtatacctcgtaaacatatagcaggaggtcagctattggaagagtaatccagtgtaacttaatctttaaggtgttatctaga

SEQ ID NO: 575350 - DNA, 292 bp, Homo sapiens
tgtcgttctggatgtccgctatgatattgcgggtggcggagtgcgctctgccgcgccgtgatttgtttctcggtgtttccccgtcctctggatattgtgcgcgccctgggtgaccttgatgttgcttcccctgctgtgagctgctgtccgtaccaagtcttctcgcaccatgatccctccagatctgctctgacttgctggactctggatctcaagatacgccatgttgggcgcggagtggtgcctgctctcccggattctgatgatctcccctgccatgccccagtggtgg

SEQ ID NO: 575351 - DNA, 1668 bp, Homo sapiens
gtgccttcgctgcccggctttcgcggccgttcgtcgctccgtgtctgctggctgccggcctgggttggtgcggagttgcgttctgtgtgtggcggcctgctgtgctcgcgctgtcagcttgcgcgaggtatccctcgtcgctttccgcgctttgcgtcttgggtggggccttgcgcgtctggggtcgggcgctgtcctcgctgtggcgcccggggctccgttggggggggccgggtgggtcgcgcctggctttcctcgcgtgtgccggttgctgttcgcgcggtgggtgtgtccgtcgtctgcttgccgttgcggcctggtcgctaagtgcgggtttgtgttgagtttcttgcgctcgctgctcctgtgtctgttgtgctgtgtccgtccggtgtccgccggggctgtcacctggtgttctggtagtggggggtcccttgtgggaggtggtcgtcgatgggccgtagttaatgctcgcgtggtgtctggattggtgcatgtcgtgtgtttagtgcgtgggttgcgcgtgggcgctggtccactggtcctggtgtagcgcgtgggctgctcgttgttgtgtttccggctgcggagcgcgtgtgctgtcgggcatgggtgcccgcgtggccgtgtgagccgtgtcgtggcgttgtgttgccggcggggttaccgtcggcgggtcggattgccccatgcaggcatgtcggtggggtgtttgttggccctgtcaagggatggttgcgtctgggttggctgctcgcccctctgggctgggtccgcgtcgtttttgcatcccgtgcgtgcccttggctgtgccagatgcttgcggcctctctgtcggggttcttcgtgtgttggtgtcgcgatgttgtagtgcgccctgtgcgtcccttgtgtttgtcctcttagcatttgtttggggcggtgcatgttgccgtggtgagtgggtgtttcgcatggtagcctttgggtgtgtggctgcagtctcgtggggctgttgatgttacgttgtcggggcttcgtggatgtgtggcggatcgctggttcttggtggtctttctcagtcgctgttgcttgtcggtgtggggggtgtcctctgtgctcgcgcgctagggtgcagtctatggtatgttggtggggtgcatatggggatatccaggttctgttgtgttcgctctaggtagtcctgcgcctgtgtatgtggttactgtcttagcctcgagatgggggtccgagttgctgcgtgggggcccctgtcgtgcgatgtcgtgagtgtaagagtaccgaaggtggttctggtagctgtgcgcccgaactgctagcccttgtagtgttggcctgtgctgatgctacgtatgactgtgcgtgtggggctctcatctgagtgtctgagtcagaggtatgctggtacctcccaggatattttgggtcgaaatgaagtaggatgaaacctacaagtactacttagcgtggtagtaagtctggtgatctagtatctgagtaatcagcctgagcggtacacagctggggtcggcgactcgcgttttgtagacttttgctgtaactagttgtaccgtaggacagaatgtgacggaggaagtaacacacagaggaggatgtgtgtgtatgcatgtgtcgtgaattcacataggatagtaaatgtattga

SEQ ID NO: 575352 - DNA, 856 bp, Homo sapiens
  misc_feature (582)..(582): n is a, c, g, or t
  misc_feature (635)..(635): n is a, c, g, or t
  misc_feature (658)..(658): n is a, c, g, or t
  misc_feature (681)..(681): n is a, c, g, or t
  misc_feature (695)..(695): n is a, c, g, or t
  misc_feature (700)..(700): n is a, c, g, or t
  misc_feature (709)..(709): n is a, c, g, or t
  misc_feature (711)..(711): n is a, c, g, or t
  misc_feature (714)..(715): n is a, c, g, or t
  misc_feature (723)..(723): n is a, c, g, or t
  misc_feature (731)..(731): n is a, c, g, or t
  misc_feature (735)..(735): n is a, c, g, or t
  misc_feature (742)..(742): n is a, c, g, or t
  misc_feature (746)..(746): n is a, c, g, or t
acccggtcatttgctacacaatgtactaggtttaaatgctattttatttcatgtttatattcatgaatccctagatatgggcacactacagcctaatattggagtgaatgcattaacgaatgagcaaaaacaacttatatactgtgtacaaaaggcttttccgcttctagagtttatctttggttcttctcatcagtgttactttttcagtcacatagtttctttgaatttcatacttgaatacgcagaaacttttaggcccccaaaataactcagatttgtgaggagaaagatactgactttaaaagcccaggatcagtaagagaccctgagattcctgaggctacctggaaaacattacaggggaagtgtatgaagaaacagtatttggaggagaaagacctagaggaactgaagtctgttagtgaagcttgaagcttgatcagccttttgtgagaacagccaaaaagcacagtgccaggattgaactctacttgtgcaggattgaaccccattagtctttttatgccagggaatggtggagaaagaaaccagctgtagttctctgttttgatatacccnaccggtatttggaaagtctggagtcagttgtaaagaagaatacaatacagatnattcatcataattgggtggtcanactggggagaccatctggacctntactttctgtaggntaatngccatagcntnatnncagggcanacatagtnaatntcctttntgtnaaaattttttaaaaatggtaatagttatgttaggatacttgttagaatctagaatgtgaaataacgtacttcatgtgtcttcttaccaaaaatacaagataggggaaaag

SEQ ID NO: 575353 - DNA, 360 bp, Homo sapiens
  misc_feature (29)..(29): n is a, c, g, or t
  misc_feature (112)..(112): n is a, c, g, or t
  misc_feature (135)..(135): n is a, c, g, or t
  misc_feature (151)..(152): n is a, c, g, or t
  misc_feature (171)..(171): n is a, c, g, or t
  misc_feature (189)..(190): n is a, c, g, or t
  misc_feature (232)..(232): n is a, c, g, or t
  misc_feature (328)..(328): n is a, c, g, or t
tgatgtggaaagagacaccaggagtaganaaactgtcctctttacctgctcagcccctgtggaataacagactaccgaagctctttacacgctcccttacaccgcttgtacnccaagaccttagaaaaaggccgnaaggaggagaggcagnnaatttggatgaattcctcnaagaatttgaaaatccannggttcctagagaggaccagcaacagcagcatcagcagcgtgnatgttatcgatgagcccattattgaagagccaagccgcctccaggagtcagtgatggaggccagcagaacaaacatagatgagtcagctatgcctnccaccaccacctcagggagtttaagcgaaaag

SEQ ID NO: 575354 - DNA, 231 bp, Homo sapiens
gggactggctctcagtaatcccacgtaaggtacctgccgtcggaagatttgaactttctacttggacaactaacacccacagtcctccaggtgggtcctaaggatcttaggagcaacgatggggggtcctaagccagggggggatgagggtctggctctcagtccctgcctcgcggggggtgcctcccccctctgcgatgggggtcctaagagccagtgggggaaccaggg

SEQ ID NO: 575355 - DNA, 558 bp, Homo sapiens
gagaaacgggaaaatcctcccgccagtagaaagtgcgcgaaaactggcgtgtcccctgggtaccttctctgggtactctacacagcgctaacctcgacgatgggaacacatcccgcccaggggttccgtttttggcccccttgcgccctagtagggccctctggggccgggtacagtaaaagtttcttgttgcgtcgtgactctggccccattcgatgcactctaaacacagctcgacctcctgccctgtagctgcttgccatagtcagagaaaccaggatccaagaacgagatacggaccaaggcgagctgctttagccttgctgatggaattcaagaagggtcgtacatacgttgcaggaggtgcacgtcgcagaggcctcctagcagtcttgtccagtctttgccaggagagatcccagttccaggatgctctgctctttgacttgcactgcctcttcatcgttttcctgaatgtcacgcttcacgatggagtggaggatgtcgatggaggcctcccggtcggtgctgagtagagactgggctctctggaactcc

SEQ ID NO: 575356 - DNA, 104 bp, Homo sapiens
gtggttagaagctacgggaagcagtcagctgaatgaacactgccaaaatcattccacaagagcagtctggatactacattggaactctagacactttagtcaac

SEQ ID NO: 575357 - DNA, 477 bp, Homo sapiens
  misc_feature (392)..(392): n is a, c, g, or t
  misc_feature (397)..(397): n is a, c, g, or t
agctggtttcgccaaggcctttcaagtagagactctaggaccagtccgtgacaagcacgccggccggactgctccgggtcccagaccagctcgtgcgggccagagccggggacatggctagggagggatccccgggggcccggctcggccactctcccaccgtacgctggtcagtccgtgagtcagcagccggcgagggggttcgtggatatgctcaagccctcccacaagagtgagacctgtgagattatgcgtgagtctgagcggcctgtgcccccggcccggcccccctcacacagtgagtcagcagcatcagagccggctagccggccccctctccgctgccgccgaccgacataagccgagctgggccgcgggggcgagtaggcagngcggngagctttaccgatggagtggaggatgtcgatggaggcctcccggtcggtgctgagtagagactgggctctctggaactcc

SEQ ID NO: 575358 - DNA, 300 bp, Homo sapiens
gtctccaccccaccaggcaacccatgatatgctttatgtaactatacattaatttgtatttcctagaattttatataattggaatcacacattgtatattctgttttatctggcttctttcactcagcaaaattattacgagattcactgacgttgtagcatgtatcattagttcattccttttattactgagtagtattcaactgtagggatacaccagtgattttacccattcccttattgatgaacatattggttgtttctagattttggctattgcaaataaagctgatatgaaca

SEQ ID NO: 575359 - DNA, 711 bp, Homo sapiens
gaattatctttgggcacaacaggattacagctgagatggcaggatagaacaacaccaagaagtcctcgttgtgagtgactgttattcgtggaagttctgtaactgtaccagaaattgcaaggagtcctttggttgaaggatgatggcaacgaagtcctggaaaaagcgttatttactcttgcgagcatctggtatctactatgttccctcaaggaaaagcacaaggtctctcgggatctggtgtgctattctccagctggtatcatgtcaacgttacattatggcgcaggactatcggaacaattacaaagcacctacagactattgtctggtgctgaagcatccactaaatccagaagaaatctcaatatatcaatataccttggttgtgatgatgtgaggacgactgcatcagtgggtcaatgggatcctgctattggaaagtatgggaagcagctctatatgaaactaccaatgaagtcgcttgatagaggacgggacgtcaagctatgatttggacttccttatccagctccagcattaaatcgggatccagttcttccagcatccagagtctcagatcagacactccaaatcagtctgatagcggagtttctgacaaccagccagacaggacacgtccgttccagagcattgtgagctccgtattctctgaaggctggaacgaggcactcagttggaaaagtcaca

SEQ ID NO: 575360 - DNA, 404 bp, Homo sapiens
tgtctccactggttgttacaagtcttgttcagtggttacttccctgacactggctgcctccctcccagcattggcagtgactgtcattgccttagttaattttttctggtttggtttttgtttggtggtatggttgttggaagaagcgttttagtctgtggccaaggttgaagtgcaggggcgcaatcaaagctggctgcagccttgaagtcctgggctcaagcattcctctaacctcagaaactaaggactacgggcacttgccaccaggctgggccttctaattaatttctgtgtcaacaaatataaaattcaggcctagagaattagttgggtcaagaaattacagagggattatagatatccattaattcaatgggaaacattaagtcatcattcagagt

SEQ ID NO: 575361 - DNA, 253 bp, Homo sapiens
  misc_feature (11)..(12): n is a, c, g, or t
  misc_feature (35)..(36): n is a, c, g, or t
  misc_feature (53)..(54): n is a, c, g, or t
  misc_feature (56)..(57): n is a, c, g, or t
  misc_feature (70)..(70): n is a, c, g, or t
  misc_feature (76)..(77): n is a, c, g, or t
  misc_feature (79)..(79): n is a, c, g, or t
  misc_feature (81)..(82): n is a, c, g, or t
  misc_feature (87)..(88): n is a, c, g, or t
  misc_feature (91)..(94): n is a, c, g, or t
  misc_feature (97)..(97): n is a, c, g, or t
  misc_feature (113)..(113): n is a, c, g, or t
  misc_feature (120)..(121): n is a, c, g, or t
  misc_feature (157)..(157): n is a, c, g, or t
  misc_feature (208)..(208): n is a, c, g, or t
ggttatgtttnnggggaataaacccactgtgtttnnggatggggggctttaanntnnctaaggggttttntttttnncnanntactnntcnnnnttntaccctgtttacttgnatttttnncccactcaactgcacaaacatttttgaatcatctcnatgaattctgctttccaatttacatttttgcccttttgtcttttcctcttngctgttaaacttcctgaaaaaataaaactagttgattcacttctt

SEQ ID NO: 575362 - DNA, 402 bp, Homo sapiens
cccatcccattcaagcatagctggtacacatatctaccttcagatgttagaatatggcttgcattgcaatctggaggcattgaagtttatgtgatctctatagcaagtctctacctaacctgtgtgaagcaagtccttaagtggagaatcactaatgcttagtctctcccccactaggtacggagggcaccagcgaagcttcagggatgtgggcgtgactgtagagtgctgtgtctgcggtgggaaggccagggaattggaggcatgaatgcagagaaaagaggaggccttttgttcttggaaggactcttctgggtcagttgtaacctaagcatttatggttatttcccctctgctggataattttccagggaactctagctggtggaagggagggtaccg

SEQ ID NO: 575363 - DNA, 832 bp, Homo sapiens
  misc_feature (206)..(206): n is a, c, g, or t
ataactcccctgggccgacccgcttgatgtagtctaccatcttggcaggcgcactcatcagaggcgctgagagctcgcactgatgaataagctgcagtaggcctagtaaataaacatgcgtagctgttatgcccagattcgaactcgaaggaataataaagccccatcgttcgacaagaagcgggcctagtcgatagtagtttccntcatcagcagaagcaatcctgcatccgataagtcctttcttaaattagcgtatccatcttctcaacacatatacattctcccgtgaccaagtgagacctagtacatgcaattacttacccaagtcacaatatcgtcactcgatttggtagagtctagttaatggcgtactagcaatgaaatactgaggaatagctcctccctattccacttcatggaagtcccaagagtgttcaccctacaggtcacctcctcttgcacatccgtggctgcattcttctcactatgacaaataacttaggcgcggatctcgatcatattagcaaatctctgcccgtcactagtcgtgaagtcttgctcctcactctctcaatccttatccatcatagcaggcagctgagggtggatgaaaccaaacccgagactagggcgaaaatctgtagcatactcctcgatgtacccacatggggtatggaatagtcagccagtgctacctgtacaatgcgaagataaccgttccttaatttgcatattatgttctactaatactaacggcgttcctactaatccaattaaaatccgagaaaccagaacctgttggtatatcgcaccggaaaaaggcaacccg

SEQ ID NO: 575364 - DNA, 476 bp, Homo sapiens
tggaatccatttcctatccccatagtgtcttcctcacttacatttggatagagtgtagtcctctagctgatttcactgtattttatataggtatgcctctctcagctaaatggtctctcctgaactgccaccttcaggggtttccaggcaaactacaataccatctttcctctgtgcagcgtgcattcatgcattaaagaccctgtttccagttatgttttcatggtgaactggcatgtattcctccacctttatccttcttatgcaggccatactcagtgaagaggctcagatctagagtcacaccactcaggttcaaatcctggctgacacttaatccctgaaatctgatgctatataagttctagaatctggctaagtctcagtgttcttagtcaccagacaggaactagggcttcccacgaggctaatgcctggtgacaatgtgatgcgcaataaatactgtccaatcagac

SEQ ID NO: 575365 - DNA, 187 bp, Homo sapiens
ccgcccacgcaagacgaaaaaacaaaaaacaggatagaggcagcaaacacaaattctgagggagaggaaagggacagttgagtaagacggctgggggaactgagaagcctgaggtgatggaaactctgccttaggcctcctcttcggcctcctcaccgaaatcctgctcctcgtcttgcggtgtctg

SEQ ID NO: 575366 - DNA, 123 bp, Homo sapiens
  misc_feature (82)..(82): n is a, c, g, or t
  misc_feature (107)..(107): n is a, c, g, or t
gcggtcgctctacgacggactcccccctctttcctaccggacgacacgacgggcctacttctcctacacggacgacacgacnggggggtacccggacgctcgacacnttcgtaccactcactg

SEQ ID NO: 575367 - DNA, 924 bp, Homo sapiens
  misc_feature (4)..(4): n is a, c, g, or t
agtngaccagaagaacagaggaggcaaagcaaggcagcggagagcgcaagcgctccgctctaggatctcgcgacccccctctctcgtgtggcgcaaggtacggcctgccaggggacgaactccgccgagtgcaagaccgttggtagacacaacccgggccttaaaccgagccggaaaagatgtcctcaacgggaaccagggtaattctcctgctcaacggacattccgccatctatacccagacggtcgtccagtgtcctcgtcaacgaacagcagaatcgcgtgtggtaccctatctctcccccggccggggaccagccttgttgataccgcccccccgggaaggggagatttgccacaaaggtggaagcacagcaagccctcggcccaaccatgttcgaggaaggacgaccctcttgacccaaagactggggaaaaagtgctcgcaacaaagggccgaacaacacgaccgcgtttccacgtctgccgctggcaccccacgctccgctcgcgggggacaccgtaagcatcgtccgcgacctacaatccatacatgcagtctctgggaatacaccccacatgttcaacaccagggccaaagcgcgtgcccagattggtatcaaaaaccacaacacttccagagaaatccactcacttagctcttagagtgccagaataaccccctctcgtctgtggttcgcctaaaattgaacaagagcggcgtgtacagaccaccttacagtgcccaaaaaacagggatccccgaaacagccccggagacctagagggcacctatgagaccgcgctcattatgcactacgctccggaagattctttttctgcaagccgtcccgttgtaacaaactttctgggggaaacacttcggggcaaaaaaattggaaccaaaaggttctctacaaaaca

SEQ ID NO: 575368 - DNA, 509 bp, Homo sapiens
ctatgcagcacagacacaagacagtcactatataccgcataacggagtcaatcagcaagaggctataacactgttgaatatctatgcactcaaaactggagcaccgagacatacaaaggaaatatacttagcgctaaagagagagctcggctcccaataccaatcaatagctggagacttcacacaccccattttcagcatgggaagcgatcttccatacaaacaccatcaacaacagacaccgtcagacttcaatctgcttacacacgaccaaatggatccaatagatatatacagcacatttcatccaagggctgcagcatgccccattctttaactcagcacatggctcatcctcaaggacagaacatatgtacggtcctcaaaccaagccttacaccattcaaacacaattgcaaatcaggtccagtgtctcctctcaaccacaagggaatagcgctgcaaattactaccaagaggacctcccgaaactctacacttacatggca

SEQ ID NO: 575369 - DNA, 241 bp, Homo sapiens
  misc_feature (46)..(46): n is a, c, g, or t
ggctgagttgggtggaccacccttgaactcaggagttcaagatcangcctggcaacatggcaaaactttttctctacaaaaaaaatacaaaaattggctggacacggtggctcacacctgtaatcccagctactcggggggctggggcgggggagttgcttgagcccgggaggcagaggtgagccgagatcgcgttattgcattccagcctgggcagcaagagggaaattccgtctcaaaa

SEQ ID NO: 575370 - DNA, 1603 bp, Homo sapiens
  misc_feature (860)..(860): n is a, c, g, or t
  misc_feature (1603)..(1603): n is a, c, g, or t
gcaacggttctgatgagattggagaacttcagatgaaaccaacaatgtcagaagtaaatactgcgcttctgtgctggatgaatttcaacaggcatggcctttgagtaaggctgggggcgcggtgcacctagagcatgcaaagggcggacagtcatagcacttacaaggaactacgggtgctgaagcaaaggtccccaggatggagtggccagaagctcttgctatggagactgcagaagtgaagatgatgaagcaacagaatggattacatttccaggtcaaacgtgtaaagaaatcccaaatggagatcataaggaaatactcctgtgtgatataatgtagataacaggtcagatagaatatggacatcgttaccaagcaacacctatgagatcactgtgccccaaaggtgcgcgatctcctgggccataatgggctactagactggcaagaccaggacaacgtgccatgagacctaatgtagtctggtatttcagcaaggcatttaacgagagcctcttatgatatccttgtgaaccagcatggcagagatgtgggcttgaagtcttcccattgctacaggatatagttcgacacttcctagtgtggtgtacaaagacccttttacaggcgcggctctgtgtacccttcaacagcatttgcttgaacaaccatggtcgtgggtttactcaagtgccttggacattggaatcctctggctggaatgaccgtgggcccctgtgcatctgcgggggaaaatcacacacgttagttaaaaaagggagcacacctgtgaagaaacgcgataacaaccaaaccacaggggagtatttcagagctaccagaggggggggttagantatacatcggcggtagaggaggaaatattcgtccaagtgacaaagtgtcctattgttgtccgatatagtgtgttggtcgttacgctcgattctactaccgcaagcaagagaacaagaaacaagaaaaacgagaaaaaagatacagaacagcaggacacaacatacaagaagcagcggaaggagaaaggagcgggagagagagcagagggggggagagaaacgggaagagagcgaaagggaaaaaaggaaaagaagggaaaggcaagccagagggagcaggagggagggaacaggagcgagaggaagcaggggacgaaggcggccgcaggaggagcgaggcgcacagcggaaagagggggaagaagagaaaaagcagagagaagacaacagagagaggagggacgaggaaacaagaggaggggaaaaggggaggcgaagaggaacgacagagacaagacgaagaagagcaacgagcgcgaagaagaggggaaagagaaggagagagagcaggagagggaagggaaagagaggagagggagagcagagacacgaggaggaaaagagagaaagaagaagagagacagagggcagagagagagagacgacggaggcgaagagggaaaaagaagacagaggcgaagaggagaagaggaagaaaagaacgcgaaagaggaaggaggcggaggagagagaaggcgagggaaggacagaggaaaagacacaagaaggagaagacgggcgan

SEQ ID NO: 575371 - DNA, 396 bp, Homo sapiens
  misc_feature (77)..(77): n is a, c, g, or t
  misc_feature (101)..(101): n is a, c, g, or t
caggtggaaaaaagcgccatgaaccctggcctgattaatggttaaacctttttaaattgggttagataggccctttnatccaagtaaaaagcaaccccctnccagaatttaaagggatctgtttaacctttcctcagtcaagttcagagtcttcagagacttcggtaataaaggaacagagtgagaggcctccttccagggagagaaatcatagtttaactgcatttaaattttataacagaattaaagtagattttaaaagataaaatgtgtaattttgtttatattttcccctttgggctggaactggctgccctgctaaaagattatagaagtagccaaaagtattgaaatgtttgcataaagtgtctataataaaacttaactttcatgtga

SEQ ID NO: 575372 - DNA, 269 bp, Homo sapiens
  misc_feature (13)..(13): n is a, c, g, or t
  misc_feature (190)..(190): n is a, c, g, or t
ttccagagtttcnaggtgtcttgaaatgtctgtcagtagggacatgcgggtcccactggagattttagtacatatttcttccttccacaatttgtacagtaacagtcaatggcaaacaactacatacatgtggtggtggtgtggtggttggtgttggcccaggctggagtgcagcagggcgatctaccgntccgcggcctggacctcctgggctggggcgatcctcccacctctgcctcctgagcggctgggaccacaggttcaagcta

SEQ ID NO: 575373 - DNA, 746 bp, Homo sapiens
  misc_feature (365)..(365): n is a, c, g, or t
tggtaaatataccgtcatatataagctaaaatttctcttagggtgggggggttggctggcagggaaagggacaggttgaacctacaatggcttatgtaataaaatcctaagggggggacaaagacgctgaggcagctcttacgcctggaacgcaaaatgaaaagggacacctcgcttctggacttactgttgtgtacgtcacaacaccacttagggagaatgtctggtggacacaacaccacggattcaagaaatactccataaatatttatacaacgcttggtgaacacgatataatctggagatattcactattgtttattcaatggggaacaattatctatccaaatataatgtcacccctntatgggcatctaaatctggcctggaggtttccatattcccgctattggaggatcctccagatgtcaagaataacgccttttagcaccaatttgtggctcctggtggtaaagtacacaaacgatgtggccatgccccgaggaactaaaacccgtggggaaagaattctccctctgggaagttggagattgcgggtgggcgctaatcaagaactttggggctaatcttctcacaacggggacttttggaggcaaaccttcaatctttgggcccaaagattattcgggcgggggcagaaaaattggagtctcggactcaggctgcatacctgtgacatttcatgattcagtatcattggattggagagcttcttatgtcgtccc

SEQ ID NO: 575374 - DNA, 113 bp, Homo sapiens
tattggtttcgagatcatatgcaaacgactacggtcagaagatgggcagcctaatggtgctcaaactcaatggactggcctcctggcggaagattttcgagacatgatgccaa

SEQ ID NO: 575375 - DNA, 406 bp, Homo sapiens
  misc_feature (340)..(340): n is a, c, g, or t
atcatgccactgcactccagcctgggtgacagagtgaaactgtatctcaacgacaacaacaaaaatttagccaggtgtggtgggcaggctgcaatcccagctagtcaggtggctgaggactataggcattcactaccaagcccagcttatttttgtatttttagtaaaaacagggtttcaccctgttggccatctctacaaaaaatacaaacaattagctgggcgtggtggcatgcgtctgtggtcccagctacttggggggctgaggcaggagaatggcgtgaacctaggaggcagagcttgcagtgagccgagatcgtgccagtgcactccagcctgngcgacagtgcgaaactccgtctcaaaagaaaaaaaaatagtacagagatttcccatgcacccctca

SEQ ID NO: 575376 - DNA, 369 bp, Homo sapiens
atgctctcgagaagtgggaaatgcagatcttcgatcgcctgttcccgcgcatttccgagatcgttcgcgagattgaccgtggttggggcgaggacatgaacaagcgcggtgtggacggtcaaaccatcgagtacatggccccggtggcggactcctggtacgggttccggaaggacaagatcgatgagttggccctgtcgctgaaggtgttcgagtgaccgacccacggatcctgatcaccggttcccgtcagtatgatcgacccggcatcatccagggagccattctcagtgccaaaatccgtgcggacggcggactcggacgttcagccgggttcgggccgaatctccgattccccatcggtgtcat

SEQ ID NO: 575377 - DNA, 158 bp, Homo sapiens
aactgcacgctgcagtgagctgatgtctcactgcattccattctgggcaacagagtgagctcctgcctataaaaataaaagacttccacaagataggacatagacacggtaggcaggaacaatccaagtagtaatggcggccgagaagctgtggcggg

SEQ ID NO: 575378 - DNA, 85 bp, Homo sapiens
gcggccgcctactactactactgctcgaattcaagcttctaacgatgtacggggacatgctgggttaataaatcatctcattcgc

SEQ ID NO: 575379 - DNA, 300 bp, Homo sapiens
aaattgctgaaaacaggctgggtgagctggctcgtacctgtgatcccaacactttgggaagtgaagttgggcgagatcacttgaggtgaggagtttgagaccagcctgcccaacatggtgaaactcgtcatctactgaggatagtaaaattggccaggcatggtggtaggcgacatgtagttccagctattcaggtagttgaggcctgaagaattgcttgacactggaggtggagttagcagcagtcgagattgcaccactcactccagctagggtacaaacgagactcttctcaaaaaa

SEQ ID NO: 575380 - DNA, 208 bp, Homo sapiens
atataaaaattaataaaatttattaaaagtatacatcacaaaagaacaataattgcaacacaaacatcgacaaaaaaaactattatacatatctattaatgatcgaatagccgcgtaaaaataaattcgttaaaagaagtaaatctaatccataaaactaagatacaaaatttataagaacatttgaagaaaactaaatccatttcga

SEQ ID NO: 575381 - DNA, 410 bp, Homo sapiens
  misc_feature (17)..(17): n is a, c, g, or t
  misc_feature (31)..(31): n is a, c, g, or t
  misc_feature (305)..(305): n is a, c, g, or t
  misc_feature (314)..(314): n is a, c, g, or t
  misc_feature (339)..(339): n is a, c, g, or t
  misc_feature (377)..(377): n is a, c, g, or t
ttcccccttttaccttncatggcttttatcnagtgtatcctggtgtgtcatttattgcctcctttatccttgatttttttaacctttttaaaaatttgcaaaatcctatgaaagtataaatcagtataataaaactcccttggatgggcacagtggtttatgcttgtaacccccagcactttgggaggtcgaggcaggaggatctcttgagccccaggagtttgagaccagcctgggcaacgtgctgaaaccccatctctacaaaaaatacaaaaattccctgggtgtggtggtgtgcacctgtncccgagctncccgggaggctgaggtggagaatcncctgagcctggggaggtagaggctgcagtgagccatgntcacacccactgcactgcagcctaggcaacaga

SEQ ID NO: 575382 - DNA, 312 bp, Homo sapiens
  misc_feature (3)..(3): n is a, c, g, or t
ggngtgtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttga

SEQ ID NO: 575383 - DNA, 488 bp, Homo sapiens
gaagtagagcgtgtgaaccctaatgaatcagaaagtgggatcttgtcactgcaggcgtacgttgtcactatcaaacacctgttattgcggagagcagcctcttgacctcaagtcggttggcgccgggaataaaattctatcagcggcagctacgggcgtctcaactgaacaggtgttcgctagagcaaaactcaattccccgacgtgtaagcgagcgcccaaattagagtttcccgttaggcgatgggcgaacttaaggtgcggaccgatggcaccgcattcggcgaagtaggaacgagcttcaagtatcgaactaccagtctgctaagaaagcgtagcacgatacaatgggcttgagcgaggccggtctgctggcactagaatgctatctctgagcggtgctctctattagctgcttagcctcgccaagctgggtcgagtgccacaggcggtgtagtcgcatgcctactaactgctggacagcgcgg

SEQ ID NO: 575384 - DNA, 157 bp, Homo sapiens
tcagctcgccctcattagcggagcatcagtagcggtccgcctgctggggtatgttgtgtgaccgcttactgatggtcatcgaaaccctgtatgtaggtgatgtgtgatctttcgtccctcccactacaggcataacgcgttattagggtttcgatga

SEQ ID NO: 575385 - DNA, 562 bp, Homo sapiens
taccccccctttattttttgcccccaaaaacaaattaaaacccccccccctttttaagggggggggggggaaaaaaaaaaaacccaaaacccccggggaaacccccggttttggtgccccccgctttttatgcccctggatggtgtattggggtttcacatcttgccccgtgttggtttggggggtgggattgggggggtgggaccccttgtggggggcgatgggcaattgtgaagccccctttgggaaaatctcaggggggatgtggacagaaggcgccctttgtcgggctgggtgttggggggacagtggttgtggttccaaaaagtcccgggagggcgggaagaggggggggttgtagaggagcagggctccccagaggggtgtcaacaaagaggggggttgcctcgaggcgcgccaccgagagggggggcccacgagggtgcccaagagatgtgcgccagaaggacaaccggcgtaaaccaggtgggttgccaccaaaagagcgtgccccacaggggggagaagagggggcgccgtccccagacgcgagagaaacgac

SEQ ID NO: 575386 - DNA, 149 bp, Homo sapiens
ggcctgcagtaaagctctggtgaggtccgtatactgctcctggacgtgcaacagtcgggtgcgtccgacctgtggtatagtgggcgaaagacctaactcgacaccatctacgtgatctgggttcacctccgtaaggtttgctcctcgag

SEQ ID NO: 575387 - DNA, 534 bp, Homo sapiens
  misc_feature (81)..(81): n is a, c, g, or t
  misc_feature (244)..(244): n is a, c, g, or t
taggggaaatcagtgaataaagcctcctatgatggcaaatacagctcctattgataggacatagtgaaagtgggctacacngtagtacgtgtcgtgtagtacgatgtctagtgatgagtttgctaatacaatgccagtcaggccccctcgggtgaaaagaaagatgaatcctagggctcagagccctgcagcagatcatttcatattgcttccgtggagtgtggcgagtcagctaaatactttnacgccggtggggataacaattattatggtaccggaggtgaaatatgctcgtgtgtctacgtctattcccactgtaaatatatggtgtgctcacccgataaaccctaggaagccaattgatatcatagctcagcccatacctatgtatccaaatggttctttttttccggagtagtaagttccaatatgggagattattcccaagcctggtaggataaaaatataaacttcagggtgccccaaaaatcaaaataggtgttggtataaaatggggtttccccccctcccata

SEQ ID NO: 575388 - DNA, 899 bp, Homo sapiens
  misc_feature (1)..(1): n is a, c, g, or t
nagtatgacttacgttgtacgtggccttgtgtggtttcgaccactattggtcgattatgtgtgtgttgtatggtgtcttcttctgctgtggtggggggccgctattgttgtttatgtggtcgtacgattgtgttgcttctatcacttgcccgtacccactcggggaccggtccccgctggggttaccccgccccggttgtttcgcccctctatggcggtttttcccccaccgtatgtcccggccgcgaattcttttggtgggatcccgccgcctaaactttcgttttgcccacccttttacgagtttccctcccggtcccgaaataattgccgcgggttttgcccacttttccgcgggttcctttttagggggcaccaatcaggccctcaatgaatatcggggtgtcctttgggtttccccccctggcgggaaaccattgggagccccctgtctaagaaaaggtttcgaagcacccggccgcctttgtgcagacgcgggtctcccccacgcaagactcccccgtgtttacactccttgtccaggagaagaacacctggagtgttcccccccgccgtcccaggagcgcatggcccgcttaagaggggcacactcttcgtggccgcggaagcacaccacaacgaggtgggcaccccacccgcgggccaccaaacaacctgggcaaccaaacgcgtgggagagccacctgcgtggtcaagcgacacttcttccccgggataaaatgtttgcacggcccgacattccccttatgctgtcggtctcccgcacctccttgcccccaggtggtggcaaaggggggccctggttgccccgggtcccccccccggggtcttaatctgctttctccctttaaaacaaccttgggaaaacccaaaataaa

SEQ ID NO: 575389 - DNA, 802 bp, Homo sapiens
  misc_feature (47)..(47): n is a, c, g, or t
  misc_feature (72)..(75): n is a, c, g, or t
  misc_feature (79)..(79): n is a, c, g, or t
  misc_feature (86)..(86): n is a, c, g, or t
  misc_feature (89)..(89): n is a, c, g, or t
  misc_feature (107)..(107): n is a, c, g, or t
  misc_feature (111)..(111): n is a, c, g, or t
  misc_feature (121)..(121): n is a, c, g, or t
  misc_feature (143)..(143): n is a, c, g, or t
  misc_feature (159)..(159): n is a, c, g, or t
  misc_feature (180)..(180): n is a, c, g, or t
  misc_feature (694)..(694): n is a, c, g, or t
  misc_feature (705)..(705): n is a, c, g, or t
acaagcgtaaggagtaaaagtgcgtggtcagtcgatgcaggtgtaangtacgtccagatgcgtgtaaccagnnnntagntagatgnagnaaagtaagagtagtcagntgantaggtcgaanacgagtcccggtcacgagtcgngtgtgtgtcagtccgnaaccgtcagtccgcgagtaancggtgtggtgtagtggaggaggtcgtgcgtgagagtagtccgtgtcccgtgtcagtgtagccaatagccagtaagtgccccaccgtgtagaacagtatgccatgagagcgtttgccgacgcactggaggtcatccccatggccctctctgaaaacagtggcatgaatctccatccagactatgaccgaagtccgagccagacatggtgaatggagatgaaccctgctcttggcatctgactgtttgcacaaggggacaaatgatatgaagcaacagcatgtcatagaaaccttgattggcaaaatagcaacagatatctcttgctactctaatggttagaatgattttgtagatttatttcattcgtaagcctggagaatctgaagaatgaagacattgagaaaactatgtagcaagatccacttctgtgattaagtaaatggatgtctcgtgatgcgtctacagttatttattgttacatccttttccagacactgtagatgctataataaanatagctgtttngtacggagggactgggagcagttccaagaccaccccactcctggtactatatcaactgcttttgtattcattgtattaaaagaatctgtttaaacaa

SEQ ID NO: 575390 - DNA, 368 bp, Homo sapiens
  misc_feature (7)..(7): n is a, c, g, or t
  misc_feature (110)..(110): n is a, c, g, or t
aacgagnccatggcctgaagacccatgtttcccccaaagtgcccttgaagcaaataactggccccggtgcctcctcaaataaaatataaatcggggccccaggccgcggntgtcacgccctgtaatccccagcactttgggaggccaatgtgggcagatcacctaaggtcgggagttcaagaccagcccgaccaatatggtgaaaccctgtctctactgaaaacacaaaattagcctggcatggaggcatgtgcctgtagtcccagctactcaggaggctgaggcaggagaatcgcttgaatccaggaggcggagtttgcagtgagccgagatcgcgccattgcactccagcctgggcaacaggagcg

SEQ ID NO: 575391 - DNA, 559 bp, Homo sapiens
  misc_feature (12)..(12): n is a, c, g, or t
  misc_feature (50)..(50): n is a, c, g, or t
  misc_feature (94)..(94): n is a, c, g, or t
  misc_feature (329)..(329): n is a, c, g, or t
  misc_feature (361)..(361): n is a, c, g, or t
  misc_feature (376)..(376): n is a, c, g, or t
cccacgccggtntggcatagttgggcagggacgctgcccacctcgtctcnagaacgcacggccctgtgcagacgcacgccaagcaggagccctntcccgtcgtcacccctctgttggacactggggcgctgtcccagccggcgggcatgcctgtcttcctccagtgtgagaatgcgcagcccagcggctccttcaagattcccggcattgggcatttcccccaggagatggcccacaagggaggctccagcccgagggctgcctgcccccttccctgacctccgtcgtcgtaattgtgtgcggaggccacaacatccccagccgagagntgcaggctccgcaaacccacctgggccaggtntgaggggtcccatcntggccccaaagacccctgacaggcccatgcacagtcctgtgtttgcaccaggaggcctcagtgctggcagatggcagtggaagctgccctgtgccactgtgccggctgcctcctgaaggaagccctcctggactgcttcttttggctctccgccaactccggccaataaaccctttctgaatt

SEQ ID NO: 575392 - DNA, 174 bp, Homo sapiens
ttcttgtcactctcctacgagaagcattccgtatatccacgatgtccatcggtggcctgtagagagctagcttgattctcctcaggtcatagccttttccttgtttttgaaactgtgcttatagttgatggctgtgttcccactgatcccagatccattgatggaaactgtggc

SEQ ID NO: 575393 - DNA, 456 bp, Homo sapiens
tcccgctctggggcttggcgcatatttgcgcatagtgatgttagtctcatgagtatctggtcatccggagagtatagctgtagccgcgtaccatcggtcttgtctccacttctcggccaatgtgagactgtgctactccttgcttgggcttccactgtgattgggagcttcctgatggtccccggaagctgattctggtttatcgtttcatgtgcatgctacataagtgttcaaccattgaggtcttcttattcttataaattagccaggctcaggctatttcgtggagtagcatgtgctagaactgactagtacgatggtcaactgatttttgaccaggtgtgccatgaccattcaaaggggacagaatagccttcaacaaatgctgctgggacaaactggatagcaccatgcaaaagaacagaagttgtacccttacctcacaccatgatgcag

SEQ ID NO: 575394 - DNA, 171 bp, Homo sapiens
caatgaattattagcttttagtactgcgggagatttttttttttcaagagtaccaatgtgtccggaattggtgggttcttggtctcacttcaacaatgaagctgcggaccctcgtggtgttacagctcttaaggtggcacgtctggagtctgtcccttctgtcgtcttctc

SEQ ID NO: 575395 - DNA, 982 bp, Homo sapiens
  misc_feature (4)..(4): n is a, c, g, or t
  misc_feature (66)..(66): n is a, c, g, or t
  misc_feature (73)..(73): n is a, c, g, or t
  misc_feature (87)..(87): n is a, c, g, or t
  misc_feature (115)..(115): n is a, c, g, or t
  misc_feature (175)..(175): n is a, c, g, or t
  misc_feature (184)..(184): n is a, c, g, or t
  misc_feature (197)..(197): n is a, c, g, or t
  misc_feature (216)..(216): n is a, c, g, or t
  misc_feature (238)..(238): n is a, c, g, or t
  misc_feature (240)..(241): n is a, c, g, or t
  misc_feature (253)..(253): n is a, c, g, or t
  misc_feature (259)..(259): n is a, c, g, or t
  misc_feature (266)..(266): n is a, c, g, or t
  misc_feature (272)..(272): n is a, c, g, or t
  misc_feature (293)..(293): n is a, c, g, or t
  misc_feature (296)..(296): n is a, c, g, or t
  misc_feature (302)..(302): n is a, c, g, or t
  misc_feature (316)..(317): n is a, c, g, or t
  misc_feature (327)..(327): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (358)..(358): n is a, c, g, or t
  misc_feature (365)..(365): n is a, c, g, or t
  misc_feature (367)..(370): n is a, c, g, or t
  misc_feature (372)..(373): n is a, c, g, or t
  misc_feature (377)..(377): n is a, c, g, or t
  misc_feature (403)..(403): n is a, c, g, or t
  misc_feature (415)..(415): n is a, c, g, or t
  misc_feature (417)..(417): n is a, c, g, or t
  misc_feature (447)..(447): n is a, c, g, or t
  misc_feature (449)..(450): n is a, c, g, or t
  misc_feature (452)..(455): n is a, c, g, or t
  misc_feature (458)..(458): n is a, c, g, or t
  misc_feature (463)..(464): n is a, c, g, or t
  misc_feature (485)..(485): n is a, c, g, or t
  misc_feature (546)..(547): n is a, c, g, or t
  misc_feature (611)..(611): n is a, c, g, or t
  misc_feature (665)..(665): n is a, c, g, or t
  misc_feature (669)..(669): n is a, c, g, or t
  misc_feature (686)..(686): n is a, c, g, or t
  misc_feature (697)..(697): n is a, c, g, or t
  misc_feature (708)..(708): n is a, c, g, or t
  misc_feature (715)..(715): n is a, c, g, or t
  misc_feature (854)..(854): n is a, c, g, or t
  misc_feature (903)..(903): n is a, c, g, or t
  misc_feature (912)..(912): n is a, c, g, or t
  misc_feature (915)..(915): n is a, c, g, or t
  misc_feature (917)..(917): n is a, c, g, or t
  misc_feature (967)..(967): n is a, c, g, or t
tagntatgtttctgaaatatccaaataaatgttttttttttttcttcattcagcaaattagaagtnggggganttttctacacagtngctgctatgagcctgttttttttttccnaattttttctttttttcattcttttttttttctttgccatgggatgtagcaacattaggncaaaaacgngttacatgcattnatacattgtattttacagngttacaataagtgtttgtgatngnntttctcaaaagncacatntctttcntttatntcatggtcagttttgtttgtnacncgtttnctttcaacacttanntatacaaagngcaaatagnttnttnttnaggtaaaatatanggtacgngnnnngnncagngccctgttaattgttaatgagtgtanaaagcagatttnantgcttcttttaattagcttcattagtcatngnncnnnnccncagcnncctccccctccccaagatgtnctctggtggatcttttttcattttctctacagtctcccattagcccaggttcatggcgtgnntgatgttcatattcagtcattttaatacaccaataaatgcgaggaagggcaatcaagactaaanaaggtgcaatggcatggagctggcactggtgctagctacaaaagtgacttgtcnacantagacacatgggatccncctgtgatggncaaatctgggntgaaggnacgcattctgcattactctgaccttttagcagaccttctggtctggcagtagtggattgctctgaagtgaattcaaatggccattgatgagagctgtaggtctatcatgttcacaaaataaactgccattgatgttgtnataccgatctcccgggtccaggcgattccggcaggtagagcatgtatancacttaagntgntncacattgccttgcgccctcatgacgagttcactcgcaggaatcgactgtncgcaagcgctgcaag

SEQ ID NO: 575396 - DNA, 412 bp, Homo sapiens
  misc_feature (65)..(65): n is a, c, g, or t
  misc_feature (116)..(116): n is a, c, g, or t
  misc_feature (151)..(151): n is a, c, g, or t
  misc_feature (168)..(169): n is a, c, g, or t
  misc_feature (172)..(172): n is a, c, g, or t
  misc_feature (256)..(256): n is a, c, g, or t
  misc_feature (311)..(311): n is a, c, g, or t
ccgcccaccatgcccacggagaccctacagacaggtagcatggtgaagcggtcagccccgcgacncttcacctctgctgtgccctgcgcatcctgaacaaggggccagactacttncgcagcaggccgagccaaccccaagaggctcagcncgtggagaggctggagnngcnaacaaggtacgtcaagagccaggaggtgatcaacgccaagcaggagcccgtgaagcccgccgtgctggccaagcccccggtgtncccgctgccaaggcgcactgggcagccccacgctcaaagtgttcggcaaccacgncaagaccgagagcggcgtgcagagggagaacctgaagctggagatcctgaagaacatcatcaatagctccgagggctctagctcgggctcggggcacaagc

SEQ ID NO: 575397 - DNA, 111 bp, Homo sapiens
gagcatgggagagtctagctgcttagctggcatgtggcgcatgagatgcagtgagaccttccctgccatggagagtaggctgcgccccccagccccttcctgacgctcagc

SEQ ID NO: 575398 - DNA, 123 bp, Homo sapiens
acaaattttcccatctgtaatgacgaaattttgattctaaaattttttctattatttataagggcaaattttttaaaaaagtgtccagctttttaaaagtaataaaggtttagcataaatcca

SEQ ID NO: 575399 - DNA, 130 bp, Homo sapiens
ggcctatttcggatcacagagcgaatagcataagcacggcgaaggatcaggtcagttaatgtattgacaccacggtggggggcctcttctcaggctcgcggaacagtgctgaatttcctgtttggagtga

SEQ ID NO: 575400 - DNA, 1283 bp, Homo sapiens
  misc_feature (598)..(598): n is a, c, g, or t
gcccagaactgagccgcgtcacctcagatacacaggtacagtagtccagttgtccatgagaatgcggacgaaacttggaggagcgggcacgagagagcaaagagaattgatggacacccggactctccagcgaagggtgatgacgactcagtacatcatctctgtgccgagcaaaagtaacaagtagttatgcgctggtccaacagtgcccactctgggaggccttgtgttcctggtcgagcatgtggaaagtctaagaggtgacccatattcgtaccctatccactcggttgagcgttacttaggccagaaacagaggaaaagtagcggaataccagaccagaatcgagtcgtgatgcatctttttgaccgtagaacactagccatttcccagagccacctgaaggctcgtaacgttcgtggatcgattcgatacgacgcgatgcgaaggaggccgcatcggacctatggcaagataccgatatgttggagcagcacatggagtcgcacccaaacacggtcgttcgagatccattcgcgatagcggaatctcaagttcaggttacaatagggcgtagcgccattaatcattgagccngcagaacagccaaggcagaaggcatggaacttcccgcgggtcccttcctagtaaagtacgacgcgttatctctaaaaggtgctttggcatgttaggttccctaaccttaggtatccaagataaaccgccacactaacaggaaagttgatcgccccagtaactcttcccaatatcggaaacttgtagaattcctgtgagagcgaacgttaaaacacaagcgccgggcgatccgagggattggataaattatccaaactcgccagaacactttcccctggagattgatacgctggaaacgacacaactttaggcatccgcgtttcggaaagaacccaatattgctctaaagagatgttattgcccccggttgggaaatttaaggaggacggaatctccgggaagttaggcggtagcaacaccccccaaaagagcacagcgccaaaagaggaacaccacccgaataattatttactcaccagcagacagaatccacaagccgaatgtggggagagttaaactcagtgaaccaacagagaaaagggagagatccgaacgctaaaggtgaagcaacgacgacctcttatgcggccacaaagagagagggagcaactttggctcactttcactctaaagcctttggaacagcggaaataggttgtacggaatccgcggaggcgtagagcac

SEQ ID NO: 575401 - DNA, 159 bp, Homo sapiens
tgcagcaggacactgcgtctcagcttttcttaagtacctctccgtctcctgcttggccttgacgtgtccccaatgcagttttcccgtgggtgccctctcacggtccatctttgtgtcgctgactttcccatggtcgtgtaagtgatggtagtgcccggt

SEQ ID NO: 575402 - DNA, 389 bp, Homo sapiens
  misc_feature (134)..(134): n is a, c, g, or t
ggctagcgggtccaccagcaccagtagctatggcaggggcagaagatttttaattaggaaccaaaagctagcaggagaggagagccacaaaagtgacagggaagcttcaggttcaaacaaatttgtaactcaancaagcccaggggggcagggcctagctgctacaaaaaagacatgttttagacaaaaaactcatgtggatgggcaaaaaacccgagggctggatttgtggctaattgtaaaacagggtattttagtttctgttctgtggaaagggtaaagcattccaacaaaggggtttaatgtagatttttttttttgccccccacgctgttgattgctaaaaggaacagtctgatcggggcgctgaaaaaaagtcttttttttta

SEQ ID NO: 575403 - DNA, 1101 bp, Homo sapiens
  misc_feature (32)..(32): n is a, c, g, or t
  misc_feature (62)..(62): n is a, c, g, or t
  misc_feature (78)..(78): n is a, c, g, or t
  misc_feature (111)..(111): n is a, c, g, or t
  misc_feature (126)..(126): n is a, c, g, or t
  misc_feature (135)..(135): n is a, c, g, or t
  misc_feature (139)..(139): n is a, c, g, or t
  misc_feature (154)..(154): n is a, c, g, or t
  misc_feature (158)..(159): n is a, c, g, or t
  misc_feature (162)..(163): n is a, c, g, or t
  misc_feature (165)..(165): n is a, c, g, or t
  misc_feature (172)..(172): n is a, c, g, or t
  misc_feature (185)..(185): n is a, c, g, or t
  misc_feature (198)..(198): n is a, c, g, or t
  misc_feature (202)..(202): n is a, c, g, or t
  misc_feature (209)..(209): n is a, c, g, or t
  misc_feature (211)..(211): n is a, c, g, or t
  misc_feature (216)..(216): n is a, c, g, or t
  misc_feature (222)..(222): n is a, c, g, or t
  misc_feature (228)..(228): n is a, c, g, or t
  misc_feature (232)..(232): n is a, c, g, or t
  misc_feature (234)..(234): n is a, c, g, or t
  misc_feature (241)..(242): n is a, c, g, or t
  misc_feature (253)..(253): n is a, c, g, or t
  misc_feature (257)..(257): n is a, c, g, or t
  misc_feature (263)..(263): n is a, c, g, or t
  misc_feature (284)..(284): n is a, c, g, or t
  misc_feature (301)..(301): n is a, c, g, or t
  misc_feature (312)..(312): n is a, c, g, or t
  misc_feature (320)..(320): n is a, c, g, or t
  misc_feature (388)..(388): n is a, c, g, or t
  misc_feature (406)..(406): n is a, c, g, or t
  misc_feature (414)..(414): n is a, c, g, or t
  misc_feature (441)..(441): n is a, c, g, or t
  misc_feature (467)..(467): n is a, c, g, or t
  misc_feature (519)..(519): n is a, c, g, or t
  misc_feature (744)..(744): n is a, c, g, or t
  misc_feature (878)..(878): n is a, c, g, or t
  misc_feature (890)..(890): n is a, c, g, or t
  misc_feature (1077)..(1077): n is a, c, g, or t
  misc_feature (1080)..(1080): n is a, c, g, or t
  misc_feature (1085)..(1085): n is a, c, g, or t
  misc_feature (1092)..(1092): n is a, c, g, or t
cacagtattgagcagcatcgagggttagcacnaggccacaactggggttgtgtgtgttttcntttggcacattctgcncacatggccacacacaccattgcatcttctgcnacacactgcttttcncagctgtgnaccntcattctggcacttnattnnagnnanatcgtcnttgcactcagttnaggcttcttggcnacanacagcananacacnattttngtttgnatgncnagtttcnnagttcatccanaggnccagcncattgtgtgtctgtgtcatgnccccatgttttcacccnagttgcatgcnatgctctnaggccagccagctgtcttctcctggatgagacagactccagagggtaaggagtagcgccatggtggcntgcagtatgcagagcccngcaggacncagcgtgggcgccattcacaagcttcntctagctttgggcatatgctgtcccntgcaggcacctagggaagccacttgcaactatgcggccttcagacttcctcntcagcacacctggcacactgagacagcatagcctgggtaacaggaacagccacctaaggcaagaatggaacggacacaacttgctcctttctgagcccgtttcccaaaaccccccttcacaggtgcttctaatgggtgttgccatagcagacgctgctaatgcatcacagcattctttgaaatggaaccagacacagcctgcctctcaatcctcagctgggggcncctagcagcctcttgtatttactcagagttgacacatcacacagatcctgtttggcattcctaccttaccggacgtctccagggggtgaccagggaccaggcagagcccccggtaccaaaccagaccaaggctngcagtccaaatngggagggtcccaggtgtcccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacnatnaagcnaaagtcngttattgta

SEQ ID NO: 575404 - DNA, 803 bp, Homo sapiens
  misc_feature (2)..(2): n is a, c, g, or t
  misc_feature (73)..(73): n is a, c, g, or t
  misc_feature (76)..(76): n is a, c, g, or t
  misc_feature (79)..(79): n is a, c, g, or t
  misc_feature (85)..(85): n is a, c, g, or t
  misc_feature (101)..(101): n is a, c, g, or t
  misc_feature (141)..(141): n is a, c, g, or t
  misc_feature (143)..(143): n is a, c, g, or t
  misc_feature (148)..(148): n is a, c, g, or t
  misc_feature (152)..(152): n is a, c, g, or t
  misc_feature (172)..(172): n is a, c, g, or t
  misc_feature (176)..(176): n is a, c, g, or t
  misc_feature (245)..(245): n is a, c, g, or t
  misc_feature (248)..(248): n is a, c, g, or t
  misc_feature (266)..(266): n is a, c, g, or t
  misc_feature (350)..(350): n is a, c, g, or t
  misc_feature (427)..(427): n is a, c, g, or t
  misc_feature (725)..(725): n is a, c, g, or t
  misc_feature (800)..(800): n is a, c, g, or t
angggaggttgatctctctcagggagaactgtggggtggggatgtagcctaaaaaggacccttcaggaagtanganaanggggtnggggagtgtggtaganccagaaacttctggggacgtcagtaatagttactaatatnangaggnagtnggggatgctggccccaaggntgangtatcagttagagcagaacaattggacctagagctggtttttcctttgggtttaggtgttagtcaactnttntcattggcgtggggaccncgcgacacagggttgtcactgtccagccctacacagctgcgggcacacagatggtacacattcccagacagacacataggtagncatgtggctgttcacccatgcccacccacacaatcacgcatacctgttggcatgtgtgttaaccccacatgcccccncccccccatgcctggcagtccacagaactgtttgcttccttttgtcccaggctggggccttgagtgataggcaaggggtctgtgatgggtagatagtgtggttggagacacggatttcttcctgaacaaagtccctcccctacatggtggacatgggatgagacggccttcagttacttcctcttgacccccaggcctgcctgccgcctcatgtaggacaggatgtccatcttgacgttgctgaccgtggtccggtggtgccagcccatgacgggtataccatctggccccaccaggnacttctcaaagttccagcggatgtcgtgaaccttcatgggttcccagaagaggcggtcagatgttcccaggagcnccg

SEQ ID NO: 575405 - DNA, 636 bp, Homo sapiens
ccatttttttcctactcacacccctcacacacacatatttttcccgccccacatattgtctttatctgattgagccaccgcagccccagactctctctcggagtaccaacactttcgaacaccgctgatttcacacactcctcgctgcgcagtgttaaatctcgctccgcgcacctgtagagtaccccccccactctctctgtagataaatagacattaagacgacacccgcgccacagagacactctctgggcgcgcacctctctggcagtgcactttgtcccgccccacacgctatgtgggctctttcatagaaccgcacagcagtggcccgctctttttctctcgcgcaggcggctttcttatagaccccgctcttcaccctcacttcttattccttctcccgctctctttcgctctcgctcgcacgcgggttgatagtatatctctcacgcggcactacatcttcttaaacatctgtgagcacagacacccacgattcttgagcccacatgttccttgaaagagtttatctcctcctctataatattttataaataaggtccgccgctctttttacgcaccttacccacacccccctatcactccccttcttcagcccaacaaataaccaaa

SEQ ID NO: 575406 - DNA, 1412 bp, Homo sapiens
  misc_feature (1245)..(1245): n is a, c, g, or t
gttctaatcctccgggcggtttttttatatatagttaattccggaacttatttttggtttccgcaggctctgaactgatttatttgggcaaaccttttggccaacgaattaagagagcaactagggcgaaaatactcaaagtcgccagcgatgttatgtttctcagctgcaaaatacctttgcagggggcccaaaatattcggttttacgggccactggggaattggggggcactgggttgaggatgggctctggggttattatcccttctcaagcaaactgggacaaaggcttcggaactgtattggctgggctgaattatttggtactatcttctccttgcctcaagaaaatataaaacgcgggtgtcttcccaataatctccccagtcgctgtagacatgttggaaattcccaaatctcccaaatctggtgtccatggcgggcaatatattccagtctttcgcgtcttaagtctttcccgcccacagatctccccaaagggctatagatgtcgtctagaccggaagcggtaaactttcgcgggccagaaaaacagaaagaagagattaaaacccatgtccccccgtgttatgtggggccaccccagaagaaagtgtctttagatgtcccaggtgtggtcttacagaaatgttgtgtcccgtccagagacacagtctctcttttgagaacccgcggtctgaggctctctataaaggtgtgtgtctcactttgtgacaaaaaggttctatagagaatattcccggctacaactcgttatagaactctctccggccaatgtggtctatatacggacaattgtgcgggatatatctccctctcggcccttgtgaaaaaaaaaacccaacccaaaaacgcggggggcactccttgttgccgtagggggggctcaataagacatgtgggattatacccccaggggttttgtctgtgtatccacaacgcgaatagctgggggaacccccaacaaatatggtgtcgccgagaaacaaagagaggtccatcactattcacaaagtctgtgggggacaaaccggattatctctgtgtggggctcccaccccaatgtggttctctttccatatatttctccccaagcggcaatggacagactttgggccaaccattggtattctatatggggttagaagacatatagggagaacacacacaccccacctatatttgtggctgtagctttagcccggggtgacccaaaggaganggtctgctgaaacatcttccacaccctttcggggatttttatcctgttccacaaccaacgcggcgcgcggcaaaaaatactcccctgtggggcccaaaacggggtggcaaacgacgggccccaaagaaacctccagaggggggctatactataattatacccaaagg

SEQ ID NO: 575407 - DNA, 121 bp, Homo sapiens
agctgatatggtgcacaccaccacgcggccaattattttcttcttttctttcgtatagatagggtctttttaagtcagggtcttgctgtgttgcacaggctggagtgcagggtgcaatctg

SEQ ID NO: 575408 - DNA, 579 bp, Homo sapiens
  misc_feature (45)..(45): n is a, c, g, or t
  misc_feature (209)..(209): n is a, c, g, or t
gatcgacgtgagcaacccgcagaccgtgggggtcggccggggctntcaccacctacgagatcagggtcaagacaaatcttcctatcttcaagctgaaggaatctactgttagaagaagatacagtgactttgagtggcttcgaagtgaactagaaagagagagcaaggttgtagttcccccactccctgggaaagcatttttgcggcanttccttttagaggagacgatggaatatttgatgacaatttcatcgaggaaaggaagcaagggctggaacagttcataaacaaggtcgctggtcatcctctggcccagaatgaacgttgtcttcacatgtttttacaggatgaaattatagataaaagctatactccatctaaaataagacatgcctgagtttggtgagaagaagcaaaacccgagaccattaatgattcatccgcaccaatgaagaagttgtaactaactagcatgctgcgcagacactggcatagcatgccctggggtacactaacactcacctgctccccttcggtccgcttgtccttggcagttgacaagacattcggttgccttag

SEQ ID NO: 575409 - DNA, 428 bp, Homo sapiens
tctggctctatcactgctcatctgagtactctggtcacctgctctgtctgagtatccctggtcagctgctctgacctgagtcatcctgagtcacctgttctgtaacccgtcttccccgctaaacaacgcaccccaccactctgactcatacccctgctctctttaaaatagccaattggaattggcttagactgtgtcgtcccaccctagccaataggggaacaacacagcagtaggggctacctgtgtcaggaataagaaccccttcccctcccttgttcagatgtgctctcgccattgctccatccacgaggtgcgcccttctatagaagtaaaattgccttgctgagaaaattaaatttatgttcgagtgctatttcttttgtggcatcaaaaatttatttctaacacagtcattctattcctag

SEQ ID NO: 575410 - DNA, 247 bp, Homo sapiens
ggagctcggtaccgaatctcgacaggtgtgcatatttatagggtacagagtgatatttcagtataggtatacgaagtgtgtaagtgatcaagtcaagataattaggctatacatgacctcaaacatttagcatgtcttggtgtggggaacattcagaatcctcttttctagttgctggggtttttttttggttttttttttggagactctgttccccccaccaaaatagaaggcgggctgggtgaca

SEQ ID NO: 575411 - DNA, 281 bp, Homo sapiens
  misc_feature (126)..(126): n is a, c, g, or t
  misc_feature (153)..(153): n is a, c, g, or t
  misc_feature (155)..(155): n is a, c, g, or t
  misc_feature (193)..(193): n is a, c, g, or t
  misc_feature (219)..(219): n is a, c, g, or t
cgggaaggtgtgggtggatgggtgggggaacaccctcatagaagaaaggggggggggataggatggggaagtccatggataggaaccaggaaaggggatgacatttgacatgtaaatttaaaaaantccaataaaaactcaaataaataattntntatctcttaaaatgccgtcaaatctaaaactcattaancaattggctgttttatttagacaatncttcccaatatgacatgaaattgtgtgttatctgtccaaagcagtgtgggtcttaagagacc

SEQ ID NO: 575412 - DNA, 679 bp, Homo sapiens
  misc_feature (130)..(130): n is a, c, g, or t
caatgtcagtacttctttacacccaaggagaaaatctgttcgcagttgtgtcaattgaagggtcagcttgttcagggtccccgatttgtgctatttccaagatgaatgccgtgatttaccctgatgaacnccgatatcttatctccccactaggtattagcccctatcacctagagtctatacccatattccagtagaatttcccctgatcgcttagagatttttttttctgtcatctgaggatttgcccttctttcccagccagatatatttttaagccattttgatccaccatagaagaaaccatttgtaaataattttagccatgccagtgttgtcccaccattgactctgtcccccgttttttgaaaccaaattctcccaaatgtttcccattctctatagcactggtaaaatgttacattaacttttcttccttctttttgtccataaagccactgctgaccatttaactatgtgcctggagctagaatataaaatttataacatcacggtctttatcttaggtttttaatccattttggatcctttttgtagagaagctcgatattctccactaaatatcgtaatagtatatttgaatctcatcgtgtaaactattgtggtcatgcttataaagtttcttgacttgacctaatccaagactgattatatgcca

SEQ ID NO: 575413 - DNA, 351 bp, Homo sapiens
  misc_feature (42)..(42): n is a, c, g, or t
  misc_feature (83)..(84): n is a, c, g, or t
  misc_feature (110)..(110): n is a, c, g, or t
  misc_feature (131)..(132): n is a, c, g, or t
  misc_feature (214)..(214): n is a, c, g, or t
  misc_feature (282)..(282): n is a, c, g, or t
  misc_feature (289)..(289): n is a, c, g, or t
gttgggcattaccttacggagccagattttctaatttcgtcntcttcctttctctctctctctctgtttttctttttttcttnngagacagagtctcactctgttgcccnggctggagtgcaacggcatgnnctcagctcactgcaacctccacctccgaggatcacttgagtcttggaggcagagtttccagtaagctgagatggtactactntactccagcctaggtgacagagccagagcaagaccctgtctcaaaacaaaacaaaaaaacaagaaagngagaganagcgagagaaagaagaaggaagaaagaaagaagaaagaagaagaagaagaagaaggaagaag

SEQ ID NO: 575414 - DNA, 356 bp, Homo sapiens
gtgcccagccagcagttaaggacccaaacaatctgtgggaaatcctcgaggattggtggccccattcagggcatctctgttgtcgccctaagccaggaggacgctgataaacactaaagcaataccttctgacaccaggcccagcccaggaccctgggagtaccactagtgcagtcctcactagccagacaaccagaagagatctgtgccaacatcatccgagagaagctcctagaacacctgccccaggaggtgccttacactgtacatgagaagacagcagtgagggaggaaggacacggggggagctggatatcaacggagcttctggttgccaagaatctatgtgaaattct

SEQ ID NO: 575415 - DNA, 646 bp, Homo sapiens
tatgctggcttttacctgaaatcccagcacttgggaggccgaggcgagtggatcgcctgagatcgggagttgagaccagcctggcaacatggtaaaatcctgtctctactaaaaatataaaaattagccaggtgtagtggcgcgcgtctgtaatcccagctactcgggaggctgaggcaggagaatggcttgaatccgggaggtggaggttgcagtgagcctaggtcgtgccactgccctccagcctgggtgacagagcgactgcgtctccaaaaaaaacaagggtaaaacttaacaatttaaacaaacttaataattaacccagtatttgggtttactaaaattaaaaggccttggtagaaaaaaaaaaaaaaaaaaaaaaaaaaaaaacttggggggcgggctcggaggcccttcgagaaaagagggttttatagcaacacaatagctcgtatgcgggggggcggggggcgcccaaatgtagaggtcagggagagcacatgggtggcaaacaccggtgggtcccccgaaggagaaaacccgggggcgtacggagaacaacaggggcgctgggggtattccacaccacatgagaaaacacccccccggcggcgggaacccgcagggcggcgtccaggaagaacgc

SEQ ID NO: 575416 - DNA, 115 bp, Homo sapiens
acacaggagaaggttggggtcagtgagcaggccagaggaagaggggcggaaaagcgcaggacaggctgcattggggccaaacacagaatcagcaaagaggaggccatgcgctggt

SEQ ID NO: 575417 - DNA, 387 bp, Homo sapiens
attccatataggtcgacctgcaggcggcgcgaatacactagtgattacagagccatcaagcagtccagtcaacaccagaagagatcatacctacagttaaaatttgcagtagtaactaacggggaagagaacatgtcacatcagaaagtattacaaaagaaggattaaatatatcaagctgtccaaacactataagaccacatagcttaatacagcggccatgcaaacaagcccgcaaaaccaatggagcgggcagaatatgggacaggcctcctccagtcagacgggcacagggcgcaagaagcagcagaggacggcaagggagcgctaggaggtactagctgaaactaaagcctaccgaaccgacgaagagaagacaaaaaacct

SEQ ID NO: 575418 - DNA, 236 bp, Homo sapiens
  misc_feature (42)..(42): n is a, c, g, or t
tagcatctcccacctcagcctcctgagtagctgggactacanggcgcccgcaccatgcgtggctcattttgaagtattttttttgtagaaactgggtcacgctatgctgcccaggttggtcttgaactctgggcttatgcaatcctcccgccttggcctccgaaagcgctgggatcacaggcatgagccgctatgcccagtccctccctgccttgtgttaacatgagtacgactca

SEQ ID NO: 575419 - DNA, 752 bp, Homo sapiens
agacttagactcccacacaataataatgggagactttaacaccccacgtgtcaacattagacagatcaacgagacagaaagttaacaaggatatccaggaactgaattcagctctgcaccaagcggacctaatagacatctacagaactctccagcccaagatcaacagaatatacattcttctcagcaccacaccgcagcttattctaaagattgaccacatagttggaagtaaagcactcctcagcaaatgtaaaagaacagaaattataacaaactgtctctcagaccacagtgcaatcaaactggaactcaggattaagaaactcactcaaaaccactcaagtacatggaacactgaacaacctgctcctgaatgactactaggtacataacgacatgcaggcagaaatcgagatgttctttgaaaccaatgagaacaaagacacaacataccagaatttctgggacacattcaaagcagtgtgtagagggaaactgcatagcactacaatgcctcaagagaaagcaggaaagatctaaaattgacaacctaacatcacaattaaaagaactaagaccaggaagaagctggtcaccttcacaaaagctagcagaaaggccaagaaaatcactaagatcaggagcaaaactggaacggagatagagaccagaaaaaaccattcaaacgaagtcactgaaatccagggagctggtaggtcgaaaagattcaacaaagactgatagaccag

SEQ ID NO: 575420 - DNA, 379 bp, Homo sapiens
cttctgtcaaccttacacgcctttggcacaatgaagtggttaacctttatttgccttctttgtctctttagctctgcttattctaggggtgtgttccgtcgagatgcacacaagagtgaggttgctcatcggtttaaagatttgcgagaagaaaatttcatagccttggtgttgattgcctttgctcagtgtcttcagccgtgtccatttgaagatcatgtttagtgaatgaagtaactgaatctgcagaaacatgtgatgctgatgagtcagctgcaactctttgtgaaatctatggtgtggctgactgctgggcacaaccagaacctgagagcaatgaatgctttttgatcacatagatgacaccgcccctcttctc

SEQ ID NO: 575421 - DNA, 323 bp, Homo sapiens
agtgttgaggtaaagggctaagcatagtggggtatctaatcccagtatgggtacttagctatagtgtgtacagatatgttagggccactttcgtaggtctatttttgtgtcaactggatgtttttacaactcaggtgagtttaagctttatttgggtgaggtgggtgatctaaaacactctttatgccggcttctattgacttgggttaatcgtgtgaccgcgtgtgctggcacgaaattgaacaaccctggggttaggtatagcttagttaaaactttcggtttatagctaaagtgttaatcacttgcatgttacccggtgg

SEQ ID NO: 575422 - DNA, 290 bp, Homo sapiens
gtcatttccagcaccaccgactagactatcctttccaatattacctgttaatgtatcaccaccagttgtaccaataatctctaaacctatcttagggatatctgaagatattatggtctgatccgagaaagtaaacttctcaatgtcatgataagtattaaagaagcccttgatcgtaatcccgtcaccttcgttatagccggatagcttcaggtcagttccttctttctggaactttacctcctcaaacttcacatctgtaaacttgataatgtcatcaccggtcgacg

SEQ ID NO: 575423 - DNA, 185 bp, Homo sapiens
tcctcttcctcccacgtaggctgggattacaggtacacgccactacacctgggtacttttgtattttcagtagagacggtgtttcaccactgtggccaggcgtggtctcaaagctcctgcacttcgttgatcatgcccgacctcgtgccatcccataagtgctgaggattacagcgcgtgggcct

SEQ ID NO: 575424 - DNA, 546 bp, Homo sapiens
agctataccaggaaacagctatttaccaggagcatcggctataccaggaagcagcaattaaccggaaagagagataactctcgcagacatgagataactctcgcatgaatacagccaccctgctaaagttcacataaatcactttcacgtaaagaatgagcaatataaaaattttgaggtagaattctatccaaagtgataaaaaaaaagggacagaataacatcttacacaaaatgaaagcattcatcaggacatgtcattacttgagtgtgaactataacttcaaaatgagctaacagacaattaagaataagatatacggactgaacgaattacataagtcaagccacgataaagtggatcacaactgtaatcccagcactatggaaggccgaggtgggaggatcacttgcactcacgagtttgcagccagccagggcaagcatggcgagacgctgtccccacaacaaaatacaacgaaatagctgggtgtggtggtgcgtgcctgtgatcccagctatgtagggaggctgagaaatggggga

SEQ ID NO: 575425 - DNA, 842 bp, Homo sapiens
  misc_feature (16)..(17): n is a, c, g, or t
  misc_feature (22)..(22): n is a, c, g, or t
  misc_feature (33)..(33): n is a, c, g, or t
  misc_feature (35)..(35): n is a, c, g, or t
  misc_feature (64)..(65): n is a, c, g, or t
  misc_feature (69)..(69): n is a, c, g, or t
  misc_feature (96)..(96): n is a, c, g, or t
  misc_feature (103)..(103): n is a, c, g, or t
  misc_feature (114)..(120): n is a, c, g, or t
  misc_feature (130)..(131): n is a, c, g, or t
  misc_feature (169)..(169): n is a, c, g, or t
  misc_feature (173)..(173): n is a, c, g, or t
  misc_feature (175)..(175): n is a, c, g, or t
  misc_feature (256)..(256): n is a, c, g, or t
  misc_feature (266)..(266): n is a, c, g, or t
  misc_feature (269)..(269): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (288)..(288): n is a, c, g, or t
  misc_feature (311)..(312): n is a, c, g, or t
  misc_feature (322)..(323): n is a, c, g, or t
  misc_feature (325)..(325): n is a, c, g, or t
  misc_feature (343)..(343): n is a, c, g, or t
  misc_feature (383)..(383): n is a, c, g, or t
  misc_feature (391)..(392): n is a, c, g, or t
  misc_feature (415)..(415): n is a, c, g, or t
  misc_feature (418)..(419): n is a, c, g, or t
  misc_feature (425)..(425): n is a, c, g, or t
  misc_feature (446)..(446): n is a, c, g, or t
  misc_feature (455)..(455): n is a, c, g, or t
  misc_feature (458)..(458): n is a, c, g, or t
  misc_feature (481)..(482): n is a, c, g, or t
  misc_feature (487)..(487): n is a, c, g, or t
  misc_feature (512)..(512): n is a, c, g, or t
  misc_feature (515)..(516): n is a, c, g, or t
  misc_feature (518)..(520): n is a, c, g, or t
  misc_feature (524)..(524): n is a, c, g, or t
  misc_feature (530)..(530): n is a, c, g, or t
  misc_feature (539)..(539): n is a, c, g, or t
  misc_feature (558)..(558): n is a, c, g, or t
  misc_feature (739)..(739): n is a, c, g, or t
  misc_feature (771)..(771): n is a, c, g, or t
  misc_feature (773)..(773): n is a, c, g, or t
  misc_feature (776)..(776): n is a, c, g, or t
  misc_feature (823)..(823): n is a, c, g, or t
ggtgcccgggtgaccnnccccnccctgcaccancncccgtcccgaaccccagccgggcccctgnnagcncccactccagccccggcccggccgagnatcccgnagctcccggcnnnnnnngccggtgtcnngcttgcctcagctcacaggcttttcccgagcgccagtncctncnaggacctccgcagccagcaccttctcttgcgacctttttcttaccctctcattcctccctcgccccttcagccctgtcaantcctccttcntanatggcctccngtntncttncctttccactgattttatttttnngtttccaaannancgtcttgtgatgcctgcnatgcttgcgtaccttgcaggacctgaacccgcggcggganatctcctnntggctggcccagtggttccctanaannccagcnaggtccgtggtggccctgaanaaccccatnaangtggagctggtggcagggaaaanntaaangtggtgtgtgtgtggccgcagcaanaannannncttntgtganggctcccanttcttccaacgcactggcntatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccangcctctgacaggcacccccttctgtgggaaangnaanaggtgctgagcccaagagactctggtacccactgctggctcatgaangaagaattattccttataa

SEQ ID NO: 575426 - DNA, 422 bp, Homo sapiens
ggagtggcagagaagctgccgtgcttgataatcatgtggccacccaaagggagctcctgtcagtgcttaaaaccaaaatcctggcacagttcactgagagaagtccgtgaatcgagcggaagaaatcagttcttgcccccttgtaccccatcctctccatcttcagcttaaggaatcaagcccaggccttgggcacttgtccgggaaccaggggaatggggagggaccttcgcatggcgctgcagttccttcctggtgtccgcgccagtgccttgcctccacctgcacctggagcccatctcttgctgcctgggtgctgagaccttctgccaccccaggggtgaactttgaagcaggtgtcttcaagagcccaggggacactcatattttgaggtgtcaccattttaagcatctttaaaata

SEQ ID NO: 575427 - DNA, 1514 bp, Homo sapiens
  misc_feature (1064)..(1064): n is a, c, g, or t
cgtggtcgctctcatgcgttgttttgtgcttaggattattatgacctgctttgggtgagccacgtggttttttgagagggttcgtgttgccccatggagctatttgggtcggtttctaccgcgttgttgccatgcttacttgggcacaatgttccgtagtgttgcaagtgtagaatctagtgttgtcgtggtgatccgaaaatttgtggcgcccagagtttttgtggaggagattgttgggggttaatctggggtttgtctccccgccgatttgagtgagcgcttgtgaactcctgtgtgtgatattcgttgggtttttgttccccccggggacacgggtcattgtgcctgttgtgttctcttgtatgagtggccccccaaagaggaatgtgtgttgttgcgcatatggttctgtgttccataatctggccccctattaatttctccaaatgtgtgctcacaaagggggtttgggttattttggggttgttgtccatgggggcccaaaataaatgtgtgccgaaagcgcgtttattgtggtggtgggcgttctattttgtctaaaaaagggggaaactgtcgacgcacatccctgggttgtatattgttatagggagaagagattttggcgtgtgaaaccttcgtgaaggtttttaaggtgggtgtgacacatgtgtttgacaaatgagtttttgttcaccccacgttttagttttatacgcactgttgagatttgttccacatggggggttttttctcccccggttaatttgcacccgtgttccccagtgtccctcgtcacatttgtgggggaaattgtattgtttttggaattttatgggggaaacacagggggttaaaaagaatgtgtgagaaagctttatagagttttgaaagagagcttgtgagaaaccacagcgttatacagagagtccacggcgtttcacagctctcgaaactgtcattgcgtttgtgatcaccctcccacacgctcccacagaggagagggtttttgtgggggatattttgagagagagggggacacaggggagaatatctgtgangagagcctctctcttgtccacacctccccactattaaccctcgtttaacacaaagttatgggagaaaaatttataagcgtctcccgcgccctaggccgccgcgtgacacctcacacacacctgtaaatctccgagtacatttttccggggcctccaaggtgggagaggaattgcgcttgagaggccacaccactgggcacaacacatatgtgagaacccccacatttttatcacacaaaaataaacaacacttatagctgggcgcttctgggcacatggtggcacacaacacacccgtatagtcccacactaacttgaaaaggctgaaggcgggaggaatggctttataccacccatagtcaaggctgccgtgagctcatgatcataacccctgcacttaacttggccaccgggcaagaacccgtccccttaaataaatttaaaggaaaa

SEQ ID NO: 575428 - DNA, 166 bp, Homo sapiens
caaggagtgaggagagtctcaggagtatagtgagctcccacctggggtgtggagaattagggtggtagcagcctcaaaaatctcaagagatatggaatagaagcatgaccacaactatgctttccatgctgacgtttctttttactctctctctctcctatttttt

SEQ ID NO: 575429 - DNA, 182 bp, Homo sapiens
tcggccggctgagcaagatcatatctgcccccatggatcactctgacatcagcctccagatgggcacgaacaagtgcgccagccaggtgggcatgacggctcccgggacccggattgcggctggacaggaaggacaccttccaggacacttctggacacatgtaggatcttggactcgtgcc

SEQ ID NO: 575430 - DNA, 268 bp, Homo sapiens
cgcccccccccccctggtggccctttcctttaggttaaccccctttcccttttgggcccttttagggcccccttttggaggttttttcctttccaaccccaggatggccgggtccttcccaaacccgttccccccttggggggtccaggccttggttcccggccctttttccttttgggggtgccggggcctttggggtacaggggcccccaacccccccccccttccaaatttttcccccttggggaattaaaccctttttcgggga

SEQ ID NO: 575431 - DNA, 176 bp, Homo sapiens
atcagaaacagcacaccggcaagcataccaaagatcaggatgatgatgaaagccggagataaaaacgaattgtcgcccatgcggaactcctgacagtcttgcgcagcacagggctgcgatgaggttagcctagcgagcagcctgcttgatcgcgtgaaatgcatggtttgctgcag

SEQ ID NO: 575432 - DNA, 526 bp, Homo sapiens
attgcaccactgcactccagcctgggcgacagagagagactgtcacaaaaaaaaaaaaaaaaaaaaaaaaactttttcgggcgcggcttgggccttggaaaaaggtttttaaacccttccggttgggcccggggccccaggttggtgttaggtgtgacctgtgtggtccataggcgtgttccctggggaagaacccgggggccatgtactaggtggctgtgggatttctctcaccaatttaaaacaagcccggggggacacccggagggttctttgagacaaatctccagagagggcggttctcgaggagcggccattcacggggagactttattacaaagggggaggctcaaaggcaggaggcccggaaatactcaaaattttaacgcccccggtcccgtggggagtcacactaatgaaaaagaagagcaacaaaagacaatacatagaaacgaccaaaacaaacgaacatgacaaacaccaaataaataacacacagacgaagagacagagaaaaacacaaaat

SEQ ID NO: 575433 - DNA, 290 bp, Homo sapiens
ttttaaagggggaaaaaaaaaaaaaaaaggaaccccttgggttccccggggccctttccaaaccctcccccccccgattttggggtttgggttcccgggttgggggtttcccaaggttaagggaaccagacggggccccccccccttagaaggaggggattttttttccccctgggggggccccccccccccttttttttttctttttttggggggattttttttaaaaaaaaaaaaccttttgggacggccatttgccggtttaaaacccaaaaacccccgtttttcca

SEQ ID NO: 575434 - DNA, 149 bp, Homo sapiens
cgggccgcgtcgacggaaaggacaggggacatgcatccctacactgctacagctacaggtcaaagacaccgcacaaaggaaaggacaggggacatgcacccgtacactgctacagctacaggtcaaaggtcgacgcggccgcgaattta

SEQ ID NO: 575435 - DNA, 306 bp, Homo sapiens
ggaacgtatacaggaaacagctgtacagggatatgcgtgacaggaaagtataaaatcgttaaagcagagtaggaggctacatgtaaataagatgcagacactttaacggtaagaaacaaaatctccaaaatagttctcctacctacccaatctgccatattccactttctccaccaatttcaggagtttccgccacatggttcggctccaatgagccagtccttgcagaatccacagacacgaattggatctgtgtttcgtatatcaacagataagttcaattgcttcatggtctacatgcaatca

SEQ ID NO: 575436 - DNA, 163 bp, Homo sapiens
acgctccactcggcacatcaatattggaccctttattgtgaagattgcgctctgtaggtgtagattctcttcccaggtgtccctttactcctcccctagtgtccttaatgtctcctccacatggaacatctatttatggctttgatgtttaataaacgtagaa

SEQ ID NO: 575437 - DNA, 243 bp, Homo sapiens
  misc_feature (69)..(69): n is a, c, g, or t
  misc_feature (77)..(77): n is a, c, g, or t
  misc_feature (231)..(231): n is a, c, g, or t
gagaaatgcagagtgacacttcaatgagatacaattagcacatccaccggattggcaaaattagaaacnaaaaccgnaacaccagcactgaccaagatatggagaaatatggtttggatatttgtcccctgcaaatatcatgttgaaatgtgatccccagtgttggaggtgagggctggtgggaggtgctcgggttatggggatggatatctggatccctcataaatggcntggtgccctgtt

SEQ ID NO: 575438 - DNA, 195 bp, Homo sapiens
agcttgatctcacagcatcaagggatccatcccgcatcagctccccgcagtacgcccggctaacttatatagcatttttagtagggacagagttttcaccatgttggccaggctggtctcgaattcttagactcaagtgatccgccccccttggcctcccaaagtgctggtattacaggcatgggccaccacacc

SEQ ID NO: 575439 - DNA, 425 bp, Homo sapiens
  misc_feature (19)..(19): n is a, c, g, or t
  misc_feature (161)..(161): n is a, c, g, or t
  misc_feature (399)..(399): n is a, c, g, or t
  misc_feature (405)..(405): n is a, c, g, or t
tccctgagcaccatcaacnatgatgagtttcccaccatggtgtttccttctgggcagatcagccaggcctcggcttcgcccggccctccccaagtcctgccccaggtccagccctgcccctgctccagcatggtatcagctctggccaggcccagccaagnttccagtcctagcccaggcctcctcaggctgtggcccacctgcccccaagccaccaggctggggaaggaacgctgtcagaggcctgctgcagtgcagtttgatgatgaagacctgggggcttgttggaacagacagacccatctgtgttacagacctggaatccgtcgacaactccgagttcagagctgtgaaccagggatacctgtggccccaaaaactgagccatgctgatgatanctgagntataatcgctagtaaagggc

SEQ ID NO: 575440 - DNA, 120 bp, Homo sapiens
  misc_feature (59)..(59): n is a, c, g, or t
  misc_feature (62)..(62): n is a, c, g, or t
cctggagaagctattgaagatgatgatgatgattatgatgaagaaggtgaagaagcggntgngggttatcagctctttgaagaagtcaaaagctgcagtaaacttttccaacgttggctg

SEQ ID NO: 575441 - DNA, 766 bp, Homo sapiens
  misc_feature (538)..(538): n is a, c, g, or t
  misc_feature (650)..(650): n is a, c, g, or t
cacctgtggagtggcggccccgctcagggctggcatacgagatggctcagaaacggccctgccctacaggtgccccgcccagggagaaggacagatggagtccccagatgcctcccagacaacgtggctgcccaaaggcaaggctggggaggcaccttggtgcccatggtggcgagcaccccagggggtgaagggcttcccaacggaagcagaatgcagaggccttgccgtgagcccacatgggccagggaaggctttctgagaggctcctgccgccccccatacccatctcatacagagccaccctcacctgtggggtgtgtgccttgaggggagcgtgactcagctgggcctgcacttggaggagcttggggaggttccccaacttctctgggcctcattccctcacctgtgaagtgaagctgatgacggacctgtcttgtggggcacgggaggactgaggtagctacgtaagtgtgttcccagcacccagcactcagtcagcactggaaaagagtagccactaaggtccgggtgngatggctcatgcctataatcccagcactttgggaggctgagggtggatcacttgagcaaacccaagagttcgagaccagcctgggcaacatagcaagaacgtgtaacctgtntacatgaaaaaaaagaatggccaatataaagggaaaagccagtataaaaatgtgggatttggggcactttccccattatgtttaaaacttttttataaaacatgtagtaatttcaa

SEQ ID NO: 575442 - DNA, 488 bp, Homo sapiens
  misc_feature (440)..(440): n is a, c, g, or t
gagacccaactcaggtctggatttataatgaagaccatgaattgattttaaacaacctcctttgccttgacatgtcagaaactcgctcatcggatccaccccgactcatgaagtgccatgggtcaggaggatcccagcagtggacctttgggaagaacaaccggctgtaccaagtgtccgttgggcagtgctgagagttatggacctgatggatcagaagggctacgttggcatggcgatctgcgatggctcctcctctcaacaagtggcgtctagaaggttaaaggtgggccctggctggacacaacataattcaccttggttttgtcatgcctgccataaatcaaggtgctttaaggttgctgactgcagcagacaagaaccttggtggaagggcgaccatctcaggagcgccactgggatttgggtttacttccgangctgctgttaagggattcttgtttatccagggaaacagaaaataattt

SEQ ID NO: 575443 - DNA, 667 bp, Homo sapiens
tttattcgtccagtctttgactcccactaaacctacccatcattagcaagtgccagagaaatcgtcttgcaattgtgcatcttctcctttgacgtaacagttgcaggcaaattgtgcataatgaggctagtcagtgaccatgcaataaaggttacatcttttaagctatgtgatattattattattccagaaacatatttgtgtgtgccacatccacaaaaggttatttgagtcactgtcatcacgttcatgagtaccttgtagcaaacttttaataatgatagatgagtagctctctctacatgacctcacctttttagttgatgttcccagtacatctaacagactagcatataggccatgtgtatgtggtaataaatgaaatggcaggggtctcattgagttatttagacattaagatctgataagacaatttcgaactggagttacacacttccctttagcttctatcagaagctctaagctcacagtgtatcccaggtataagaaattctgttcacaggtttatagtcctccacccgaaatatttggctcccaacctatccccatttcatcatcacccggtatggtcattacaccagaatcaattttgcttcgaggctggtattgttgttttcttccattttattcccatattcctttcctt

SEQ ID NO: 575444 - DNA, 524 bp, Homo sapiens
  misc_feature (228)..(228): n is a, c, g, or t
acaccaaaaaaagttcgattcgcttcttccacatttaccaggcgaaaaagaggaggaaagccagggttaattctcctttatctggaaaattttggatgagttcttgaaaaaaacttgggaacccaaaaggtggtttatccttgtatctctccagggtggattgcccaaaaaattggaaatcatagtcaaagggcttcccttggttcccccctcatttatttggaaccngacttctttttttttcggcttaaaaatttcaattctcgtggtaaacccaaagtaaaaggaaagggtgcctttccccaactcaccccccttggggaggcaaatccgggtgtggaggtgtgggctaaaggtagtgcctgttttattttaaaaagggggcctgccagttgtatctgttgcttttttcaatgattcagggaaacaaatgggcttttctccttccttaaaaaaaaaccccccctctttttaaaattctctgtgggaaaaagcctgccaataaaatgggggtttttgggcca

SEQ ID NO: 575445 - DNA, 102 bp, Homo sapiens
atctagaggatccgtgtactggcacaatcttgtgtcaccacactccacctcctgggttcagcaatattcttgcctcagcctcccgagcagctgggactatag

SEQ ID NO: 575446 - DNA, 335 bp, Homo sapiens
gacatatatccctgagacacagacacaaaaatcctcaacaaaatactagcagattaaatccaacagcacatcaaaaagagaatacattatgatcaggtgggatttatcccagggatgcaaggatggttcaatatatacaaatcaataaatgtgatacatcacataaacagaattaaggacaaaaaccacatgattgtctaaatagatgcagaaaaagcattcaatagcctgggcacagtgacttatatctgtaatccagcacttgagaggacaaggcaagtggatcacttgaggtcagtagttcaagaccagcttggccagcatggtgaaacccc

SEQ ID NO: 575447 - DNA, 258 bp, Homo sapiens
cggcacgagggcaggtcccaagccctgctccgcggggaggcagctgaggcccagcgagaattcgagcgtggcgcgagcgggccggaagtgctgtggtacccggtgcaccctccacagctgctggcccgggtgctaagcccctcactgcccagggccagcggcaccagccggctgctccaagtgcggggcctggtgagcccatgctgagctggaactcgtgctggcccacgagtgccacgcacctctccttccacctca

SEQ ID NO: 575448 - DNA, 337 bp, Homo sapiens
  misc_feature (48)..(48): n is a, c, g, or t
  misc_feature (198)..(198): n is a, c, g, or t
  misc_feature (208)..(208): n is a, c, g, or t
  misc_feature (291)..(291): n is a, c, g, or t
  misc_feature (316)..(316): n is a, c, g, or t
gcattttcagattgagtaatttgatgaataaagaagaagagagaagtnagggggacagggaagccctaagagataatgtcataaccacccccaacacatacagacccccagggctaagtgagggggagctcttactgaactcacaggtagaaagagctgccaggagggctagtggcaggggctgtgtagcagatactncgagggcctncccacagccctggctttgaccatttcggcacaccagcctgacttccagctgcaaagacttgcatttctttgcctcagggtttnttcttaggcagcggactggcttttngcttcaccttacagagcaggc

SEQ ID NO: 575449 - DNA, 83 bp, Homo sapiens
acctgggcaacaaaaaggcccctgtctctgataaaaagaaaaaaaatgaaaaaataaaaatgcccaggtataaaaagaaaaaa

SEQ ID NO: 575450 - DNA, 288 bp, Homo sapiens
ggtcctagcgaggtgcgggagattagcgaggtactcgcttagtgccccgcggttccaggggccaggctgggagcccacagccaccccgctatgccgcaggcccgcctaaccaccgtcaggcagcctatgggacgcagggccccatttgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagccc

SEQ ID NO: 575451 - DNA, 436 bp, Homo sapiens
caacaacatgtttaggctgtctacaaattcaagctacaagactgtgtacaaattcattgtgtgtcacaaaaacatttaatactgaaagagattcttattcaaataggcagtgtgtaaatgtggggtctgttaacagttcaaattgcagattcctttccttctttaagttttcattgcaccaccacgaactaaaccatttaacatacctcagaggtctccgggtacctagtctctcagaggcctttggaggcccacgaaggcttatcttaactaaaattggcagggctggctgataaagttaacggaactccccattttggaggcagacttagtaatggtcaaacgaagaaactgttgtggtctgttcttaaaaagctactagtatttagtgcttcacagaggaagtacagacagcaatacatccgagatgaggagg

SEQ ID NO: 575452 - DNA, 171 bp, Homo sapiens
gcctgacattgccaacatgacgacttgctgccatgtcagcttcatcctttcatactgctccctgcctctgtgacaggtgccataaacggataccagccagtcacgctgagggaacagctcagttaccttaagggtgataatttttttaggtttacttgttcggattgctca

SEQ ID NO: 575453 - DNA, 108 bp, Homo sapiens
tttattaagacaaattccaattgttctctggctgtttttttcagttgtgtctagcaaattatttatctgccctttgaaataaaatgtttttgtttataaaaatctctg

SEQ ID NO: 575454 - DNA, 213 bp, Homo sapiens
atccaaacattgattctgctggaaggatttgtctggatgttctaaattgccaccaaaaggtgcttggagaccatccttaacatcgaactgtgttgaccttattcagctgctcatgtcagaacccaacctgatgacccgtcataggctgacatagtaaatatccccatttttctctgcacacatatcctacctcgtctatacgctaactctcct

SEQ ID NO: 575455 - DNA, 325 bp, Homo sapiens
ccatggtggcagccctgggacaaagaacggtgtggctttggctgcctttgcatggaatcttgccccggactccttaagactgcccaaggaatgaggaagatcaggggcaacctgggaactgaataactttcaaagccagtggtcagcttttttgctccggactagggtttacaggttttaattcaaaccagatgcctggactagtttttagaccccaagtcaacctttttgagccccagcttcccgctgggaataatgatgcctgccctatttacctcccagacttgttatgaggataaagtgagatttaactgcccccaagtga

SEQ ID NO: 575456 - DNA, 137 bp, Homo sapiens
caccttcaggcactcagtcagcatgcccagcttgtctgttgctccacctgccgttccatgttccatgggctgtcttgccattttcatcttgtcagcactgcaacagcttgtcttgttgctccagctgcatgttccat

SEQ ID NO: 575457 - DNA, 210 bp, Homo sapiens
ccgagggcgccttcgtcgccgactcgttcccgctctgggccgggctgatggacaccatggaggtggtggacggggccgagccgcgcgtcgcgctcacctgcgagagccgcctcgtcgacctcgagcgcgccgaggtgcgccgctacaccgatgccgaccagcaggccgagtatccgggcgaccgcttcttcgagttcgtccccgccctgc

SEQ ID NO: 575458 - DNA, 148 bp, Homo sapiens
ttaactgccgtcatgttaagtagagtttctaagagcccgaaccgctgaggaagtcttcattggagggtgagcttgaaacacctcatgagagcctaggagccattttgagcaatggggaacgctcacggactctgttgtaatgagagat

SEQ ID NO: 575459 - DNA, 322 bp, Homo sapiens
agaggatcccctggcgaggctctctacctctcactctcctctggtacagtgggagtcgggtgtgttttctggaagggtaggagacagcttcaccttgaacttggaatttctcagcagcggctagtggggctggcggggataaatcttcgagctgggctcccccaaaaactatgtacgtatctgaagcagggctctggtagacatcgggtttggtgatgacaaagaggatattcttagagtccgggatagggactctagtaactccggtaaccggccgaagacccagtggggacatagccttcggtaggtagagagccgggca

SEQ ID NO: 575460 - DNA, 1105 bp, Homo sapiens
gcgcgtccgtcccgcaagcactgagtctcgcctttgccgattcggcgcccgtccacatccgcggtccagctcaccatgtgtatgatgatatcgccgcgctcagtcgtcgacgaatggctccggcgatgtgcgaaggccctgcattcgcggagctgaggatgtccctcacgtggcctgtcttccacgcgtcgcatcgtggggcgcaccctaggcaagcagggcagtgatggtgggcatgggtcaggaaggattcctatagttgtgagccgatttatggcctccaaggagctacacgtacgtatggcatcactctacccctcgcatgtaagcctcgattcggatccacaggcgatcggtcgaccgaagcattggggaacagagcattggaagaagaatcctgggcagcgcaactacctttcgttaacagacttgtaaggcattgactggttgttgtggcataccccaggaagggatggcagcccccctggttggtcatgggccttgaacgccggaaggggtccccccgcccttggaaatcgcccccagatggggccccaatacctgactggaaggaaaggattgaacgcccagggattccaatggtttgtcggacggaaccctttccagaacgaacctccacaagtcctaagttgttaccggttttgcattaattctcgaggggcttggtaggccttagtcccccgttgttaccagcccattcttgagccctgttaacctaacgttgtggccaattcggtctgaatttgggaactccccgggttgaaccggggggtccaaaccctagcaacattgttggcccccacttcttaccggaacgggggttaattgcccccttcccccccattgcgcaattccccttgctgtccttgggaacccttcgggcttgggccccggggacctttgaacttggaacttaccccttcattggaaaggattccctttccaacctggatgtccggctgggtctttacaaggcttttcaagccaaaaccaagcgggtgccgaagccggggggaaaattcccgtgccggttgaaccattcaaccggacgacacgcttgttggcttacgttccggccccttgg

SEQ ID NO: 575461 - DNA, 504 bp, Homo sapiens
aacatagatatagcatttgacaccacacgagaagctctgcaggataatcagacccaattgatcatggaggacctgatcgaagtttgcaacaactcccacagcaagatcatgtacgccagggacgtggatcagagaagctcaacattcaagaagtctctacagatcggaacagagtttcagagacgagcgacagccatgatcctgcgggcgcatgtgcttcgtaaccagatacatgtatagtccccttctaaaaaaaatcagtcaagtgtagctcacacctgccaacagccaaacatgaatgagcaccaacatgtgaagactcgaccagatgcctctcctaggaaagtacacggggccactgccgcatcttaggccccctgtttagaaatcaattatttccccgctgaagagagaaaaatcacaatctaaagactttaagttgggaagaagatctctgttgtctgtattaaagacaagcacaccctgtcgctcaaatgaaaagga

SEQ ID NO: 575462 - DNA, 838 bp, Homo sapiens
gcccaccaagaaaggtagaaaggctgtggatgaggcccacatatgcctattccttcaagtatttaacagaacaagcctgttaaggaactgagagatgaccagtttctcaagatatgcctggctgaagacgaagggctcctcaccactgacatcagcatagatttgaagggagtggaaggctatggcaacgaccagacatatgcgatttttatccaacagttttactaccgagatgcgttcagccaccaggtgcaggagtggacccggaagcgcaccatggccatcgaacgggctttacagcagttcctctatgtgcagatggccaaagaactcaagaacaagctgcctggctgaagccacaggacatactgtcactaaaggcctgtagtcgaaagctctacaatctggtcgagagatggcaccctaccgaccagatcagccaggtggaacgaagatgacgactcaaatggacgagaaccaagggcagggcatacgagatccacggacatcgacataaactcctctgcacagagcatccacccatgacgtcatgccgcacctggctcaaccgggacacggagacgcgaccagcacctaaacatacgacctgaccacataccacaacacaacgggcagaacaccaggcacttggacgaagaaggcaaagaagccggagcacaaacaaccggagaccaaagcacaaagacaaaaggccaaaccgaaaaactagcccaccagcacgaaacagacaggacacaacaaagaaatacaggaccgcccgccacaacagacacacaccagaggaccacacaccacatagaggaacggcaacccacgt

SEQ ID NO: 575463 - DNA, 720 bp, Homo sapiens
atggctaagaacccaaaagcaattacaacaaagacaaaacataaataaatgggacctaattaagaagcttctgcacagcaacagaaataatcatcaaacagacaactcacagaatgagagaaaatatttgtaaactgtgcatctgacaaaggactaatatctagaatctacaaagaactcaagcaaatcagcaaggaaaaaagagaaagacaagtaatcccatcaaaaagtaggcaaatgacatgaactagatatttctcaaaagatgacttacaaatggccaacaaacatgaacaaatgctcaacatcactaattatcagggaaatccaaattaaaaccgcagtgagatagcaccttaccccctcaagaatggacattatttcgaacagttaagaaacaatagatactggaacggacgtggtgaaaggggaacgcttatacagtactggtgggaatgtacatcagtacaggtctatggaaaacagtatggagatgccttaacgagctaaaagtagatctgcacatttgattcaacatttccactgctgggtatctacccaaagggaaagctaaatcacttctattcacaaaaaagacacctatacacattatattaaattgccagcacaaattacacaattacaaaggatagggaaccaacttcagtgaccatccatcacacaatggaaagaaacagaaacaaaaacaacaacaaaaaa

SEQ ID NO: 575464 - DNA, 365 bp, Homo sapiens
  misc_feature (43)..(43): n is a, c, g, or t
  misc_feature (50)..(50): n is a, c, g, or t
caggtccagaaacatgacaagtaggactttcctgcctcttggnaaacagnaggaggaaaggcagcagaagccgcagctctgcgggtctactttcagtgacacagatcctgaattccagcaaaagagctattgccaaccagtttggagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaaa

SEQ ID NO: 575465 - DNA, 814 bp, Homo sapiens
tcgccaaagcggttaatttgaaagacccggttgaacaaattcccccaagaagcacgcgccctgcagctgtacttattcctttagaatcccccccccctcccctccccccaggggcatggttaatatatctctactccgctccctcacccaaagaagaaagcttggtttgacacaaaccacgcgcccttgttgcccacactccctcacgggataatagaatacctcaaccatcaacctttcctcccccgcgagtcctctcatgcactaactagcgaggaaatatttctctctccccccgcacactgcaagcacctccggagcgccaacccaactcccccacacaggctgcaaccctcgcgtgtgcggggctcagtgagtatgttacagaggacccacgaggtgtatgtagagtacgtgatgcacacacaatagactcgagataattaaaagcaacgcgtgttgtatttagaacacgcacgcccacgaatggttcttcccctaatcgaaccggcctgttgttttttcatcgctgtgtcacacgctgccccatgtgctttgatcacgccccgaggtatgtgttttatgacgcaccaagatatcgtgaggtaaatgtttacgagggtgatgtttcatgattatctgtggcgaggaacacaacatcttgtcacaccgaaaggaaaggagttctctggggcacaaccgcactcaacacacctgcgtagaggaaaaccactattctttgtgtggaaaataacgccccgtcagggagacacagatctcctaacaaaaaagaaaaaaaacgcccacaaaaaca

SEQ ID NO: 575466 - DNA, 1429 bp, Homo sapiens
ccgtctcttgttcctgagtattctctcttctgcggtgcactcttctcctcgtgttgtgcgcacatttgtcactcgttttcacaaaacagcgtgttgctcccgtgtctatctccggcggggttttctctcgcccccccctgttcctcctcctctctcttccggcgccagcatggctttgtagccgccggttttcttgctctcccccgggggtcccttgccctgtttaaacgcaccgcgccgtggtcctacacagcgcgcgtctctcacacacagcgggggcccccgcctgaacgtcccagatcctttccttctttgaggggaccctctgtgattggggggacaacccccgcccattggctcaaaaggccatctcccttgggggtgaaaacccagggggttaccacctttttggtgtgacctggtgagccccatccttgtagggggttttttggggccacccacggaggggttttcccccctcgccccgacctctcttttgagcctctttatagagaaggagctgcccccaaagggccctttttggtggggaccccaaagatttgggccccccgctgtttcccagcaaaaataaattttgtggtgggggttttaaaatttggaagccctttctgttgggagtacacaaacctggcgcccacatagggatattccccccgtgtaaattgtgtaagagggatggtaagggccccctaccggcgttgcctctcgcgggaaactcttggcctccacaaaatttctagtatatgccccaacaggccccggagggagaagaggtcttcccacccacgctcaccccacaacactttgtctacgcccccctctaatatgccacgcgaaaaaggagaaaagatggccaccgcgctatgaaaaaaggtatcatcccgcgcgctttggtagaaaaaaattgaaagagcctctctttggttataaagttatgaagcccacgcgatccccacaaatgagaattttatctcgagccccacactcttattcttttccacgagaaatgtaaccctggagaaaaattttcgcctctttaatatatataggaaaggcccacaaccaccacaaaaaagccttcttccaaacccccacaaaaccctccctcgtaagcactttccacgccggcttgagcccacttagcctcatggtcacccaagaagagttggcgctggtaaaaggaaattgcacgccccccctcgaaagagcacccacttaccaagttctgggggaagccacgttttaacactcacgtgcaccacgctgctgctggtggccctgcacgtgtacgttttcaccctcttaatgcttatagttggaactaaagcacagtttgtaaaactttcactccttttttttgtaaattccccaagctttggaaggagaacccataaatttttgttttcca

SEQ ID NO: 575467 - DNA, 758 bp, Homo sapiens
  misc_feature (44)..(44): n is a, c, g, or t
  misc_feature (63)..(63): n is a, c, g, or t
  misc_feature (116)..(116): n is a, c, g, or t
  misc_feature (125)..(125): n is a, c, g, or t
  misc_feature (129)..(130): n is a, c, g, or t
  misc_feature (166)..(166): n is a, c, g, or t
  misc_feature (169)..(169): n is a, c, g, or t
  misc_feature (185)..(185): n is a, c, g, or t
  misc_feature (189)..(189): n is a, c, g, or t
  misc_feature (194)..(194): n is a, c, g, or t
  misc_feature (198)..(198): n is a, c, g, or t
  misc_feature (228)..(228): n is a, c, g, or t
  misc_feature (230)..(230): n is a, c, g, or t
  misc_feature (236)..(237): n is a, c, g, or t
  misc_feature (243)..(244): n is a, c, g, or t
  misc_feature (248)..(248): n is a, c, g, or t
  misc_feature (255)..(255): n is a, c, g, or t
  misc_feature (259)..(259): n is a, c, g, or t
  misc_feature (271)..(272): n is a, c, g, or t
  misc_feature (275)..(275): n is a, c, g, or t
  misc_feature (282)..(282): n is a, c, g, or t
  misc_feature (299)..(299): n is a, c, g, or t
  misc_feature (302)..(302): n is a, c, g, or t
  misc_feature (307)..(307): n is a, c, g, or t
  misc_feature (313)..(313): n is a, c, g, or t
  misc_feature (328)..(329): n is a, c, g, or t
  misc_feature (335)..(335): n is a, c, g, or t
  misc_feature (345)..(345): n is a, c, g, or t
  misc_feature (347)..(348): n is a, c, g, or t
  misc_feature (350)..(350): n is a, c, g, or t
  misc_feature (356)..(356): n is a, c, g, or t
  misc_feature (360)..(360): n is a, c, g, or t
  misc_feature (362)..(363): n is a, c, g, or t
  misc_feature (369)..(371): n is a, c, g, or t
  misc_feature (384)..(384): n is a, c, g, or t
  misc_feature (393)..(393): n is a, c, g, or t
  misc_feature (410)..(411): n is a, c, g, or t
  misc_feature (413)..(414): n is a, c, g, or t
  misc_feature (416)..(417): n is a, c, g, or t
  misc_feature (420)..(420): n is a, c, g, or t
  misc_feature (453)..(453): n is a, c, g, or t
  misc_feature (459)..(459): n is a, c, g, or t
  misc_feature (475)..(475): n is a, c, g, or t
  misc_feature (487)..(487): n is a, c, g, or t
  misc_feature (548)..(548): n is a, c, g, or t
  misc_feature (560)..(560): n is a, c, g, or t
  misc_feature (569)..(569): n is a, c, g, or t
  misc_feature (579)..(579): n is a, c, g, or t
  misc_feature (589)..(589): n is a, c, g, or t
  misc_feature (591)..(591): n is a, c, g, or t
  misc_feature (633)..(633): n is a, c, g, or t
  misc_feature (644)..(644): n is a, c, g, or t
  misc_feature (647)..(648): n is a, c, g, or t
  misc_feature (670)..(670): n is a, c, g, or t
  misc_feature (744)..(744): n is a, c, g, or t
tttttgttcctcttttttcttttgtcctttttccttcgcctttnctttttgttaatggcagtnttctatgcaatgtgttcagaaagttacatttaaatcgttatttaagggttttnggttgggtntgtnngggcaccattccgccccacacgtttatgtgattttngcnttttcttctgtttttntgtnttttntctnttgttactttgttgtcttcatttttacaancncggccnncccagnncccngcccccntggngggccccggggnnccngcgcccnccttgggtggaccttgnttntttcnttcctntgccaggttttcgtnncgggcngccccccacncnntngttttnttcntnngttttnnntaacccgtctcgngggggcttnttcgcctcgtcctcgcnntnntnntcntcgtattccccttgttcgtcggccgtggcgtcntggttntgttggttttcggtcnctctggtcgttnttgttgctctcggcctcggtgaactccttctcgtccatgccctcgcccgtgtaccagtgcnggagggccttgngccggggcnatggccgtgnactgctcggngntgcgcttgcaccagctcctggctggcgcgtgctgttgcgcgngtggaggtggncgnngtcttcaagccgcggggcgggntgtcgcacacggccgtcttcaagttgttggggttccatccaagaattactgctgttcttgttatgccagttganacactgctcgtccc

SEQ ID NO: 575468 - DNA, 217 bp, Homo sapiens
tgatttctcgggacccgcactgtaggtccccgcaagtcgacgactatctcctagtccagacgccatggggtcatggcacagaaggagaccggcttatcacaagcctgtggggcacgtgaatgttgagaatggggacgaaaaccagaaggcccagttgtcgacttggaccaaagtctttgactggtttggcaatgtccctgcctctggttcaaggcgc

SEQ ID NO: 575469 - DNA, 326 bp, Homo sapiens
tggtccctagtatgctttggagctgtaaggtttagggacaaagcctgacatgcacacatctccttaagaaataccctgcatcgtgagctgggatcgcgccactgcactccagagcctgggcaacagagcgagactccatttcaaaaaaaaaaaaagaaaaatttaaaaacagaaagacaattaggggttgaaagacaaccgcaagagatggtattcacagcagcacaggttggctctggttttgctactagaggatccaggaagaagcccaggtggatttctgctcaaattctgagcactgcgcctatgtctttgaattttccaca

SEQ ID NO: 575470 - DNA, 150 bp, Homo sapiens
  misc_feature (58)..(58): n is a, c, g, or t
  misc_feature (80)..(80): n is a, c, g, or t
  misc_feature (89)..(91): n is a, c, g, or t
gaccatcattgcggtgagcatcagtatgtactgaggaatgaatgagtcatgtgtgaangcttgcttgaatggtcatcagncaagtagannngagaaaagaaagagtcgtgatttattatgcactgaggaaccagaaatgttattgaacag

SEQ ID NO: 575471 - DNA, 274 bp, Homo sapiens
tctccttcaaggacacataggacccaccagataatccaagataactctcttttgttttgttttgttttttgtttgttgttttttgtttttgagactgagtctggctctctcaaccagctgcagtcagtcgtgccttctctgctcactgcaaccctgcctcccggctaaagtgattctcctgcctcagcccccgagtaggtgggattacaggatgaccaccgtctggctaatttgtatatttaagagaatggggttacacgtcgcagctggctta

SEQ ID NO: 575472 - DNA, 351 bp, Homo sapiens
gattttttttaaaatcttcaaacacttcacttagtgaaaaaatgggccaatctggaacagagacattttatttggttagggcaagagtgaaagcaagcatttgttaaccctgacacatttatcagtggacaaaggtttttgcttctggtaatgaattattagaaaaaggaagattttgttcaatggttttggcccccaggttaactgtgtaaatctgcaattttggtggtaaatccccttgccacagattcagtagcttttggtaaacttcactgtttttaaaggaccttttgtgtaaaataaagaaccaatttttaaaacaaaaggcaaataaaaacaggaaaagctgga

SEQ ID NO: 575473 - DNA, 269 bp, Homo sapiens
gccgcgtgctagccactctagccagtctagccactctagccacgtctagccagtctagccagtctggccactctagtcaattgttgcagatgttcctgataactcttctctttctgttccatcatctcctcatgcttctgtggtatttcctccaacatttgcttggcagcgtacggcagattcagccttgatacgttccagttcaatcgctgcttcctttgctgagagtgactgatcagtctgtagaagtgcatcagccagatcctcct

SEQ ID NO: 575474 - DNA, 580 bp, Homo sapiens
  misc_feature (29)..(30): n is a, c, g, or t
  misc_feature (54)..(54): n is a, c, g, or t
  misc_feature (152)..(152): n is a, c, g, or t
  misc_feature (394)..(394): n is a, c, g, or t
aagagagagtgtttatatatgtgcacaannacacacacgcagagacatctgcgngcgcatcgtggtgatatcactcacgatgtgagcacacgtctagacacagagggcacacagagagagatagtgctcatagaagagcgctctcacacgcnctgtgcgtctacgatgtgagagcacgaggcacgagagacacacacaggacgctatcacatcactcttgaagaaggtgttgtgtctctagatatcactgcgatatgaaagatgttctgcacgagtgtactctgagatgtatatagagacgcacgtggtctcgtgcgcgagtgttgtggtcacttctctagaagaagagtctctgtgctcctcgtgctcctgtgtgtggggtgataagatgtanaaaagagagtgtgcgtctgtgagtatcctcctctagacacgcgcatctatattgtgatcatctcctctgcgtttctcagaaagagccccagtatcgcagtataataaacaccacatcttgcacgatgtgtatcgcgtgtcacagggtgtgcgcgtttgtgtgactctgcgtgccagttattcgcta

SEQ ID NO: 575475 - DNA, 139 bp, Homo sapiens
atatggttggtctcacaggagatggtttttcaacaaaccagatatctggtttctcatacctcaaagtggtcggtcataataaaaggaagttacagaattccattcaagggaaagtactggtctttggtgtaagggacat

SEQ ID NO: 575476 - DNA, 453 bp, Homo sapiens
  misc_feature (15)..(15): n is a, c, g, or t
  misc_feature (71)..(71): n is a, c, g, or t
  misc_feature (80)..(80): n is a, c, g, or t
  misc_feature (147)..(147): n is a, c, g, or t
  misc_feature (327)..(327): n is a, c, g, or t
  misc_feature (362)..(363): n is a, c, g, or t
  misc_feature (372)..(372): n is a, c, g, or t
  misc_feature (385)..(385): n is a, c, g, or t
  misc_feature (394)..(394): n is a, c, g, or t
acatctggttggaantcagaaagtactagacctcctcttacctaagaagtgtctatactccatcagcatgnaacgctgtnagacatgtttagctggatctgcccactgtgcactccatcatcagcaaaatgatcattaatgaggagntgatggcctccctggaccagccaacacagacagtggtgatgcaccgcactgagcccactgcccagcagaacctggctctgcagctggccgagaagctgggcaccctggtggagaacaacgaacgggtgtttgaccacaagcagggcactacgggggtctacttccgagaaccagaaggancggtaccgcaaaaacgagggtctacatgcgtccgnnggtgtaacncccagcagcagtnctcagaggncctactgagctctccactctgtttccgcctgggccatccaaccttgaagtcctaaacca

SEQ ID NO: 575477 - DNA, 549 bp, Homo sapiens
  misc_feature (53)..(53): n is a, c, g, or t
  misc_feature (61)..(61): n is a, c, g, or t
ctgggggagacctgggctctaatggatggttaaagatcccccatgtaattgtnaatgggcngcaaatattggttaacaaactgttgatgccaggggtaagccaaactacatctgccagacctctggcctgccgcgcctaatactgcctggagtagtgtgatttttacttttatttttttttttgggatggagtttggctccagcctgggcaacagagtgagactcccatctcaaaaacaaacaaagaaaaagagaaaagcaccaggagacccaatgcagtggctcacaccagtaatcccagcactttgggaggtcgaggcaggcagacgacttgaggccaagagtttgagaccagcctggccaatgtggtgaaaccccatctctactaaaaatacaaaaaattagccagacatgatggcaggagcctgtaatcccagctaatcaggagcctgaggcaagagaatcgcttgaacctgggaggcagaggctgtagtgagccgagattgcaccactgcactccagcctgggtgacagagcgaaactcccgtc

SEQ ID NO: 575478 - DNA, 80 bp, Homo sapiens
ggatttgctggtgcagtacaactaggcttaatagggctcgaattcgagctcgaattcgaggttagaagcttgaattcgag

SEQ ID NO: 575479 - DNA, 1595 bp, Homo sapiens
ggcaagttctcccagtgagaaagccatgttacagattcgagcgccaagatcggtgaagcccaagtggcgagaagccggacgatgttcgacgtccggctatctcccaggcgtctatcgtagtgatgctggacgactgagactctggtacctcaatggctcagtctcaggggagctgaattattacggcaggctacagggaaatctgacagattggtatgcgttggtcggtgcatccagctgatccattaatcgttttgttacctccggtgtccttcgcaacgtatgatagtcctgtatctcgcagcacacaatctcgaatgtctcaggcataagtcaccgcgcgagacttggacagtgaaaacactgtctcagcgtggcgtaaggcagtgtgtcgctgctatcttatcgtcttcagtgagcgcagtgacgattctgcccctagaggccacaactcggacatcgaaagcccgtgtactacaaccaaaattatagggcacagaaacggccgttcactccacgagaaggcccgattagctttccgtagaagctagacatggatgtcaacgggattggcgcaagtacccctttggcaggggaagctctggaggttcctttagccgcatagggcgcggcagaagcttctggatggagggcaccaaaagggaaggcaaacaattccccggacggatacccaacagacgccataaagcaaacttcgcgtcccatggaaccccctgggcctgtccgaagctgaacagcactgaggattaatcgacggtatacgcggggcacccagaataaggtgacgagccgcaaggcccgcagcggacgacacttacgcagcggggcggccggcacaaacgaaacctagagcaagcgggcgtactattggcaacaacaaccccgtttttggctcatattacccatttggggaacgtagggttgccagtttaatttttagaagcgcaaaaacggagccatttccaatgcgtggtggtcggggccaacataaggggggaaaatgttgggttatctaccaaacatactatgtggtcaggaacaatagtttagtagccaccaccgcaacggaaaacgcgtatcgatagaccccaaaaagattatagggctatacaacaacagcggacgcaagtcaaagacgcttggacacgcctcttcatacaacgctttaaagccccttcacaccgggtctaagttttaccttttaagcttttccccaatggcagctacgtgctgtcaagcggactatagaacgacacgtcaacaaacaacacaaggcaatcgaaaacgcaaaaacagtgagcacacagaggcagaagggccacaaacgatcccaccaaaaagcacatcacagagcgaacaacgtgacggcggacgaaaaccaacacgggcgcgacggacgactcaaaccacggacacaacctagctggcgccagcacgacagagaacggagcggcgcacaacagagacgacccgcgggctgcgcaatcacacgccccgatggcaaaacggctccacagaacgaccctatcgtcacacctgcaacggagtcacgaccaacacagagtgacgtgaga

SEQ ID NO: 575480 - DNA, 174 bp, Homo sapiens
cgcttttagaagtacactcgcatgtgaaatgtggaaacgtcgtacagcctacacaccatctatgtctacccacacagacaatcataactgacgtatagcacacacacaagcttcatagcatctcaacttatgggcctatgttcaagattattacattataaggacttttggagg

SEQ ID NO: 575481 - DNA, 290 bp, Homo sapiens
cgggacgaagtgtgccgcaggttatgactcattggtgcggcgacgcttccagcagatggatgtgctggaggggcatcaacctgctcgtcagcatctcatgtaatcagtgacacaagctgggggtgtattacctgtcctggctccgtgaacaagattctgcacaatgacccagtacttggagaagaagcagggcttggaccagcgtgggaggacatggagtggctgcgggcactaccgtgtagtgaactacgagcgtattaagttcctggtcattgccctcaagagctccg

SEQ ID NO: 575482 - DNA, 299 bp, Homo sapiens
  misc_feature (209)..(209): n is a, c, g, or t
  misc_feature (211)..(211): n is a, c, g, or t
tttaaaagaatgacacttctggccaggtgtggtggctcatgctgtggtcccagcactttgagaggctgaggtgggttaatcacttgaggtcaggagttcgagaccagcctggccaacatggtgaaaccctgtctctaccacaaaatacaaaaattggccaggtgtggtggtgcatgcctgtggttccagctacttgggagcctgagggngnacatcgtttgaactcgttgaacccgggaggcagaggttgcagtgagccgagaacgcaccactgcattcgagagtgagactctgtcaga

SEQ ID NO: 575483 - DNA, 149 bp, Homo sapiens
tagcatagtgctgtcctgtgactagaatgatgtaaaatacttcgggcagggcggggtggctcatgcctgtaatcccagccacaatatatacttgtgcagtgcatatattcacaattgcacgtgaatcatattctcaaaataagaagttt

SEQ ID NO: 575484 - DNA, 115 bp, Homo sapiens
cacgaggggggagctgactccattgcatgtgggaccttcagccgtgaactgcacacgccagagaagatgagtcaaggacctacacttttctcttgtggaaatatggaaaatgaca

SEQ ID NO: 575485 - DNA, 101 bp, Homo sapiens
aggagctggatggactggaccccaacaggtttaaccccaagaccttcttcatactgcatgatatcaacagtgatggtgtcctggatgagcaggagccttag

SEQ ID NO: 575486 - DNA, 93 bp, Homo sapiens
gcacgagtacacaatggtgctattctgtgtcaaacaccattgtgtaggataaaacatcaattgatattaaaaatgaaaagattattggaaagt

SEQ ID NO: 575487 - DNA, 341 bp, Homo sapiens
agattagccatggaatagaaagagaaaaatccagagattgaggtgggctttgaggtttcttttccctgaggagggtctacagcttcggcaagatgtagtttagaggttgagtggagctcatgagacacatgtgggtgctcggggcctatattagttgcctgtagctgctgtaacaaatgaacacaaatgtggttgcttaaaacaacagtcatttgttgtctcgcagtcctggaagtcgaaggttggaaacaggtctcactgagctacagtcaaggagttggcagggctgtgttccttttggaggctctagaagagaatgcatctctttgcttgttccgctg

SEQ ID NO: 575488 - DNA, 447 bp, Homo sapiens
agcggagccgcccccaccgcctccgccccaggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgaccaggccctcagaccctgtagccccggcaggggaggaagggcagacccacaggtcaggtatgacgaatcatgttgcagtgacgcaagggaccggcagaagcttcttcagcgatgttcagtatctgcgggacatgcagcctacggtggactctgagtatcaggcttgtcgtgagacgacgggaatatagaagagagcgccagtgagaagaaacgcgactccgttttgggggcaatgacaccagtgttgacgagatcc

SEQ ID NO: 575489 - DNA, 1432 bp, Homo sapiens
taaaaaaaaaccctttttttcccttaaggctttcctacccaaaatttctctttaaacttctcggaggacctctctacttagcccctggggccgtacccatttcttggtgtcagaaattattctaaccaacccgccctcaacacatacgcaagtgtgtgtccgagggtgcgtgcgtgcgtgctccaggaaagaacgcgtagacacccgtggagagcgcgccccctcgaggtgcgcgcgcggagagaagcagcgggtgtgccccgagagagagaggaaccagaacgagtgtggcacaactcagagagagcagcgtattccccccaagagtgtgaggtgtggcccgccacgcgggggccccgagaagaggtgcgaaagagcgaaccccccgtgggaaaactcccccagacacacacactctctctctctttgtgtagaaacaccccagaaggcgctgtgtctcccaaaaacaattctttcaccccgcgcccgtgaaaaaagagacgggcggcacaaaaagagggggcccaaaaaaaatgtaggggcgcaccaaaaatactcgctcccggagttgtgagcccgcgcgaaccaatattctccccccggacgcgcacccgcggccacacaaagtgtgtgtaaacccagaaaagccccccgaaagagacaccaaaaaggtggctcctctgacaccacaacaccgtgtgcgtacagtgaaaacatcccaaaaggcacccaaaaaaacaattaggggagggaacacacgtgaacccacacacggggggcggcaaacaaacaagagacgctcggcgcgaccactgacacccgaaaaaaagaacccactctggggggcagaaaccacacaacacacccatatgggcaaaccccccccaggtcccaaaaaaaaaaaacaaccggagcaatatgggacaaccccgagtcccatcacacacgccgtacacccctggggagacgacaagagaccacaaacaaactccacaacaaaaacacaagaacgccctatgcaagcacacaacagagaacccaacacccccaaagagtttcccaccagagggccccccgcggtccacggccataataaaaccccagcacagtaccccaaagggaagaacacccacaccaggagggaacagcgagaactccaacaaacccgcgcggttacacccccaaacggggggcgcccccaaaaattgtagaaacccccagcgaggaacacccactgacaaaacgagggcaaaaaaaaaacagccaacacaacaaagaaagaaggacaacaacaacaatatgacgagagagaaaatagagacaaccagacacccaaaacaccgtagacaagaccacaagccacaatagcccctgaaacaccccacgcgaaaaaacaacagcagcacacaaacaccacaacaccgataaaagc

SEQ ID NO: 575490 - DNA, 507 bp, Homo sapiens
gcatgttctgcacagatatttgagaacttaaagtataataataataataaagaatatatacttgaaaatgtaacaacaacaacaaaaaatacaaattttagttgtacagctgaaggagttttgacaaggtatattaacacagaatatttacatcaccccagaaattactcatgtgctccctttccggcaaaacgaacttaaaagtaagcgcttttaaaaattccagtccttatagtttaaatttgcctgttcttttcatttataggaatagaatcatacagtatatatgattttgtgtctagcttccttcacttaataaaatatctcagattcatgcatgtttttcaatcagtaatttactactttttgttgcagagtggtattgcattgtatgacaaaaccttaaattattttatcattttatttgttcatgacagttggattattttcactctttgccttttataaaataaagttgataagaatattcttgtacaataaaaaaaa

SEQ ID NO: 575491 - DNA, 498 bp, Homo sapiens
ttcttacagagctcacatctcagacttgatcttcatgagaatgtacttagtttgtcacgctagtaagtcataatctaagacgcaattctgatatatatatataatactatccatggaacagtgtcaacgttcattgagcttcatcttggacacaggattgcctagtaagtctctctccataaagcgcatttacaatttgagaccacttcataagaaacttctattccactttcgtgactgtggccacaattactcttacaggctcaacacctctgccaaagcctcttggtaggtcaacggcgtctcttttcttccttaatttgcgtgtcaacatattcactgtcagatcaagatcttctttttgtcacctcttttccttggcaagctttctgagagataagctccgcttcaaccaattctgcacaatataggctttccagagtgttcccgagtagtgtccgcatctgtacatcacatacacctcactcaatatcagct

SEQ ID NO: 575492 - DNA, 314 bp, Homo sapiens
cactggacgaggagtcagacctagtttctagttattgaagctgggtgaccttggtaagcatctttaagcctcgctttcctcacctttcaaaagggataataatataggcctctttccttgtaggagtgacaaacagcacatgaaaaggaaggacttttgtccaggatgtgatgattgactgttataatcctatggtgtttctgagatggttgcagttgtttatcgtttataggactcattagtgttgtcttattttgtgcctttgggtgtcagtggtttctataccgatgtggggttctgggggccaaacatat

SEQ ID NO: 575493 - DNA, 227 bp, Homo sapiens
tggaaaacagcaataaccacagtacatatacggtagttctctatagtttacatacattcataccataactctgtctctcctctttttggtttccaactttaaaaacaaaaataaaggatgataatcttaacggggtgaaagggagtggaaaaataaatcaaacaaagtgcaacccagtttgggtgagaaaaaaaaaaaacagccgccggaaaaaaaaaaaacaaggg

SEQ ID NO: 575494 - DNA, 406 bp, Homo sapiens
gcaacagtccagtaataaaagcccaccctccactctgcagcagctgcgacgaagaagacaccaggacagacgacgtctaaaaacggacgcgatgaccaggatcacacggtggcaacctctcatggtaccatcaaaaaggcaagaagcatagcccctccaccaagagactaaccaagcaagtggatcaggcaagaagaaagcttcatcaaaagcaaacaaaagaccagaaaatgtctacgctacatcaaccccattattcatgcacactcacttatattccattcgcatggcataatgctagcactccaagtcctagtaggtagcatcaagagcagcaggttcatagcattagctataaacctagacccaagtaacaagggatcccaggcaaccccaatgaatgggg

SEQ ID NO: 575495 - DNA, 1063 bp, Homo sapiens
ttaggctggtgtgtggctgtggtgagtgtgggtgctgcagtgaccccaatgtggtgtggtccctgtgagccagagtggccaattcctgtcccctccagcatgcatgtgcatctgtgtgctgaaccctctgagccctcttgccccacttgccctgcctggggtcccacctgctcgatggacttcgatggtacttggattggggtttgagtgatgcagagtggtgagtgatgtgaatgagtgatggatggaaggagtgatggaatgagtgattgacctgatgttgatgctgccacctgctggaggtgacatgggacaatccccggcggaggaggctggagcatgcctggggccctggccctgaggagttccttgcttgccattggatgccctgatgccctgccccagcccctggccccagaagagtggctggacattactggggaactgggcttgtctgagggaacgaagacgctggtcccagggcctgccaggttcgagccgcccggtcaagggccaggtggtcaccgtacatcttgcagacgtcgctggagaatggcacacgggtgcaggaggagccggagctggtgtcactctgggtgactgtgacgtcatccaggccctggatctcagtgtcccactcatggacgtgggggagacggccatggtcactgctgactccaagtactgctacggacccaaggcagcaggagcccatacattacccccgcaacgcggccatgtgcctgggaggtgccctgaagacggctgtggacgggcctgacctggcacaattgcctcacgggggcacgtagacgcgatggaccctggccaaacgggaaacggagagtgcggcaaaggcccactaacaacggcgggccattttgtcgcagggcccgcccaagtctataagagagctgtgcactcaaggggtataccacgtcagggccacaggtggacgtatagttaggcgcagaatgtagcgaatactagtacgtcaacgttcgtgtttttcacaacgatgtgcctcccgcgagctcgcgaccatatgggagcatactgccca

SEQ ID NO: 575496 - DNA, 744 bp, Homo sapiens
  misc_feature (744)..(744): n is a, c, g, or t
ggagagagaactagtctcgagttttttagatattttttaagggggttaatttggcgtatgggggtcatggcagggggtttaatatggataatggtggtgatgaaattgatggcccctaaaataaaggaaacaccggctaggtgtacgggagaacaatggtaaggtcaacggaggctccacgggtgggagtagtcccgtgcaaagggagggtagacggtcaaccggtacctgctccggcctccactatagcagatgcgagcaggagtaggcgagagggaggtaagaagttcaagaagctatactgctcgatacattgccgggagaaaacgcaccaattcgggggagcacacgaatcaatacagggcacccctagctcagtctgcccaaacgcactcccgaaaatataatgactgggactactacatatgcacacgaagacattattcacaaaatcgccatagcactgtagacaccaaacaaacaaccgttgcgcaaacccgcgcgtaggcaccgacacaaacccccacaaaaaagaggtacccgcccagaagggacatggaagagcccaagcacaccagggcaccagcacaatacaagcgaacagcggctaaagaaagcgtacgtcgcaacacaaaggaaccgcccacaggcccacacacgcgcgcaacgaaagcaacaagaacagcaaaccaaaaaggacgaacaaacgggacaaataacgaaggaaatcgaacagcacgaaan

SEQ ID NO: 575497 - DNA, 142 bp, Homo sapiens
  misc_feature (3)..(3): n is a, c, g, or t
gtngatctagaggaccctcgatcgaggtctctgttcgaaggagtaattaatagatcatttattgggctcaatacagttttctgttaataatcctcacgaaaaataaaatgaaaacttctttttttttccccgcaatggggta

SEQ ID NO: 575498 - DNA, 203 bp, Homo sapiens
taagaaggcatttaccaccacccacggaatcgagaaagagccatcaagtctgtcaagtccgtgtcctgtgtactgggccgcggtgaggtttcccgtgttgatctcaatattagtcccacagtactccacgtccttggtgtctgccctctccgctcacacttccttttaatgtttcgagctattggcaaccattacctccgccc

SEQ ID NO: 575499 - DNA, 887 bp, Homo sapiens
  misc_feature (35)..(35): n is a, c, g, or t
  misc_feature (111)..(111): n is a, c, g, or t
  misc_feature (114)..(116): n is a, c, g, or t
  misc_feature (122)..(122): n is a, c, g, or t
  misc_feature (156)..(156): n is a, c, g, or t
  misc_feature (167)..(167): n is a, c, g, or t
  misc_feature (260)..(260): n is a, c, g, or t
  misc_feature (276)..(276): n is a, c, g, or t
  misc_feature (310)..(310): n is a, c, g, or t
  misc_feature (349)..(349): n is a, c, g, or t
  misc_feature (355)..(355): n is a, c, g, or t
  misc_feature (390)..(391): n is a, c, g, or t
  misc_feature (576)..(576): n is a, c, g, or t
  misc_feature (579)..(579): n is a, c, g, or t
  misc_feature (600)..(600): n is a, c, g, or t
  misc_feature (605)..(605): n is a, c, g, or t
  misc_feature (619)..(619): n is a, c, g, or t
  misc_feature (627)..(627): n is a, c, g, or t
  misc_feature (636)..(636): n is a, c, g, or t
  misc_feature (645)..(645): n is a, c, g, or t
  misc_feature (649)..(649): n is a, c, g, or t
  misc_feature (683)..(683): n is a, c, g, or t
  misc_feature (699)..(699): n is a, c, g, or t
  misc_feature (732)..(732): n is a, c, g, or t
  misc_feature (867)..(867): n is a, c, g, or t
ggcggcggagcgattaacacaaccatgagagccangaacgcccaacgccgccagcggcgagggcgcaacgggagagggcccgccagggcgggcgcagggcagagcccagangcnnncggccnggccagcaggaaccctccccaaggagcaggcacnggggcaggctngggggggcaccagtaaccccaaaggaaatccgggagggatggaacaggacaggattggaggggagggggcggggaaagggggcgcaagaagcngcagcaggaggcgggncggcgccgacggaccggagaaacagagaggaagnaccagggacaccaacacccaggaccaaggaggcacacangaaccntcccaggaaggggaggggggggaacacaggggcgnngaagcacacgccaggcaagccacagaagagcggacccagccggggggcagacacgcacgcagggggacgcaacgggcacaggcacgcacacccgggcgcggcgcgggggacgcggaggccgcggggagaagaaggacggcgcgggcgccggcagaggaggcgtggcaaggcgtggaggggggctngtnacgccggccagcagacaactnttctnagatgctgaagatnctgccatngccgccatngccactgtnggtngagggagttgccatacagatggaggggcagtttncgctcacacccacttnatacagcagcaggcccagcagcaaaagcgagcncaaggcagccagagcaatgcccacagacagcatggcggccagcggcgaggcagggggcaggggcggcggccagcccggccagggtcaggccggtgaccagcagcacgaggccacttagcagcaccacgagggcgntggcccctccaccactgcgc

SEQ ID NO: 575500 - DNA, 152 bp, Homo sapiens
  misc_feature (61)..(61): n is a, c, g, or t
  misc_feature (80)..(80): n is a, c, g, or t
gaaaccaaaaatattcaagcactgccttatacaattttactggggttctattttacccctnctacaagctcagagacttnggagtctcccttcaccatttccgcggcatctacggctcaacattttttgtagccacaggcttccacggactt

SEQ ID NO: 575501 - DNA, 1134 bp, Homo sapiens
gcttctttccgcgccgatagcgctcacgcaagcatggttaacgtccctaaaaatcctgccggcactttctgtcagcacgtgtggcaagcaccaaagcccataacgttgacccagtacacgaagggcacagggattctctgtacgcccagggacaagcgggcgttatgacaggcacgcagagtggctatggtggggcaaaattaaggccgagtttatcctggaaacaaggcttaaaaacatagaaagaagatggtgctaagggcatattgagtgctgttgagccccaaagtgcgaggaatctaaggagaatgctggttattaaaagatgcaagcatttgtggaaactgggggcaggcagcattcaaggacagcagcacaaggtgccaagttgcatcccagtatcctaaaggtggtcaatctttcgaattaatttgcaagcacgattaaaacatctgtgcaggttctcagtgtccaaaaaagagaaacaagaaaaaagaggaggcgagaaaacccgaaggcaacacgtgcgacagcggacggaccgcgaacgcccacaagagacaaaagacaaaagaagaatacccagagagcgcagaagtcgaaagaccgaagccgcccccccgagaaacgagtcacgggagaacacagagggggacacaagacgacggggtaccacacagaggcagacaaccgcacgtgcacaaaagaaaaacacaagagagccttggtgagtactactccaaaaacacaaacaatcggaaagcaagacgccacacgggggggcagcaacaccaagcgagcagaagcgtcaggacaacaacagaacacacagacggagtacgaccaccagaggagagagcaccaaaaacggggaagaaaaaaacaacaaaaagagaagaggtaggcacgcaaagaaatgagacagaccacccgtcgaaataccaacaaacactataaaaggccgccgcgacgcggtggggggccagagacacgcaacgcagacagagctgaaccgccacaacacaaaatcggacagaggcacagaacaccacaatgagaaagcaacaaagaagagaacacgagagacaagaacgaacacggaagcgcaacgacacagccacaagccgaaatagc

SEQ ID NO: 575502 - DNA, 1083 bp, Homo sapiens
ggagtgcacctgtaatcccagctacttggaaggctgaaggcaggagaatcgcttgagcccaggaggtggaggttgcagtgagccgaggtcacgccacttcactccagcctgggcaacagagcaagactctgtctcacaaaaaaaaaaaaaaaaaaaaaaagggagtgtaagcctggaattgggggaccccaaaaaccggtggtggctctcccctaatggggggcttgagctgggacccttatgggtgtaagacacagtcccctttaagctttaagtcttgtggtgtttcctaaaacagggaggcagcgtctttgcactggtacgccacctagcatcgttgggggaattggtcgtggggctacccccttgaacgccagcaaaatttcaaagaggtcgtcattgccaagggccaatgagaccgaacctccgtggggtacttcagctcgcagggtcattccagggcccagggggcctcttttcggatccaggcagggtaatggtatctccttggcacggacggggcgtttttccccttccaggggagtagcggttcccttttgggccggggtgggtcatagacactgttcgttccaggatgttgagggcctatatcggcggggccttcacactctctgcccagggccatatcttaatgggggtagaagctgggtactccagcgtgttcagcacggtcctctttactcttggcccttggctccgtgcagcagggaacgaaagggcgctccttctatatgtgcgtgcacttggttttgggcgctggtatgtagtccagcccccctgtaagtagtgccgggggggtatctccctggattacatgtcgccttagttgcagcgcttaaagccccgcctgcgtgctgatagctgagcgtgcggtctctgtgtcgcatacacgggtgtacggttgtttgggacccacgggttcgcccaccgtgttgctcgggtacccccctgcgcggggggtctccgttgtgccgggccaaccccagtgtgcggtgtggccccctttccggcggtcgcgtctcccggccctcgctgtgcaggtgctggggggcgccactccgt

SEQ ID NO: 575503 - DNA, 143 bp, Homo sapiens
tttttctttttctttcattctttctttccttctttctttctttttttctcttctttacacgttaattctgagcatattcatttctcttctaagtcgtgaagtctctgaaggcataaattagttctaatttttcctggtctcct

SEQ ID NO: 575504 - DNA, 668 bp, Homo sapiens
ctgacgtcaacccaatcaacattatcatagtactttaactataggcaaaatatgtttttaaaataatgagcaagggccgggagccatattgatgccgaacttagtgcggacacccgatcggcatagcgcactacagcccagaactcctgggctcaagcgatcctcccacctcagcctcccaagtagttgggagtacaggtgcacaccaccaggccccagctaatttttgtatttttagtagagatggggttttgccatattgaccaggctggtcttgaactcctgacctcaagtgatgcgcccaccttggcctgccaaagtgctgggattacagacgtgagccactgcacccagctccagccttgaaattcttaatcagatataggttgagtatccattatttgaaatatgagaccagaattgttcatattttggattttttggattttggaatatctgtagtatacagatattccaaaatgctctctagtgagcatttcctttgacatcaaaaagtattagattttggagcatttcagatttcggattttcgtgtgttccttgagacagggtctcgctctgttgccagagtttagtggcataatcacggctcacttcaggctttaacttctgggctcgggtgaacctcctggctcagactcttgagt

SEQ ID NO: 575505 - DNA, 217 bp, Homo sapiens
acacatgaaacaacaccataatgcataagtggcctatttagaacccaagactttgcaaactgatctctcccccgtgaaggagtagagcacattagcaacaatgtacattaatttatggattttcattttcatagttttatttatgtaaataattatcatgatgttatggagcttgcagtatacatgactgtcaaatatagattcttgtactttgtac

SEQ ID NO: 575506 - DNA, 197 bp, Homo sapiens
gattagagtttgccaggccgaatagataatgaggatgtaagtccggtgggctattatcagaatgactgccccggtaaacaacagggggtttggatgagaatggctgttactacgagggctatgtggctgattgaagagtatgcaatgagcgattttaggtctgtttgtcgtaggcagatggagcttgttataattat

SEQ ID NO: 575507 - DNA, 964 bp, Homo sapiens
gtctgtatgaggcgcgatcgaaagagaactgtgatccactgggaacgtactgtgaagtggtgagtctctgaccagggcagctctcattctggacccgtaaccttccatgtatggactaagctgggacaatggcagatggtggtgagatcatatataataatagggtgtatgttgtattcccaatgtgatagttgatgccctgtggttggctcaggagagataagagagtatcagtctcgcacgtcatgcatatggagtcagcgggggaaaagtagatggtgcttgagaatggtgtgaaatggttgccatctcaggagtagatggcccggctcacttctggttatctgtcaacctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctataatgttttaaagacctcagtaaccatttcagcctctttccagcaaacccttctccatagtatttcagtcatggaaggatcatttatgcaggtagtcattccaggagtttggtctttctgtctcacggcattgtgtgtttgtccgggactggttgggtggacaacgttagaattgctgaagatcaaccattcagactgtgtgtctgtggaggtcacgaaggggggggaaccttctgggtcttggacttccacctctccatttcattgggtccacggttgccctgactttggagcacgggtgctgccggttgcttggggcttgaggagcacctcggcaaggcctcgcacgccttcccaagcaaagaagagcccagagagaatcattaggaaccccgggggatactcaccgcattctccagggcgacttatagtactttactactttttttg

SEQ ID NO: 575508 - DNA, 337 bp, Homo sapiens
tacagagtgaatgtagagaagagtctcattctgtcacccagactgacgtacagtggagagatcatagctcacggcacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatctt

SEQ ID NO: 575509 - DNA, 708 bp, Homo sapiens
agagctgagtttgaggcgctggatgacccgctgcccttagagagagcgcgctctgctccctgacttagcgctactcaacccagccacacgtaactcaaggacagactcaggtacccagggacaccccctgccttgcctagggacttatgggagtcgaatcgaaccttgttttgggagagttgtagctaggaggagctaacatttggaggctggtgagacagaagcaatcaaactgagagcccaggcctgatgatgttccaggtaaaaagccacgggacacctccattgttgtgcactctgctaatgaggcatgacttctttcggacctgtcttagtattaattattgctttatttttttgaccagataacatacttgcggcatatgtcataaattttcactggaactaagggaggatcactgcatttatggaaaactataggaagatcagataccatgctactacttgatagaactctggcctagcacatacgagaagggacaggtaacggcacgatcatagatgataaggctaaggattgagttgtggaatttggacgcacgttcagacactgcgaaaatcctttgttgacaatagggatacataaatccatgttagtatgcacccggctcctccaaagagggcgttacagtacccgttggttccactattcagaagataccgtcgattgctcacaaagggaataac

SEQ ID NO: 575510 - DNA, 285 bp, Homo sapiens
atggcgggcgcccctcccccagcctcgctgccgccttgcagtttgatctcggactgctgtgctagcaatcagcgagactccgtgggcgtagcaccctccgagccaggtgcgggatataatctggtggtgcaccgttttttaagctggtccgaaaagcgcagtattcgggtgggagtgacccgattttccaggtattctccactggttgaatgcaaatggaagccagaggaaaagggaacccttgacacagttttcatatagattggcctccagggcagacagcag

SEQ ID NO: 575511 - DNA, 353 bp, Homo sapiens
  misc_feature (66)..(66): n is a, c, g, or t
  misc_feature (75)..(75): n is a, c, g, or t
  misc_feature (78)..(78): n is a, c, g, or t
  misc_feature (92)..(92): n is a, c, g, or t
  misc_feature (233)..(233): n is a, c, g, or t
  misc_feature (291)..(291): n is a, c, g, or t
  misc_feature (325)..(325): n is a, c, g, or t
ataaatgtaaagttctaatttttgtttgtagctaaaggttgactcttagggataatatttatattnatagtattnatntatttatttatttngatacggtgtctcactctgtcgcccaggctggagtgcagtggcatgatcttggctccctacatcctccacctcccgggttcaagtgagtcttctgcctcagcctcccgagtagctcggactacaggcacatgccgccacgntcagctaatttttgtatttttatagagacgggggttcaccgtggttggccaggctggnctcgaaatcctgacctttgtgatccgcccacttnggccttccaaagtgctgggattacagtt

SEQ ID NO: 575512 - DNA, 82 bp, Homo sapiens
ctggccgcatcggtatttattctgtgacattttcctcattgaagatattttaacatagattaaaatacatcaatatttcatg

SEQ ID NO: 575513 - DNA, 456 bp, Homo sapiens
  misc_feature (92)..(92): n is a, c, g, or t
  misc_feature (102)..(102): n is a, c, g, or t
  misc_feature (107)..(107): n is a, c, g, or t
  misc_feature (112)..(112): n is a, c, g, or t
  misc_feature (128)..(128): n is a, c, g, or t
ggtccttcccaatgggctcagcacccaaccttgcagatttcattgccattggacgccgtcacaggcaacttgccaatctgagtaaggagttntctgacatanaatanatacnaccgagggtggccaantttttattcaatccaagcggaatcaccaataacctgtgccactcattcaaatttgtcgtaacgaatgttctcagccttcacacccaacttcgaaaacttggcaattgctgcatcaatcatcgcgggcggcccacacaagtaggcctgaacctgcggccaatccaactctagcttgtccagctcatctgtcacgtagccacgcgcaccgttccagcttgaattggcgggttcctctgacaacacctgcttgaagttcagtgagcctcgccagccttgctgaattcgacctatttcctcatcggcatacaagtcgcgctgggtacgggca

SEQ ID NO: 575514 - DNA, 412 bp, Homo sapiens
gaattagtggtaattccagcagtttagtggcataaaatactgatacccccacatgaaaatctcattgccatcaccaatttttgattcagtagtaccaggtagtaacatttacaaacctacaaggagggtcaggtgcggtggctcattcctgtagtcccagcactttgggaggtttaggcatgtggatcgcctagggtcgggagttccagactagcttgaccggcatggagacaatctgtcttttgctgggaatacaaaattggccgggcatgatggtgcatgcccatggttccggctgctctggagggtgaggcggtagaatctcttgaacccggggggcagaggttgcggtgagctgagatcacgccattaaactcctgcctgggcaacaagagtgaaattccatctcaaa

SEQ ID NO: 575515 - DNA, 116 bp, Homo sapiens
taggggggctccccttgcccttccctccctatcactccaaattggggtgggctggaggaggccccagcccagctattgtaaaagcttttttttttagtaaaatatcccgaggttta

SEQ ID NO: 575516 - DNA, 267 bp, Homo sapiens
cacggcggcttgtgcctgtagtcccagcactttgggaggcaagatgggcagatgtcttgaggttaggagtttgagaccagcctggccaacatagggagaccctgtgtctattttttaatttctctttcttttttcttttttttttttggaaacggattctcactctgtcgcccaggctagagtgtgcaggggcgcaatctgggctcaaggcaagctcggcctccggggttcatgacatttctccggcctcatatgtcagtttccggg

SEQ ID NO: 575517 - DNA, 392 bp, Homo sapiens
  misc_feature (46)..(46): n is a, c, g, or t
  misc_feature (91)..(91): n is a, c, g, or t
  misc_feature (185)..(185): n is a, c, g, or t
caaagtttctcagtgcgattccaggggaaagttggaaaccaacatnaaaaaatcaaaaaatacaattcaggatataaatgaaaaattatcntaaaaacaaatatttctttaaaaaacaaaacaaaaaaaaacagaattagtggggcgcaatgactcatgcctgtaattccagcactttgagaggncaaggcaggcagatcatgaggtcaagagatcgagaccatcctggccaacatggtgaaaccccatctctactaaaaatacaaaaattagctgggcatggtggcacacacctctagtcccagctactagggtggctgaggcaggagaatcacttgaacccgggaggcagaggttgcagtgagctaagatcgcgccactgcactctagcc

SEQ ID NO: 575518 - DNA, 430 bp, Homo sapiens
ccgggagcccttaacccttccaagaatagaaaaaagctctatagtacattaccgtagattattaattgtaacctgctaaagtcaacagtcctggccaggcacagggacaggttcacacctgtaatcccagcactccgggaggccgaggccggtggaccacttgaggtcaggagtttcaacacagtgaaaccccgcccctaccaaaaatacaaaaattggctgggtgtggtggcgcgcgcctgtaatcccagctacttgggaggctgaggcaggagaatcgcttgaacccgggaggcagaggctgcagtgagctgagatagcaccactacattccagcctgggcaacagagtgagactctgtctcaaaaaaagaaaaaagaaaagaaacttggaagccatttcagaaagactccaggaaggccagcagcca

SEQ ID NO: 575519 - DNA, 117 bp, Homo sapiens
cccgcggtacagtgcgcaataccaaacgcccctctatcgtctgatccgtcctaagtcacagcactgtcctacactcgtccatatctcgtccctatgtcctaggctgcatggacatca

SEQ ID NO: 575520 - DNA, 407 bp, Homo sapiens
attccaaagcattcaatttggttacccccaggtttttccaagcccttcgctgttaaaagacggtcaggtaattggaatgggaccccctataaggcggattgggtaccgggccccccccccaggtatttttttttttttttttttttttttttttttttttttttttttttttttttttttttttttttttttttttttttttttttttttttttttttttgaattgtattttttattgaaaagaattcaggctgaggtgggaggattacttgagctcaggagtgtgagatcagtctgggcaacaaagagagaccattgtctcaaaataaataaataaataaataaataaataaataaataaataaataaaaatttcaaaggaataaaaatgagaaagtagagctggg

SEQ ID NO: 575521 - DNA, 418 bp, Homo sapiens
  misc_feature (330)..(330): n is a, c, g, or t
ttctcgctacaacagctaaaacgtatgtagcaatttccattacgaattcttctctcggcgactggttacgtggtgcagtgtgccagctaattctaaatactaggagtatcactttgctgatttctaggttaactccacttgggtcaagagcacactccagaggaattcaattcaccgagataagcggaggttttggtcaacgttccatcagcgtgtaaagggggcacacagcctgtcaggggtgggttccctattcttcctgtcaggtgaaatgtgtgaatctggctttgaaatcttcatgctgacttgtgagtacagctgagctgctgngacaaaggcccaccatcccaggccccaagtccttcccttgtgttagcccagggcaggggtcaaacttcacccttcaacaccttcctgg

SEQ ID NO: 575522 - DNA, 469 bp, Homo sapiens
attatatcctgaatggaaaaaaagtacatcagcaggccgtgtgaaatctgaagactgtagattagataacggcactgctatcaatgtagaatgtccttaggtttaggaactacacatagaagtatttagtgctttttcaaagtgccacagtttggatgataaatggtgatggtgtggtctcccttcccagaacccagtgagaacccagccctctccactcccaggctgtggacctgtcaccatcaaccacctcagatggccactcaactcctcaccactgagagggcattcagatgagccaggggctggtatgccctgggacacacaggaccccttgtcagcaccatgccaacctgtgcacccacaaagtgtgtccgttcctctggcaccttgagtccctgataaggtctcagccaggtggggccaccactcagctgtgcccggcagtcagaagtaagagtctcgggac

SEQ ID NO: 575523 - DNA, 631 bp, Homo sapiens
  misc_feature (55)..(55): n is a, c, g, or t
  misc_feature (174)..(174): n is a, c, g, or t
  misc_feature (204)..(204): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataaaagctgttatagtgttgatgttgagtagtgctaatgtggcccctccaattagatgaattaataggtgccctgctgtaatgttggctgtcagtcgtacggctagggctactggttgaataaatag

SEQ ID NO: 575524 - DNA, 324 bp, Homo sapiens
ctaattggttcttcgatgacggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggcgtcatcgaagaaccaattaggagtaccgagctggaat

SEQ ID NO: 575525 - DNA, 4587 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (4286)..(4286): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575526 - DNA, 615 bp, Homo sapiens
  misc_feature (382)..(382): n is a, c, g, or t
  misc_feature (558)..(558): n is a, c, g, or t
  misc_feature (607)..(608): n is a, c, g, or t
  misc_feature (610)..(611): n is a, c, g, or t
acacccaaactaatttttgtatttttaatagagacgggatttcgccatattggccaggctggtcttgaactcctgacctcagatgatccacctgcctcggcctccgaaagtgtttggattacaggtgtgagcccggcctgagattatttttttctaaacacttatttaaatcttggaatttgtaaattaacattcattcaatcataatatggagtttataggaaaacagaaatgactcatatttaactaccattctcctctgtctccatttttccttctaaatgttataatgatttttttcttagttgtttactatacatatacacacatatacatatgataagaatttggtgtactcagtgtcatttgacaaagaaaaganttgaggatgtaaaatgagtttgtttcttttggtggagtgagaattttgttataatcaagttagctaataattaagtagaaatattgaaaaagagataaaagactacacattgggtacagtgtacacggcttggatgatggttgcaccagaatcttagaaatcaccactaaagaacngtattcatgtaaccaaatactacccattccccaaaacctattgaagtcnncnntgac

SEQ ID NO: 575527 - DNA, 544 bp, Homo sapiens
  misc_feature (70)..(70): n is a, c, g, or t
ttaagagtatacttggaaccctcggagtcctccatggaccaggaaccagggtggcccatggacttccaancaaaggctccactgtggggctgcttttggggagagactcacagctggacttctctatccgacccatgcaatgttagccagcaacccaattaccccaccaatgctttgccccataaggagataggaaataatgggaacttcacaggaagaaaccagtattggataacatacaccaggcttacaggaggccaggccccaagtaattacccatgagacagaaagcctacagggtgggcgggtgcttttgactggctggggattattgatacattactgatacatcacttcttttataagcatatgtaaaacggagtgctactgaaagtcgaaggacagcttccggggagtcatgaactctttcactatctcatccgtgacctccttgcgccgggcctggtgctctgcgatcaagggctgcagaacctctatgagtgccttcttgagctcaccggtgagcactggtccgctggtgtaa

SEQ ID NO: 575528 - DNA, 4212 bp, Homo sapiens
  misc_feature (76)..(76): n is a, c, g, or t
  misc_feature (477)..(477): n is a, c, g, or t
  misc_feature (3911)..(3911): n is a, c, g, or t
cccctcccgagtcctatctgtcagttgggtccctagttattgattataggtttatttcgaatccgattcagatgantagtcagtgtgagctgattattactagtatggttccggacattactgttatgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575529 - DNA, 1115 bp, Homo sapiens
ggtgtacaccatctttgccatcctggcagtacactgttgtcttaaccaacatggcgttccacatgacggcctggtgggacttcgggaacgaggagctgctcataagcctctcagccttgaggaaatagcgattctgatacccttcattcctgctatggagaggacgcaatgcccatctgaccagaaacaatgattacacgataccatttctggccttcctcgcaccgccaggatcctctcttgggcttacgtgaagatggggcgaagggtaagaacggaagggtgtaggccgaaagctcacgccctagtgctcgctgcgctatctcctctctcagccctcagtatggcgccgtggggtcctccatgacgatcacctttacctgacgaggccccagagagagctgacctcgggcgagagaagcttccacccattgtgctgctacacatagaatagagaaacatttctcgtggcaggttcccaattggacccgacttatatgccaagtgtgtgctcgtggccctcttttaccacgagggccgacggctattcaactatcgggcggccagggatagtcacccgcgtgcaggccgttgtgagctgtgcgtacgccgtgttcaaggcccagcgggttcccatctcttctgctgtgcgaccgcgcggtgggtcgctcgcggctatgggcaccgtgaaccggtttctttgtcactgttgtcccatatcttggccttaggcattctgcacggccgcttgttgtgccccggagcggtctctccccgtgtcggtggaacgtgcggccaccaaggggagttccctgtagagtccccgttgaacttttcgcccatttatgggagttcaggggtgcggtggttgccccctagggggcgttttgtgtaccccctgtttcccccaatttcttgttagccccatcgggatgttgtgccccagtggatgttcttgcgccccggagcggaaatatggctaagacacgtgtaattagcactgtccccaaagagggtggtgctacattaatccaaaggatcagagggtcgggacatccatggactagtattcactccgaagttgtgaaagagtagtggtggttcaccgaaaatcg

SEQ ID NO: 575530 - DNA, 3759 bp, Homo sapiens
  misc_feature (3458)..(3458): n is a, c, g, or t
ggtaggtagggctcatctagaaccagaattaggaataaggattgagaagaaaactcagcaagggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575531 - DNA, 103 bp, Homo sapiens
tggatcccctcccaagaatgaggaactgaaaactgttccatcaagcagtacactcatttatataccatgttgggtgctcatgactcatggaataatcgaattt

SEQ ID NO: 575532 - DNA, 719 bp, Homo sapiens
cgcgtttaagataaaacactctcgatgggaaatttgtagcaaaacggtttataatgcgaagcgcgtgttctttcagagctttcaaaatcggaaaacaaggggtagaacagtcttaggatcgtgaaaagttgattataaagacagcctaattctatttgtgtcataacaaagttggggcatgccttattctccttaaggccaagacagggtaatgtcccacaaacacttggtgactcaacagtacttagcaaatgcttaaagagctgcctggcgttcccttccgtttacgtaagcgtcatgcacaataacccgtgtatatgaagacattctaatatgtatagtcacaccgtgacacttttggcaattaggatcctagtgaggagcatgggcggtcgtggaacttctctctggtatgataggatttagttaggtaattcagctgtggatcactcggcttctctcacaaaaaaccaagtataccctggatttgttagaggcgacaacagtgcagatgttcttggtcatttaagcttagattttgagcgtatgagtccttagcagagtggttggcatacatatgtaatttatatgaatgcaatcggctcttgcaccagtatcagtatgttaaagagaatacgcacctgtctgggagaaaaacagttaaagacttgatgtattaaacaagcggataaatagtagaaaaagctaataaaattaaa

SEQ ID NO: 575533 - DNA, 393 bp, Homo sapiens
aaggatctctgcacacggttgggtcaagactacatagcctacaacttgctatgcccgttccctcccacacatctctaatgcgaatgacacactgattaacacctgtatgggaacggcaggctcacaggtttaagcattggtttctactacaaggagtgggatatggaggtggtcaagtcttacgggtaatatcaacattctctctagatcgcagggggtcagtctggctgactcgaccatacgtctgtgtaccacataagggatacattagtaaagtagggaaagggttatatgtgtggctggcctgttctttagagaggaaggtgggatggtatctgctgtgtacctgtctcagaccaaacctggggctggaccagtggccctttcttctca

SEQ ID NO: 575534 - DNA, 3687 bp, Homo sapiens
  misc_feature (3386)..(3386): n is a, c, g, or t
gggtcaggatgtaaagattattcaaatgtgctcttgtgttgtgattagggtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575535 - DNA, 4508 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (4145)..(4145): n is a, c, g, or t
  misc_feature (4147)..(4147): n is a, c, g, or t
  misc_feature (4153)..(4155): n is a, c, g, or t
  misc_feature (4161)..(4162): n is a, c, g, or t
  misc_feature (4167)..(4167): n is a, c, g, or t
  misc_feature (4473)..(4473): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccnangcctannnatagtnnccctnctctcaataggaggcctgcctccactatcaggatttatgccaaaatgaataattattcaagaaataacaaaaaatgaaagcatcatcatgccaacactcatagcaataacagcactgctaaacctctatttctacatacgactagcctactcctcctcactgactatgttcccatccaccaacaacataaaaataaaatgacaattcgaacacacaaaacaaataaaattacttcccacaataatggtattatcaacactagtcctacctataacaccagccctctcgtccctaaactaggaattnaggttaacacagaccaagagccgtcggctaattta

SEQ ID NO: 575536 - DNA, 3791 bp, Homo sapiens
  misc_feature (3490)..(3490): n is a, c, g, or t
cacgccgatggtggtgtggagaaaagggaaccctgttacactgttggtgggattgtaaattggtgcaaccactgtggaaaacagtatggtgattcctcagaaaactagaatagatctaggaatcccactcctgggcatctatccagagaaaaccatgactcaaaaagatgcatgcactcggatgttcactgaagcactattttcaatagccaagacatggaaacaacctaaatgtccatcggcagaggagtggatcaagaagatatggtacccatcggcgacacgccgatgggtcttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575537 - DNA, 3538 bp, Homo sapiens
  misc_feature (3237)..(3237): n is a, c, g, or t
cgtccgtcgaccgctgagctgtgagaatgaccttgacttctgtccactacatggagccatgttcaggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575538 - DNA, 1455 bp, Homo sapiens
gatgcctggaccagctgactgtcatataaacctttcttatttgagctacggcttgacaccagaccgtgaccctacgacacgacaaccttgacagcctacacacgacgacacgtggggattgtggtgggctacgtctcttccaacgcttcgggtgacacccctgacatacggtgacacacacgttcattcacgactgcgacgacacacaattcgacgtccatacatggacacacacagacttgatatacgtgactttcgccatctatgcacttcttatggaatcgacacccacgtgtgtaccacagttgaacaagaaatctatcctacaagtacctatgagcgcgcataacctaacacaattgtatgaggctgagaacaacggctgtacacattacgtacctgcagctagcgtaatgtgcctattctgccgcagacacgttacgtggaacacgtataacacggtacacggtgtgcctaacgcgaacaacacggacacttagcctctaccattccccttacacctacacctttgtgccgtgtctctcaccttggacactggatttcgcacaaacatgttgggcatttctgacaggggggaactatccacttaacatttttccttaagttagggattgggacaccacgcaccgtgtctacacttgtgtgtgccttaagcaagaaccgagtcaggcacagtgcttaacaccgatagcttggttgtgacacgagcaagtcttggcgttaataacgaatcaacgttacaaacagcgttaacaacattaagtgcttaccacgccgccgggattaaacgaggcttcaactcttacaaagctttgagcacgaatgcccgacgacatgttgccaacgcgctatgggttagttaacattgttgccactggtatcggagccttaagatgggccgcctttacgccgtgcttgggtaacaatctttggggcggataagggcatttaaaatattaaaaaggttgtaatctaatttattcaaagggaacgcgagcatcattataacacagggggtaaataaccatttagacgttggacttcgcactgtatagaagacatggggggacagatcaagttgggtgtagcgtaaacggggggaacgtacgtatagatatatgggtatgataatgtaactatgcggtttggaagaaagcaaaaccccgacgagcgtcacaaacaatggccacacggaccgacaacggcgcgcacaccgtaccgctagaccacacacatcgtatacacggcacgacaggaatggagccattctaccatcaggggaaacacactcccgatacaaaagcagaatggtggctcggaccaccagacgctgggcacacaacacacgatctacctgttcacagccccacaaccaaacccgactactagctgcaaacgccacgcacaaccggagcgatacacaaagaagggggg

SEQ ID NO: 575539 - DNA, 112 bp, Homo sapiens
cttgattagaggatccccccgactagccgacagctctgcttcgcagctcagtgcgcttcctgcgcgcactgggaggcgcttaagcgtcaccaagcacactcacttaatgaaa

SEQ ID NO: 575540 - DNA, 3528 bp, Homo sapiens
  misc_feature (3227)..(3227): n is a, c, g, or t
ctcggcccgaattctaattacggggagaagggggctggcgaggttattaagaaaaggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 575541 - DNA, 207 bp, Homo sapiens
gcaaaattggaattgagaagcagattcctttttttaaggtgctttgtgctaaggatgaggatacaattcctcagctcttggtagacttttgggagctcacctagtgccatgtctcccagatgtggtactccaggactctctttcaactcacatcacagtacacctggagattgtctagaggcagcctcctgacacacacattgcgac

SEQ ID NO: 575542 - DNA, 738 bp, Homo sapiens
cgcggtggctcatgcctgtaatcccagcactctgggaggtggaggcgggtggatcacctaaggtcgggagttcaagaccagcctgaccaacatggagaaaccccatctctactaaaaatacaaaaaattagctgagcgtggtggtgggtgcctgtaatcccagctactcgggaggctgaggcaggagaatcacttgaacccgggaggtggaggttgcggtgagccgagatcatgccattgcactacagcctgggtaacaagagtgaaactctgtctcaaaaaataaataaataaataaataaaaataacttcagccaggcgcagtggctcacacctgtaatccctgcactttaggaggccgaggcgggtagatcacccgaggtcaggagcctgagaccagcctgaccaatatggtaaaactccgtttctaccaaaaaaatacaaaattagccaggcatggtagctcatgcccgtaatcccagctacttgggaggctgaggcaggagaatcacccgaacccgggaggttcacctgaactgcgggagaagttcaggttcagggttcacctgaacccgggagaatcacctgaactgcggaggttgcagtgaggcgagatcacaccactgcactccagccttgggcaacaagagcgaaactccatctccaaaaaaacaaaattctcaaaacaagggctagtggaacatgagaaaataggagttctaaggtatatgtcaaagg

SEQ ID NO: 575543 - DNA, 873 bp, Homo sapiens
gggctaatatccaaaatgtattaagaaacccaagcccaatagcaagaaaacaactgtctttaaacagggggcaccaaggacctcaacttaacatttttcagaggaagacatgagtggccaattgattgatacatgcaacaaaaatgctcaaccatctctaatcattcagtgagttgcaaatcaaaactgcaagatattaccttacaccttttagaatggctattattaaaaggatgaaagacaggtgctggcaaggatgtggataaaaggaagtcccaacattctgttagtgggaatataaattagtatagccaatttaggaaatatatggtgggtcacttaagaaacatataagtgtacaagattatatgatgcatcgtcaacgaatttactactgaggtatatatccagaaggaattgaagcagtatgtgagatcttggacttcacttattttgaaattgatgacaaagctaataaatggacaaagacttacgttatcataacagatgaatggacatggaagatgtgtgataatatacatattggaactatatataaaatcctgggaaaaagacaggaaacaacgtgcatatggtgacaaccaatgggatgaaattctgggaagggttatcaccctagtgcacctaaaggatggacgcaaaaagaaacacaggggacaaccagaaacgcaacgggcgacaatttagcgtaacactccagaaacaagcggacagacatgcagcaaatcaacaacagaaacaggagcgataaaccatcagcttaacaacagtcaggacaaccgattgggaatagcacagcatgaggcacagccaagcgaacaaaccagaccgtgacagggcaaaacaaccacg

SEQ ID NO: 575544 - DNA, 350 bp, Homo sapiens
aacgtcagaggacaaaactaaataagtagagaaagtataatactggagtaaataggagtggactgggtgctgcctgtaaatagggaggactccaagccgggaaggaaaattcgctttgccacacctgtatcaattttttacaacttttttcctgaaagcagtttagtccatacttcgcacggacatacttgtgccttctgtgctaaggtaaggtatccgagcctcgatgcaagtccagctgggggtgttcttagggtggaatgtgatgtgcaggagcaaacgtggcaagagagtggccttctgttggtgactttgaaaaggcccacatgatacaattagagaatgccaag

SEQ ID NO: 575545 - DNA, 941 bp, Homo sapiens
  misc_feature (346)..(346): n is a, c, g, or t
ggtatttacgagcgcagcggctgacgggccggatcgccttcgtcggcgcccggccgcaaccgttcgtgcccggacgcgtgcctcgcctgtcgcggcgctcacagattaacctgtgagatgagccgacttcgggacaaccaaatatgctctgaacaggcactgagaattcgcaagaaagaagacaaggaacacgtgaggaacaaaaaaagcaggagtataaggaagcgaaaaaggactggcatacgaaacatatgtatattgaaaagacaagaaaacattccgctacatacgagtcatgcatagatacacgtacaaagaaacatagagcaacaatgaaacacaaagntaaaacaacatgaatccaagcatgagtcacaataaagaacaaaatgataaaaacgaatgcagtcaaaacaaaagaatgcaacatccaatgcagacctgaaaaaataaaaaccaaaagtccctaacattaagaaccataacatcacaaaaacccaaaaaaatccaatggactaattctacataaagacattgacaataaacatgtcctaaaaaaacaaaaaagaaaacaaaaaaagaaaagaatacaaatttgaaaaaacaaaaacataacaaagaaataccagaaaaaaaaacaaaagaaaataaaaaaaaaaaaacaaaaagaaaaacaaaataaagtgatacatcgaaaaaaaaagaaagaaaaaccagaagacttaatttcacaaaaaagatgaaagacacaacaatacaaaacaaaaacatattaaaaaaaaaacgaaatgaattaataaaccatacaaaacaagaataaaaacaacaaaacaaacaacaaaaaaaataaaaaggaaataaccagtaacacaaacacaaaaaatgaaaggaagaaaaaaaacacaataaagttaaaaaaataacaataaaaaatagaaatt

SEQ ID NO: 575546 - DNA, 812 bp, Homo sapiens
  misc_feature (354)..(354): n is a, c, g, or t
gctatcacggtgctgctgatttagtctcgaacacactctctcatggtatagctccgtatcggctctacagtggcagcgagtgcagagcagtgagagggttcagtgacgtgcaagtgggcgcccgtcacgcgagtgcgcgcggtgcgcgaatgtgtgagtcgcggttgcgcgaagtcgcgttggatgcattgcgcgcgcgatcgcgatgtgccccggtgcgcctcgagtgaagccttgcgtttgcgatgcctttgccggtaggcgcctttgcctcgggggggttgggaactgcgaattttggttcgggaagggcgccccgattggggaacccggtggcaactggcggtactaaantgcgcgagggggacgtacttacgggagccactcttgcccgcagatgcttgatagcgccaggctctgtggtgacccgaaagatccagcaaagggtcgggcccatatatctatttaagtcagattttttcctcccaaaaaggggggcggaaaaagagtgcgccccacaagtagcgaaaacaaacctttggtgtgtgcgccatatgataatcattaaccgcgcaaagacgacactggcgacggggagacactaccgcgcgtataaacatttttaccccacggggaggagtgttttatagaggggacaaacaggagcacattctcctacacaaggtttttttatgagggccccgcacttattaacggggggacaacaacgttttttgaggggccccccaaaaaatgtgtctcacgccccagcaaaaagggttttagatgtggccaacaattgtcttcacaag

SEQ ID NO: 575547 - DNA, 536 bp, Homo sapiens
ctacggtgtatacatatgtactgatgacatgatgcgtacagattctagcgtgtaaagcagcccaagacgctctagagaccatgcaagcatatatgctccggttctctaacaagttaatcaggcgctacaaatacctggagaaaggtatagaagatagaagtaaaaaagctagctagctgtactatagcacgggtcaattcagacgtcggagaggaacaatgctagctatagtatgcactaggtgtacttctaggctaaatggaacacttacatagcatccattcttacatagcctttataatagaaaataaggttaaagcaggcgtttcagcaagctatatgcttgtgaagctacaaaaatcatggataaatgaacaacagctatcaatagccagaagctgcaagtcttcggacagtcagcatggataacaagacttgatggaacactaacctgccaataatgccaagttgtagtcacactaccacaaaatataaacctgaggcaggctagacatacctttccgactatgttcgga

SEQ ID NO: 575548 - DNA, 306 bp, Homo sapiens
ccacgcactcagggcttttcaatccaggttatagagaaggggtcagatttgtcaaacaaattgtattatcaaatctctttgaaaatgtctaatgtcctaatacaccaagaaatgaggcaaatagaattctgatatgggaaaatgtctcaatattttctaaagagaacctttaaaccagaagagaaatgtgtactactaagcttggaagcaaataacaaaaggatcaactttctaaatagtttgcagagaggaaaaatggctcaaataagtttaaatggcagctaataaatattccttttatgaaaa

SEQ ID NO: 575549 - DNA, 345 bp, Homo sapiens
  misc_feature (313)..(313): n is a, c, g, or t
  misc_feature (335)..(335): n is a, c, g, or t
tgagttcaaaatgggtcataacgcagcagagataacttgaaacatgaacagcgcatttggcccaggaactactaacgaacatacagggcagctgtgattcaagaagttttgcaaagcagaactagagccttgaatatgaggaacacagtggccagccattggatgcttcacttcttgaagcatcttgacagctttttgcaggtgaaatgcttccacaccagcaggatgcaggaaaaatgctttccaagagtttgttggaatccaggaagcatgggtgtttatgctggcagggattaaacaaatttattttctncgttgggcaaaaaagtgtttgnttgtaatggt

SEQ ID NO: 575550 - DNA, 172 bp, Homo sapiens
cgaggagagaggtaggaaaacgatagagaaagacataagattataaggctcctcgacttggcactgactccacattcctcctagctctggcactaacccttaagagcagaagcagtcattccccagtcctcccttcccccgggatacagctccccgggaatacagggcggac

SEQ ID NO: 575551 - DNA, 341 bp, Homo sapiens
aagattttttttttaccccccaaatggggggtttccccccaaaaagggttttttaaaaaaaaaaaaaaaaccggggttttttgggcccccaggggagggttttgggagcccaaaaaagtccttttcccccccgggggggggttgggagggggttccccccccccttacccccgctttttttaaaacccccgttttttttagggggttttttttttcccccttttcggggggggtttttaaaaccaaactggggggtttccccctggaggggttgttgggccccttttttgggttggggcccttggggtttttttaaaaaaaaaaaacccttttttttggga

SEQ ID NO: 575552 - DNA, 1120 bp, Homo sapiens
gccatggggcttgtcggctcctgaagctggcaggcgacgtccgcgtccgcccgggtcgtggcggcgggcgcccagcgcggtgcagaggaagttcagtagctcagtgtgcaggggcaaactgcgctatggaatgtggccatttccgtacttggggagtaaagcaagcaaaagactggcagaacgcagcagagtgataactgtagatggcaatatatgtactggaaaaggcagacttggaacacagaaatagcagagaagactaggcttcaagcacgtttcctgaagcggggattcattatccagacagtaccacaggcagatgggcaagcccctcgccaccgactataatggcaacttgtagttcggagaaattttacagatgatccgagaagcaatgatcggcaacagttaccgactgcaggcctggttgtacagcagatcgccatgcgtgcagtactcagatgccttgtgagcacgttgcatgacctagaggacaagggtgtggcgtcggagcgctccatcttcagggactttgtgttcctggaggcgaagtgtacaaccagggattcatccgaaagcagtgtgtggaccactacaacgaggtgaagagcgtcaccatctgcgattaacctgccccccccactggctgattacatcgatgtgcccgttccagaggtccagaaggcggattcagcaagaaaggagatccacatgaaatgaagatcactctggctatctacaggacatcgggaactggctattaagaaaacctttcttctctgcagatgcagtgaacacagtgccgcggttccccaaaatcctgccaggagagacccacgattcccaaaacgggggtaaggcacatgtgacacccgaaagtccaaacaggggccacagcaacagaggagcaaccgcagtagtaaacacgggcaaacagagccgcgaaacaacagggggagacaaccaagagcaagagtccgcgcgagaccacgagccacaacacaacacggcgaccaccaacacgcagcagaaacacggtgaccacagagaagacagctaagacgacgctaggcctaaagagcaccgcacaaatgagctacgaacgcaccaaaacgagact

SEQ ID NO: 575553 - DNA, 416 bp, Homo sapiens
gctgctaaacagaaaaatcacagcgcgcggtccagccccgtgcgccccgcgggctacaggcctcgccctgcccgcccgcccgcatcccagggacaggcagacccgcatccccgccgccgtcggtcccgggactccccaggctccgaggccccccacgcccggctcccgccccgacccctcggaggcgccgggccactcctacgccccgagctgcccggccgccgcccctctgtcccgcgcgccaatcggcggcctccttgactaaataaggccaggagcgccgggcgggcgccccccgtccgttacttccgccccccgcccgccgtgactcaggcccggcggcgggcggggatggcgctgccccgggccgggcttcccggcggaggcgggcggggctccggcggcgccgaagtcgc

SEQ ID NO: 575554 - DNA, 367 bp, Homo sapiens
tgctacttagttatgtgccagcgattattaaagtggctcctcctgacttaccatcggaaagctgtgtgagaggctctctcactcacttatgtttggatctccgtaaacacagtttttgttcttggtctatctctggctacaaccaagtgtgcttatgaataattttattgtctaatcatttgatgtttgttttcctgtatgattcataaacagagtcacataacaggtgtaatatctcctttattctttccttttctatttcctcgatttcaacagttgctgccacgtgcttttcaatgcatggtccattccgagaggatctgcttcaaactgttttattgcctaattgaggataaatccgtgaggg

SEQ ID NO: 575555 - DNA, 512 bp, Homo sapiens
aagagaaaaaatggtaaatagacatgaaaaggtatctatcaaaatatctctaaggaagttggtatacaagttggctacatattagatggattctagttttcctatgatctttataaaagcttatcacttataagaaaaaaagttattttcattttggaaaaatatctataccctttactaagtccctttacattcaatgaccaagattcccacaacactctgggaagctgaaagatctgaaagtaacacggccattacatagatgaaggcagcagacctaggaaatgtaaccccgatggactgactctgggctggcattctcccacccctgcggctactccagactcagaggaatgtggcaagtcagatgccagcttgggccaaaaaaactccgatcattttaggagtctcaccaagcccagttacttcctctgagatggtaacagcaataggggaacacttcaaagacaaagcattcagaatgattcatgctgcaccacctccccctggtg

SEQ ID NO: 575556 - DNA, 651 bp, Homo sapiens
ttgcggtgagcatctcatgtgggcacagttcatgtgccccaaaacaattacaacagtaacgccaaagaccactgatcacagatcaccataacaggtatgataataatgaaaaagtttgaaatattgcaagaattattaaaatgggacacaaacacatgaagtgaacacgtgatgtgagaaaaaaatggcaccgatagactcagagttgagccagccgtgatattcaattcatgaaaacgcagtatctgcagagcacatatagcgaagtccagtaaaacaggtgcacccatggaattcatgttcattctagagcaactggaaaatacacccttgccaaagaaagtctaatgtcccctcatgtgtccaaacgttctggccaggtgtggtggctcacgtctgtagtcccggcactctgggaggccgaggtgggaggactgcttgagcccaggtggttaaagctacagtgagctaggatcacgccactgcactccagcctgtgcggcctcaggctctggggctcaaatgaacctcttgcctcagcctcacgagtagctgggactgtaggtgcaggccgctatgctcagctaattttttattttttgtaggatagggtctccccatgttgcccacgctgtgctcgcgccaaaggag

SEQ ID NO: 575557 - DNA, 193 bp, Homo sapiens
gtaaagcagggttaagactgcatgatatgtggaaacagccagtttccaatgtttagagccatccaggcaattatcaatattccatgggagcctttcggccaggagcaggtcaacccccagatgaaatgatttactgctggaagtggaggaggtttcctgccacctctgatgaggagatgagccattgccagga

SEQ ID NO: 575558 - DNA, 181 bp, Homo sapiens
gttggcaattcgtcgtcgtcgtgtggtctcagtagcatctgtcacacgagcccttcttggttgggctgacattccccagagtggtgacaaaccctgagctggtctgcttgtaaaagtgtccttaagagcatagacactcacttcatatttggtgaccaccacgacgaattccggcacgacg

SEQ ID NO: 575559 - DNA, 624 bp, Homo sapiens
cccacgcgatcggccccacccaccacgagtgtgaggccggtcccccccatgacacgctgcgcctcactgcattgcccgactacaccctgaccctgcggcgctccccggatgacatgccactcatgacccccgaacaccatcactatgatccccaactccctggtagggctgcgagacattgcaccccttataacacctttgccgcagggttcaacagtaccgggctgacccactcacactccacgtacccgggttatagctccatactcagaagcacagacctaatctccagtgctcacctctcctcccagagtccatggaacacattgcacacgacactacacacatcacgacgcagacacacacaacacacagcacatatactgtatacgacactgcacccacagcccatactagcagtatcacaccatgacacaacacactagacgagaatgttggcacatgcatccccgctatagtacagaaacacactaacatacgggaacgtaacaccgtgacacaacaccacctttacaactggcggacagcagactgaagtccctcggataacaccagaggcacccgatgaaaacgagcacgctgacagccgagctccctgacacc

SEQ ID NO: 575560 - DNA, 1161 bp, Homo sapiens
gacctcgggactgtgtggaagagagagtgactcgacagcagccagtgacagccagctgaatgccaggccagtacgaacgtatgttgtcgggtacggtgattcctaggcgtgccgttgactgcactgcccatcacgaggtcgtaaacctggagggcaccaagacggaggtagtgtgatcacctgctgatcattggcttcgctgccaggcgtctggcgtcgcgaggagttgcaagcgagtggctcgcgtgtctcagcgctcccggggtgagtggtggattgaaagaggtagtccatcgacagaactattgtaactgcgttggattttgcgctaagtcttaccatgaggaggtatttctccgaaatctaaggcttcgtgagcataggtgcatcgaagacttacctcgggcctagtatatttagacttgcaatctctgacatacggtgaatcttctcccaataagggtcgcttttgcgaactatacagggaaacttgttgaccagccatagggcttacatttaactcaaaataggcatcccacacagagatcccttctacgttcacgttccttcctagaggacttaaggtagcggaacttgaaaaccttttaacttacaacggtatacaagtcctataaggagccacatagcagcaaactgacgcaaatgtggagctaaacaacaatgggaatccaaatgttggtaggaaaaggaactggtaacggaatcacaggacgtggaacattacaacacaagtatcaccacatattcatatatagtaagccactagagcgcaactttccatcctgtggcgactgagtcggacattaccttctgtggtgacctagcgtatcattagggcaaagcaagaaaacaaggaaccagtatctgaggagcccactgtgggcctgtggtgtggaacgaatgctgcccaaagtcgtcccgatccacgcgtagtggcactggcggcagccagtgaaacaaatgcagtaacacgacttcaaagcccgaaggcgagtgtacagtggaacccccagcgatagcatccccggagacggaatgcggtgacagcggctcgtgacagtatacgaagcccaagttcaggaaccagatggttgtgtctgccgcggacgccaaacggcctaggcggacagaggacattaa

SEQ ID NO: 575561 - DNA, 813 bp, Homo sapiens
  misc_feature (17)..(19): n is a, c, g, or t
  misc_feature (210)..(210): n is a, c, g, or t
  misc_feature (284)..(284): n is a, c, g, or t
  misc_feature (296)..(296): n is a, c, g, or t
cggctccagcgccatgnnncatccaggaagttcttcgttgggggaaactggaagatgaacgggcggaacagagtctgggggagctcatcggcactctgaacgcggccaaggtgcggccgacaccgaggtggtttgtgctcccctactgccctatatcgacgttcgcccggcagaagctagatccaagattgcgtgtggctgcgcagaacntgttacaaagtgactaatggggcttttactggggagatcagcccttggcatgatcaaagactgccggacccacngtgggtggtccntggggcactcagagagaaggcatgtctttggggagtcagatgaggtgattgggcggaaagtggtccatgttctggcagagggactcggagataatcgcctgcattggggagaagctagatgcatgaagggaagtcctggacatcagcttgagaaggtggttattacgatgcgagacaaatggtcatcgcacgataacgtgaaggactggagcaaggtctgtcctggcctatgagcctgtgtgggccattggtcctgggcaaggactgcaacagcccaactaggtcccaggaagtaacacgagaagtctccgacggactggctgtaatgtccaacgtctctgatgcggtggctcagagccacccgtatcatttatggaggctctgtgactggggcaacctgccaggcagctggtcagccgactgatgtggaatggttccttgtgggtggtgctacctcaagcccgaatgcgtggacgtcatcttggccaaaaaggagcccattcatttcctaccttcg

SEQ ID NO: 575562 - DNA, 330 bp, Homo sapiens
  misc_feature (81)..(81): n is a, c, g, or t
ggtgtagtaaactaggtctatggtccttagctggagtatctgtgatacaggtcattacagatgccaaggatgtgctaagcnctttctgttaactcattgaattaccaaaaatgattttataggccagtatctttgatccatcgaaacgtaaaaattctcaacaaaattttagcctactgaatccaactacatataaaaaagatcatacaccatgaccatgtgggattcatcccaaattcacaaggatgagtaaacatgtacaaaacattcaatgtcatacaccacattaaaaaaaaaggagagttaaaaaccagaagtgaagttcgacag

SEQ ID NO: 575563 - DNA, 1050 bp, Homo sapiens
gagtaaattctgcagacgtgtttgtccctgcggcgctccgatggggacagtgtggttgagagctggggaacatcgggcactatgagcggctgcggtgtctttctgggcaccatgggtgtggtcgtgcgtgccggggtctggtggtctctaccgagtaaccggtgtgtagtgcgcatcatgtccgctgtatgatgctttcgtgctccagcatgcttttcctgaggcgatgtccaggatgagtgacgtttatcctcatttgcgcagaaagatttaggcgagagatgaatcgttcatttgcaaatccagtcgatgctcgttgcgcgcacccgttggcgaagtattcttcacttgaacgaaggctggtacgtccctgatgctagttgaccgaggagagcgtgccaactccgcagatgcaaaaggttgggggagagagattgaccgagcctagggcggtgttggaggcttgcagatcccacaaagattatggtgtccatggcgctttctccgaataccaatgtactcacgatgtagaggtgagagtcattcaggccatggatgggtccactcattgctgtaggcctggcaagacggcatcaggctatttggagctcatggggggatcatcttgggtttggtgctgaggaggctatgaaagccaatagtatgtttgtgctaaaggctggtctctcgcggagtcgcatttggagcttctgccttcacggaagtccgagcccagtggggagcgattgtgaggctcactgcggagctgagcgcacttctagttgtgagacagaacgtcttatattctccatgtttccaatggtctggagttactactggaaggacggccactatttactgtgttgcacagactgaggtcgttgattccggtgattagtgaaagaaaaaccacagctcctttgaacgagattggggcgcgtatgggaaccgaaaaaaatggcatcggccaactggtaatcttgtagaccccatttggacacctggaggcgaatggtttggtgcaacaacacaaagcgaatgagcatggtc

SEQ ID NO: 575564 - DNA, 142 bp, Homo sapiens
aggcaggacactgtagtaccaaggttagatagaggggtggtgtttgtggtatgactggtgatcatttctgtgcttgggacaggtgtagaagatacaatgctactggtgacgtggtgataactgtattaggtggctgctgggc

SEQ ID NO: 575565 - DNA, 277 bp, Homo sapiens
tttttaaaaaaaagtttttttttttgggccccccgccaaacaagtgggggaacccaggggacaacggggaacccttggtaatttttcaaaattccccccaaaaacccgggcccaaaagaaaaccaaggggccgggggtgttttttgccccccggttttttccccccccaagaaaaaaattttggaaaaaccccccttttctggtttttaaaaaataagttcccccccgccaggttacaaagaaagcccgggcccaaaaaaaggtttttcccccttta

SEQ ID NO: 575566 - DNA, 116 bp, Homo sapiens
aaagctgtatattacttaaatgtacataaatcctttccacaaaggttcttgcgcactatgcatgggaatgtcgttcttcttcggcaatcatgctccttcccttctgtcgtcttctc

SEQ ID NO: 575567 - DNA, 228 bp, Homo sapiens
acgggagtgtaaaggatggcgagtatagctgttccggtgattgtaaaggagggcgagtgatagctgtttccgtggttgtaaaaggaggtgtcggagtcttagctgtggcgctgattgtaactggaggttgagtgatagcggagtggtgattgtaacaggagggcgagtttaagctgagatctatgggtaaaagaagctctctctataacctgagagctggggccttct

SEQ ID NO: 575568 - DNA, 218 bp, Homo sapiens
cgaaaatacacacacatcacaccacagacacacacaccacatatacacacaccacacacacacaccacatacacgcacaccacatgcacacaacacatacatacacaccacatacaccatatatacactcaccacatacacaaacaccacatacacacacaccacatacacgcacaccacattcctctggctatacactgtttgtaggaggtagcact

SEQ ID NO: 575569 - DNA, 180 bp, Homo sapiens
tggagtgtgtgcgtgcaggtctctgtgtgtgtgtgtgtgtgcggggatgtgtgtgtgtatgtctgggtctaggtctctgtgtgtgtgtgtctgggtccaggcatctgtgtgtgtgtgtgtagtatgtgtgttggtgtgcagagtattggtgtggagagtggtgagcaggtgctggtgtga

SEQ ID NO: 575570 - DNA, 266 bp, Homo sapiens
atccccccatttacctcgggataagggttgggtttttgtaaaaaaaaaaccctttaaggttcctttattttttttttgggctgcgggtaggctttttttccaaacttttttttccatcgccccttaatttaaagtggggtcccttaatagtttcccgtccgttttttttttaagtgtgggtggggttccaaacaaacccaatttttttcaaagaaaaaaatttgcaaatttaaagttaaaaaaaaataaaatttctttttttttta

SEQ ID NO: 575571 - DNA, 351 bp, Homo sapiens
caagtatataaaatgcacattgttttataaatctcctcaaggaaatcaagggcagtgcgaaattcttttggttcatgaggtggtgtaaggtaatagaatgaatgggtcaaagttgtgcaaagtgatgcaggtttagtgtcctttatctgaaatgcttgtgaccagagttgtttcatattttgtatttttccatattttgtaatattttcatataccatatgagatcacttgtggatagtaacccaagtctaaacattatattgatttatgtttcatatatatctcttatacactttgcccgaaggtccttttatattatatttttagtaattctgtacattgtagattgga

SEQ ID NO: 575572 - DNA, 370 bp, Homo sapiens
  misc_feature (100)..(100): n is a, c, g, or t
  misc_feature (164)..(164): n is a, c, g, or t
cttttgaaggtcaaactgggggagctgccaaactggatctttatgcgggacttcagtcctagggcattttcggagggtttcaaaaaggtttctcccggtncttccaccagtacctccatgttaagaaggggagcatttcggggattaccatgggggtggcatgntacgggctctttagatactcctttttctacaagcatttcaagcacgagcgggtccgcaaataccccttaaaagggccccctttgccccccccccccccccggccttgggccgagcccctttgttaggaacccaatttccatcggtggtgaatcctttcatatcctaataggaattaaccccccaataaaacatggctggggcgtga

SEQ ID NO: 575573 - DNA, 686 bp, Homo sapiens
  misc_feature (556)..(556): n is a, c, g, or t
gctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggcttctttttttttttttttgccaataacttaggatttagctgctttcattaactaaacaatattaaatgccttatttatgaaattttacatagagataattttcctttgggctgcattcattgctntataaccctcatgccaaattttggcatttagcagagataaatatgaaaccactggttcattaaacttaaccaatagtggatgttgacacttctgaaccattctaattctaatttaattcatgactacttt

SEQ ID NO: 575574 - DNA, 568 bp, Homo sapiens
gatcccatctaggaatgtgagtggagcatctctgccctggcgaccatcgtctgagatgtggtggtgatgctgcctctgcccctgcacccgtctgggatgtgatgtgagctgcctgtgtgccctggctgctgacccgtctgggaggtgaggagcgtctctgcccgggctgacctgtctgagaagtgaggagaccctctgcctggcaacttgcccctgtctgagaagtgatggatgcccctccggccctgcttgcaacaccccgtctgggaacgtgaggagtggtctccacccagccatgacaaacacacaagtaggagaagggacagatgggagcgcgaccaggaaacacagtaacaaagcaagaagagagcaaggaagtggaaaaggcaaggaatggtttgaaggagagaagcctggcgcatgagctggtgcgagtgagagaaaatgataacaacagaagagtgaagggacagataaaagcacaaagagacagaaccaaaaagagaagaagaagaaaggaagaaataactaagacgtaaagaaagaagcgacctaatagaagagaaaa

SEQ ID NO: 575575 - DNA, 235 bp, Homo sapiens
agctcaacccatcccactccaaccccacccaacacacatagcagtgcacaccccacatcacaccctactgtgacataagcccatcctggagattctccaactatagcctggcgttgtagacctatttctgcagatgcacctaggcgcacacacacacacacacacacacacacacacacacacacacacacacacacagactctgctatgtgtgtatatagtctacacacatata

SEQ ID NO: 575576 - DNA, 107 bp, Homo sapiens
tggggactattctgaaccagccagacttctccagtaatgacatctcgaccatgtgtggaggtgtcatatgctgggtcccctgcacctccagagttggtccgagcgga

SEQ ID NO: 575577 - DNA, 420 bp, Homo sapiens
  misc_feature (373)..(373): n is a, c, g, or t
  misc_feature (394)..(394): n is a, c, g, or t
taaattatgctagacattacaaaatttgcctctagattcttgtgggtcttctaggtacatgaccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttaagtattgtctctgcaccctactgtctgatgaacttggttgttcccaattggccaatgatgtaatctaaaaataattaaagttttctattactttgatagggtgttttgaattccngtttgactttcagagggaggnggaaaggccataggatgggcctaaac

SEQ ID NO: 575578 - DNA, 870 bp, Homo sapiens
gtttaccgagaataacctacataggcagtgccatcaggtgccaaagttgaagggccaaggaaggctgttagcagtcaggcagtttaaaacggcggcagtgaattggaaccggcccctataggggcagatggggaccggcccaccccacgaggttgatacgttgatttttcaaaagcagtgttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgtattatacagaatgtatccatcaggcagacaaggggtctgaagtcacaggctcagtagcccaactcagacacaaagccacagacaatatggatgatggtcctcttacccagaaactggagacaactttgcaggcaccctggctgcgttcctgataatgcctagagcatgtagcaatgttcaaggcaggtgccttggaatctgctgtgagttatgcagtactaaccaaacaaagttgctaaggatgagatgttgcaacatttcttgtgtgcacttttttttcctgacatctttttttccttttaggattcattaagtcatatacttagtcccctgcaaagaagaagacagatgtcccagagcagactgaaagcggggcgtgggatcctaggcaatgcaggagggcaggtg

SEQ ID NO: 575579 - DNA, 949 bp, Homo sapiens
  misc_feature (23)..(23): n is a, c, g, or t
  misc_feature (28)..(28): n is a, c, g, or t
  misc_feature (43)..(43): n is a, c, g, or t
  misc_feature (62)..(62): n is a, c, g, or t
  misc_feature (67)..(67): n is a, c, g, or t
  misc_feature (297)..(297): n is a, c, g, or t
  misc_feature (351)..(351): n is a, c, g, or t
  misc_feature (378)..(378): n is a, c, g, or t
  misc_feature (380)..(380): n is a, c, g, or t
  misc_feature (413)..(413): n is a, c, g, or t
  misc_feature (430)..(430): n is a, c, g, or t
  misc_feature (450)..(450): n is a, c, g, or t
  misc_feature (453)..(453): n is a, c, g, or t
  misc_feature (456)..(456): n is a, c, g, or t
  misc_feature (459)..(459): n is a, c, g, or t
  misc_feature (486)..(486): n is a, c, g, or t
  misc_feature (490)..(490): n is a, c, g, or t
  misc_feature (511)..(511): n is a, c, g, or t
  misc_feature (520)..(520): n is a, c, g, or t
  misc_feature (546)..(546): n is a, c, g, or t
  misc_feature (551)..(551): n is a, c, g, or t
  misc_feature (590)..(590): n is a, c, g, or t
  misc_feature (667)..(667): n is a, c, g, or t
  misc_feature (688)..(688): n is a, c, g, or t
  misc_feature (694)..(694): n is a, c, g, or t
  misc_feature (707)..(707): n is a, c, g, or t
  misc_feature (711)..(711): n is a, c, g, or t
  misc_feature (713)..(713): n is a, c, g, or t
  misc_feature (720)..(720): n is a, c, g, or t
  misc_feature (726)..(726): n is a, c, g, or t
  misc_feature (734)..(734): n is a, c, g, or t
  misc_feature (746)..(746): n is a, c, g, or t
  misc_feature (786)..(786): n is a, c, g, or t
  misc_feature (790)..(790): n is a, c, g, or t
  misc_feature (794)..(794): n is a, c, g, or t
  misc_feature (804)..(805): n is a, c, g, or t
  misc_feature (811)..(811): n is a, c, g, or t
  misc_feature (889)..(889): n is a, c, g, or t
  misc_feature (927)..(927): n is a, c, g, or t
ttttttttaagaaagatgccagntcttnattaccagggaagcngtgtgcacgcgcgtggagngtccnttggagctgaccgggcccttaccttctcctgcttgtcagaggtgagtcctggtacccagcacggtggcctccgggaggctttgataggtcagcctttgctgcctcccagctcagggctcctccaaggaacctgcggggccccatgtgcccacagcccgaggagggaagcaccgaccgccctcctcgtggcacgctgcactccagcgctgggcacttcacctgcttcctgncttgcggtggtcaggctcgatactgactccactgatcggcacattgagttccanaagcatgcaaaccgcgtggatgctgtngngacattgtttgcaccgtttatacaaccagacanctttttagactaaattngtgtccaaactaacacgcanggnaanggnctccagctgcagctccctgggtctgtnaggncggggagcggttctaccggantattttttnttttttttgtattttttcttttttantcganaaggcggtctggatgtgctcatacgtgggcaggtcagtnaggtcacccagggcggccactgccggcttccctcggagcatcttagaagcgactctcttcacatcttccggcttcangttgcggatgagcgtgcacanctcgtncggcactttctgnaacnantggcagnacctgnctccccanatcctcgaagancacaggcctggattccaggttcatcatgagcattgatggnagcngcgncttggctcgnnccagcnccaccgggtccacggttccgcccattaaaataaactcctttgtgatgatttctaccatttctcgaacctgtcttgggncggcgctggcatggatgcaaaggagggcagtgtcctcntagctgtggtggtaggaggtcg

SEQ ID NO: 575580 - DNA, 180 bp, Homo sapiens
cacaaacaaatggtgtaatgctagcctggtcatccaaatattataatttttttttatattttttgggatttgttttgagacagggtctcactctgctgcccaggctgcagggcagtgatgcaatcatggctcactgtagcctcgacctcctgggctcaggtgatcctccctaagacccta

SEQ ID NO: 575581 - DNA, 1990 bp, Homo sapiens
  misc_feature (23)..(23): n is a, c, g, or t
  misc_feature (28)..(28): n is a, c, g, or t
  misc_feature (43)..(43): n is a, c, g, or t
  misc_feature (62)..(62): n is a, c, g, or t
  misc_feature (67)..(67): n is a, c, g, or t
  misc_feature (297)..(297): n is a, c, g, or t
  misc_feature (351)..(351): n is a, c, g, or t
ttttttttaagaaagatgccagntcttnattaccagggaagcngtgtgcacgcgcgtggagngtccnttggagctgaccgggcccttaccttctcctgcttgtcagaggtgagtcctggtacccagcacggtggcctccgggaggctttgataggtcagcctttgctgcctcccagctcagggctcctccaaggaacctgcggggccccatgtgcccacagcccgaggagggaagcaccgaccgccctcctcgtggcacgctgcactccagcgctgggcacttcacctgcttcctgncttgcggtggtcaggctcgatactgactccactgatcggcacattgagttccanaagcatgaaggcatgtcagagcgggagcgacaggtgatgaagaagctgaaggaggtggtggacaaacaacgcgacgagatccgcgccaaggacaggaagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagagtgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgtattatacagaatgtatccatcaggcagacaaggggtctgaagtcacaggctcagtagcccaactcagacacaaagccacagacaatatggatgatggtcctcttacccagaaactggagacaactttgcaggcaccctggctgcgttcctgataatgcctagagcatgtagcaatgttcaaggcaggtgccttggaatctgctgtgagttatgcagtactaaccaaacaaagttgctaaggatgagatgttgcaacatttcttgtgtgcacttttttttcctgacatctttttttccttttaggattcattaagtcatatacttagtcccctgcaaagaagaagacagatgtcccagagcagactgaaagcggggcgtgggatcctaggcaatgcaggagggcaggtg

SEQ ID NO: 575582 - DNA, 358 bp, Homo sapiens
ctggaatgggaagtcttttccccactggatgtgcctgtttggtgggttttggaccttcccagactacatttttaggaaaggcctgtttggagtagtacacttaaagaccctggccttttttggtggaaaactgttccaattttgggggttttttaagtgggtaattcttttcccatcctgtttttttttttcatttcaggcagcatggggtccacttttgtccccaaacctaatgttttaatccaaatgcaaattggttccacatttttactggagggtaatcagtttttaaaattcacacacatgtaatcgaaacgcaatactataaagttctactggtgagactcctgaaaaaaaa

SEQ ID NO: 575583 - DNA, 1772 bp, Homo sapiens
tctgggcgcccggcattggaaccccccggcccaagcctgtcaagccccgcaacagcagcggggtcagaaaaccaagcagttcatgcccaccctctcccaaagggatgtcaacttctcagaggaggagttccagaagcataaaggcatgtcagagcgggagcgacaggtgatgaagaagctgaaggaggtggtggacaaacaacgcgacgagatccgcgccaaggacaggaagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagagtgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgtattatacagaatgtatccatcaggcagacaaggggtctgaagtcacaggctcagtagcccaactcagacacaaagccacagacaatatggatgatggtcctcttacccagaaactggagacaactttgcaggcaccctggctgcgttcctgataatgcctagagcatgtagcaatgttcaaggcaggtgccttggaatctgctgtgagttatgcagtactaaccaaacaaagttgctaaggatgagatgttgcaacatttcttgtgtgcacttttttttcctgacatctttttttccttttaggattcattaagtcatatacttagtcccctgcaaagaagaagacagatgtcccagagcagactgaaagcggggcgtgggatcctaggcaatgcaggagggcaggtg

SEQ ID NO: 575584 - DNA, 377 bp, Homo sapiens
ctttccaggaagaagaaacaactggccatcagcaaagatctggagtcatgaaactaccccccgaggatggctgggaaaagaagatccaggaactgctggtgtctgtactagttaccgccctgataggaaaggcagaagccatagctctcaccaaacctccagcatttaaactttgctgtggagtctacgtgaccccaccacgaggtgaccctcacctttccctccatacctggggagacagacatggcagtggtcactgaaccctgggatgacacgctacctcatcctttatgacaccctttgatatgttgcttttgatgcatttctttgtatcccatttggtttcatttttagcaataaactcattcttggtaaaa

SEQ ID NO: 575585 - DNA, 1448 bp, Homo sapiens
  misc_feature (23)..(23): n is a, c, g, or t
  misc_feature (28)..(28): n is a, c, g, or t
  misc_feature (43)..(43): n is a, c, g, or t
  misc_feature (62)..(62): n is a, c, g, or t
  misc_feature (67)..(67): n is a, c, g, or t
  misc_feature (297)..(297): n is a, c, g, or t
  misc_feature (351)..(351): n is a, c, g, or t
ttttttttaagaaagatgccagntcttnattaccagggaagcngtgtgcacgcgcgtggagngtccnttggagctgaccgggcccttaccttctcctgcttgtcagaggtgagtcctggtacccagcacggtggcctccgggaggctttgataggtcagcctttgctgcctcccagctcagggctcctccaaggaacctgcggggccccatgtgcccacagcccgaggagggaagcaccgaccgccctcctcgtggcacgctgcactccagcgctgggcacttcacctgcttcctgncttgcggtggtcaggctcgatactgactccactgatcggcacattgagttccanaagcatgaaggcatgtcagagcgggagcgacaggtgatgaagaagctgaaggaggtggtggacaaacaacgcgacgagatccgcgccaaggacaggaagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagagtgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccacta

SEQ ID NO: 575586 - DNA, 1260 bp, Homo sapiens
  misc_feature (1)..(1): n is a, c, g, or t
  misc_feature (725)..(725): n is a, c, g, or t
nttctggagggggtctcccccccaggtgtgggtcccgccatatatccgcgggcgtgtgttatgacgctgtgcggggccccgtgtgtactgttttgcccgggtctccttaaggggtttatcccggagggcgccctttgggggttgtcgcggaaaatttctggcgcccacctgtggcgccggggtttatcctccgggctccgccccgcgtgggtgcgacccccagtggggacgccccccccgtgtggcgcccgacacgcgtttgttgcgttcgcctgggtctcgaccaatgacgggcccacagcgctttccccacatttagtccgagagagaggtgctccaaacgagagaggagtccaacgcgagaatgttggtcatatatatcctcgcggggggcggctcgccgcacgcacacacccccttggggtgaccccctcgaagacggtgtctcgcccgctgccgggagtttcccacacactgtcccgctcacgcgctgagagagccccttctccccgtgtgtctcttcgggagccacacactgttgggctgctgtctgtgggtggtccgcgcctcctgtggtgtcacacacacacccccttctctggttcacatggggagacacaccccgctcgtgcttgtccctctcgtgggtcttttccacatatggcgcacatgtttgcctcgtatactctccgcgtgtaagatttctataggggacacacgcgaanagaaatgtggtttgtggcgaacacgctgagtaccgcggggagcccaacagaggccatatatgcgcctctcacacccgccgcacacaggtgtccgctgagaacacatcttgtgggccccctgagatttgtgtggacacattttctacagtgagaccacagttctgtgtgttgtggtcacatctaatctcccaccgggtgttgggtctcgttccacaggcgccacagtctgagatatagagatcacacgagaggcgcacactcactattgagaggccacagagaagcttcttgccccggtgagaccctggatatctccacccggatctcttatattttccacattctctctgcccctgccccccagagggccacaggagactcttgccccttgaaccctgatattccacacttatcctccacccttccacattcctctgccctggtctcccaccacacccgagagtcctgcatcagcccctttatcctcacccgcttttttaccatggccttccataaagtgtaaaagtttctggta

SEQ ID NO: 575587 - DNA, 1496 bp, Homo sapiens
ctggccacagtttcctgactgacattaaacagatacagaactatttaaattagagatactcatccgtttacaacagaatcctcttatattccacacggttttcaagtattcctttctctgcgtcattagggtaattaaagaaacccaagatttgtttcagcagcttttgatttccactggtaacgggataaatcctccatagcggctaacgtggaagacacctcacacatcacatcagcatgcatgccttgcccataccgcgtgacctccaaggtaccgtgtccaaatgacacgcagaataccctgctgctttcttggaataactttgacctgcacccccaactttgtctttcacaccttgaattgatttgctcccttctaagtttgctgctatatgtctccggcattgcaaaaaacgtgacttgcacagcaaagggtcagctctcatttctgtgtttgctttcccttccaaaggtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgtattatacagaatgtatccatcaggcagacaaggggtctgaagtcacaggctcagtagcccaactcagacacaaagccacagacaatatggatgatggtcctcttacccagaaactggagacaactttgcaggcaccctggctgcgttcctgataatgcctagagcatgtagcaatgttcaaggcaggtgccttggaatctgctgtgagttatgcagtactaaccaaacaaagttgctaaggatgagatgttgcaacatttcttgtgtgcacttttttttcctgacatctttttttccttttaggattcattaagtcatatacttagtcccctgcaaagaagaagacagatgtcccagagcagactgaaagcggggcgtgggatcctaggcaatgcaggagggcaggtg

SEQ ID NO: 575588 - DNA, 187 bp, Homo sapiens
cccgacggaaaggagcatgcaacaagcgggcttgactcgagaatacgggtcagtctgcgactgtcttgtcagagtgactgatgaattgaccttaatgaacagcgtctcgataatcgattacaacccgctgtctttcgagcgaagtcgaacgggcaaggacccgaccaggacaatgtcgaaaaacggt

SEQ ID NO: 575589 - DNA, 691 bp, Homo sapiens
gagcgtagactatgctctacaagccataatgacatcggaacacatagaggctatcatctcggggcctgcgactggtgttctaggtaccggtctcagcctccttagtcgagccgacgtgtgggcgcaccccgtggtatgcttcttaggtacttgaccgatatactaaccagcggttgatcggtcacagggccgtgacggttatgtaactaagtgctatcgttcgaataagtcaatgatccgcgactctagtagatgcggcatgtgcttgtggccatcttgacctatattacgcgccgtaagtaactcggggcccgccggatatggtgtttccccgtatctgccgatgtatgcttctgattcttatcatcgcgtttctcctactctctgctcgcatctgctagtagtggaggccaggagcaggaacaggttgaacaagtcgtacccgtcccattagacagggaacgtactcccacccgtggagcctccgtagacgctaacgcatctttctccttaacacctagcaggttggtctcctcgtatctgtaggggccatcaagtttgcagtcacaaacaacttatcaactattgaaaccgccgctggctataacccaagtaccaaaacgcccctcttcgatctgatccggtcctaagtcacagcaagattcctacattctccgtatctctcccagta

SEQ ID NO: 575590 - DNA, 281 bp, Homo sapiens
  misc_feature (15)..(15): n is a, c, g, or t
gcctctggagtgtanagaataggtggcatcatgatcgtgatggtccggtggactgtcagcagttgcgtggtggagacagaggtggcttccgtggtgcgcggggcatggaccgaggtggctttggtggaggaagacgaggtggccctggggggccccctgggactttgatggaacagatgggaggaagacagaggaggacgtggaggacctggcaatacatggataacaggcgagcatcttcagggacgcgccagaaatcggccctactagatgcagagacc

SEQ ID NO: 575591 - DNA, 237 bp, Homo sapiens
ggctatcacatatcacgggagtaactatccacttccatgctatcggatgtgtagggctccatgcaagaacttggaagaaaaaacagggcgggatggcttttgtttaaatgagcccgatcattcctttttctgcaactgagaattatattttcatcattggcttctagaagtcctgcaattctttacttttctttggtgcattattatctaaggtgccatcactggataatgtgatag

SEQ ID NO: 575592 - DNA, 442 bp, Homo sapiens
gagctgtagagagtgagttgagcatagtttgtgattttgagggcctctaaaagtgttaaagcagcggcagccgctgcacggagacatgagggctaggctaaaacagtaaggtcaagttgtttgggcagaaaggctacagggtgcggtcctggctcttgtgtaataattctgaccgaactaaccatgcctaggaaggaaaggagttgttgttttgtaagggatcgaggtttgggagattaatcggacacaagcagcagggagagcacgtgtgtttttatgagaattatgccaagataggtaacagatgaggatgaaatttgggcttgactgaagtaatggggtctgtctgtgaagccttgaggcagtacagcccaggtaatttgctgagcctgattggtgtcagggtcagtccaagtgaaagcaaagagaggctgggatgaca

SEQ ID NO: 575593 - DNA, 134 bp, Homo sapiens
tggtgctagggctcgccataggtacttgtgatatcattttccttaataggtagggaagccagccaactatcttggcatctctggaggtaggtgtaaagcgaagctcaagtatatacaagcattcaaatatgctc

SEQ ID NO: 575594 - DNA, 191 bp, Homo sapiens
aactatcatcagtgatacagcaattgaaaagctcaagaaagcttattaactttaaccacaaattaataaacattccaaccgaaagatacctcttattagttcccttcatctaattcagagggtttgttgacattatctgtgcctttgcatgcccttatgctgttttctagtactcacatatataatctgta

SEQ ID NO: 575595 - DNA, 143 bp, Homo sapiens
ggtgggcttgcccctaaagcctggcttgggttgaaaagtgttcccgccctaaggccttggtgccctgtaacctctttatgtcctaccggggttcttcctgaatttgagttttcctttaaatactcccttttggagggaatttt

SEQ ID NO: 575596 - DNA, 241 bp, Homo sapiens
agccgtcacaaacaatcatcgccctcctgctctgaggacagctctttgcagtgaactcaggcaatgacgccacggatatcgcagatgacgactgcccgaagccccccgagattgaacatgactatgtggagctctcgacccgctactagtgcaagaactactacaaactgcatacagaagaaggcagagtaccattttaacggtgggtgtcgtgaataaataaggttatagaatatgcacc

SEQ ID NO: 575597 - DNA, 123 bp, Homo sapiens
agttgcccgacacccccgtaagtgcccacaaggcagcttcctgtgtggcctatggcacagcccctcgtagtgagtaatttggggggtcctgccgtgtgctgtgggtgggtttcgtctgccgct

SEQ ID NO: 575598 - DNA, 416 bp, Homo sapiens
agatgggtttctagagtatatcccatcagaaatattgcaactagcttaaaataccagtacacgtgagtgtgaacattttaagtagttttatagtgtcccccagtcccgggtaggcaccatacgaactttctgagagtgtgactactttaaatcctgcatatagatagaatcatgcaatactatgcctgtggaaggtggttgcgtgcattgagggataatgacctccaggtacccccatgacgtggcatatgacgaggatttcccctttgtaaggttgaataatattcctgcgtgtgtgtgtgtgtgtgtgtgtgagttagtggattatctatagttgaaccgggggtgtgctgtattggtgctgaaggtagattcaagacctcacgaatgtcaaattcctggagccggatagcttg

SEQ ID NO: 575599 - DNA, 438 bp, Homo sapiens
gctctcagtgagagtatactatgatgagtatgaggaattgatatcaccgggttgaaggtcagagggaagctggcaaggtatgctatttgtgctatctaatggcgacaaaaatacaatattgcttcgatttactttagggagtgtaggcagagaagtcgtggctagtatctggggctatctttaggtccttcctaccataatagtcctcatggaaccaaaatgggggtacagacatgttacttgagtatgtctctcttacactatacaatctaggacagaggccaggcgtggtggttcatatcttgtaatccccacacttaggaggccaaggcaggagtgatccctctgagtccaggagttcgagaccagtgtaagcaatatagtaagacctatgttctacaaaaaatacaaaattagccaggcatggtggtgcaaacc

SEQ ID NO: 575600 - DNA, 913 bp, Homo sapiens
aaggataatgggaagtcgatcggatccctgcggatgcctggtcgctgcggcgatctcatcatgaccgcatttacgtcgtatgtgcctcgaacccggagtaccgttccattcatggtgctggtaccttgcttcaacacgtggctgtggtgcgagtgggaggaggcgcctcgaggacatcgcagtggaagtcgttgatggactcatcttgaggggctacggacggagtcagctcctttgaatatgggtatagcctgggcgacacttaacgaaaacgaggcatgagtctgtgggagaggtacttggctgcacggagaaggagtggatctcccaagactgtacattagcttggggaccacgtctggattcctagactggcacttggggagaggatagagaaagagacagggcttggagtaatccctaagcattcagtgcatgctattgagaatccggtggcctaatcgatgtgcaatgttgtttgcggcacggtttgaccgtgggtatatttgacctcacacacacgacatgtgttcttgactcgacgttagataactagtgctacccctctaccatcttcactttaagaactcctgcattgacctgccaaggaatttcgcggagtccagtgacccttgacgggaccagacctaagtgaaggtaggcgaaacgaccggatctccacaaaactattcgactggccctgggggttttaactgaattcttgtacgaagttcttgcgaacctcttaaattcagttacctcaatagattcactagagctgttgtaggctgtttaacccctcttgaaaagatactgggagcacctacagttgagaagtgggccaagccttgcatagagggtgatggaagccttgctggcgtaaccaattaccggcatggggcataatataagg

SEQ ID NO: 575601 - DNA, 838 bp, Homo sapiens
  misc_feature (111)..(111): n is a, c, g, or t
  misc_feature (615)..(615): n is a, c, g, or t
  misc_feature (620)..(620): n is a, c, g, or t
  misc_feature (649)..(649): n is a, c, g, or t
  misc_feature (673)..(673): n is a, c, g, or t
  misc_feature (747)..(747): n is a, c, g, or t
  misc_feature (751)..(751): n is a, c, g, or t
acagtgcttgttcggggcgctccgctggcttcttggacaattgcgccatgtgtgctgctcggctagcggcggcggcggcccagtcggtgtatgccttctcggcgcgcccgntggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgtgcctggaactttgagaagttcctggtgggccctgacggtgtgcccctacgcaggtacagccgcgcttccagaccattgacatcgagcctgacatngaagncctgctgtctcaagggccagctgtgctanggcgccccttctaccccggtggtntggcagttgcagtgctgctgtctcgggggggttttcatctatgagggtgtttcttctaaacctacgagggaggnacanctgatcttacagaaaatacacttgagagggtggtgtctgttgatcccagttttgcaacagggagttccatataagtgcggggttggg

SEQ ID NO: 575602 - DNA, 825 bp, Homo sapiens
  misc_feature (111)..(111): n is a, c, g, or t
  misc_feature (615)..(615): n is a, c, g, or t
  misc_feature (620)..(620): n is a, c, g, or t
  misc_feature (649)..(649): n is a, c, g, or t
  misc_feature (673)..(673): n is a, c, g, or t
  misc_feature (747)..(747): n is a, c, g, or t
  misc_feature (751)..(751): n is a, c, g, or t
acagtgcttgttcggggcgctccgctggcttcttggacaattgcgccatgtgtgctgctcggctagcggcggcggcggcccagtcggtgtatgccttctcggcgcgcccgntggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgtgcctggaactttgagaagttcctggtgggccctgacggtgtgcccctacgcaggtacagccgcgcttccagaccattgacatcgagcctgacatngaagncctgctgtctcaagggccagctgtgctanggcgccccttctaccccggtggtntggcagttgcagtgctgctgtctcgggggggttttcatctatgagggtgtttcttctaaacctacgagggaggnacanctgatcttacagaaaatacaccccagaaaggtggggggcccgtttaccacacccttgcacacgcagtttcccct

SEQ ID NO: 575603 - DNA, 1171 bp, Homo sapiens
  misc_feature (111)..(111): n is a, c, g, or t
  misc_feature (948)..(948): n is a, c, g, or t
  misc_feature (953)..(953): n is a, c, g, or t
  misc_feature (982)..(982): n is a, c, g, or t
  misc_feature (1006)..(1006): n is a, c, g, or t
  misc_feature (1080)..(1080): n is a, c, g, or t
  misc_feature (1084)..(1084): n is a, c, g, or t
acagtgcttgttcggggcgctccgctggcttcttggacaattgcgccatgtgtgctgctcggctagcggcggcggcggcccagtcggtgtatgccttctcggcgcgcccgntggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcagtgctgcgccgggcggattcggggcggggcggggggcggactgtgcggtagatggctggtgggctgccggccggtgtgcatagcgtgggtgccgtacggctccatagcggcggagcagtctgggctgactactcgtcgttctcctttcgtagtagctgcggaagcattgcgtcgaaattccgtctccgccgcttggggatagccgcatggcagggcacaaatcccgtggtgactcataggaagatctcgcctgggttggtggtaaagaacgttatctcatccgtacctctttgaccccgtgtttcgtaagcatggccttctctcctgtaggagagagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgtgcctggaactttgagaagttcctggtgggccctgacggtgtgcccctacgcaggtacagccgcgcttccagaccattgacatcgagcctgacatngaagncctgctgtctcaagggccagctgtgctanggcgccccttctaccccggtggtntggcagttgcagtgctgctgtctcgggggggttttcatctatgagggtgtttcttctaaacctacgagggaggnacanctgatcttacagaaaatacacttgagagggtggtgtctgttgatcccagttttgcaacagggagttccatataagtgcggggttggg

SEQ ID NO: 575604 - DNA, 693 bp, Homo sapiens
ggtcatctgatagccttattgcagtcttcatcattttcatcattggttcctatgtagattattggacagtttattgtagcactacataactgtattagtaagacatatgctgtcacacatgcatattaggcactttcatcattgaaacaagtcctgcatagcctatgtatacaaatagcaagaatgtttgctgttatatgaacaagatgtaatggggtggggggcaggggtaatttcaagttattaagtttataaaatgaactagcaattttgtacctggttgactctgtggtgcacttacctctgatagtgacgttgaattccggtatgtagaacaggggtgtagatggtattgtcagtttgctgttaacaagagtgagcaatgtccctctgtgtcctgtcagacttaaaggctgtcagtgtacacgtgggtattcgaataccagaccttacgtgtcacatagaataaatacaaggtggtatctagacgcatgtgaaatcggagtataaagttgctggctcttaggagagtgtgatctgaatgagtatggactgaagcatctatatatgcaatctagttgaaaagaagcttaattgcgggtattatggtcttgattgtgattgcagttttatggtatttataaggagatttgagctcattggggctgtttgaaatgctgtggctagaagggg

SEQ ID NO: 575605 - DNA, 892 bp, Homo sapiens
  misc_feature (111)..(111): n is a, c, g, or t
  misc_feature (518)..(518): n is a, c, g, or t
  misc_feature (653)..(653): n is a, c, g, or t
  misc_feature (658)..(658): n is a, c, g, or t
  misc_feature (687)..(687): n is a, c, g, or t
  misc_feature (711)..(711): n is a, c, g, or t
  misc_feature (785)..(785): n is a, c, g, or t
  misc_feature (789)..(789): n is a, c, g, or t
acagtgcttgttcggggcgctccgctggcttcttggacaattgcgccatgtgtgctgctcggctagcggcggcggcggcccagtcggtgtatgccttctcggcgcgcccgntggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaaaaancccggaaaaattaagttttttttgggcccccctgcgatgtgcctggaactttgagaagttcctggtgggccctgacggtgtgcccctacgcaggtacagccgcgcttccagaccattgacatcgagcctgacatngaagncctgctgtctcaagggccagctgtgctanggcgccccttctaccccggtggtntggcagttgcagtgctgctgtctcgggggggttttcatctatgagggtgtttcttctaaacctacgagggaggnacanctgatcttacagaaaatacacctcgagatgggtgctggtcctgttgatcccagtctctgccagaccaaggcgagtttcccccctaataaagtgccgggtgtca

SEQ ID NO: 575606 - DNA, 1252 bp, Homo sapiens
agcggatattgacccgaggccccggtccaatatggcgagctccacggtgtcgctggcttctcctccggcttggcactattcggcttcctctgggaagcgtccggcgcgctcaactcgggggcctcccgtcgatcgagcgaacttgactactggccctatccacggcgcgcgcgcgacgcctaccccacgggactgcacacgggtgctgcgccgagaaagccgggattgcacgatgagttggcctccgcctcccgcgaactcccggtcgaccgagtcggtctggctcgtgcgacaactcttcgtgtcgcacttcggagggaccagcgcggtaggcaacggccaccgtagacgcgggccgtgagagcccctgagcagcacttactgcggtgctggagcccggtgggcccggcggctagcgcggcgagacagacgcgaccaccgtggaggagacggtgcgggcggcgactgccgtgtcgcccagaagcggagggttcctaacctggatgaactcagggcgagtgcctgggtgaacgtggtgagcgacgagcggcagggtgagcagtctccgggggtgctgcagaacgcgcagttcgggatccaggcgtgagggaccctggtcacctgggtacctgactgacgaggaggtgctggacgactgagaacccatttgcgcagctgctgagtggcggtcgctgtggctcattcgtaagtggaagcattagctcaacgagagccgacccacaagagtgtgacgacgacacccgagacacggtcttttacccgatttgtgcatgtcatactccgcaggacaggccattggcaacaccggaagaggcagatggccccacctccctgcacgacgcgcgaaaccgaccagcggtgcatacaccggggagaaacggccaggtcctcacccaacaagacgctgccacgcccccgacccggactcgggggggacacacccaagcgcaacaggacccaccaacggacaacaaaccaaagaggacacgggacctcgccggaccccgacgtatccaacgccacgcagagacaccagagcgagacagcgaatagacgcagcgaacagacagagcaggcaacgaagggacacaacaagagcacaacgcaggagcgagcgaccagcaaaagagctcacacgacggtcccggacgagagacgacacgaggacccagcagcaacgaccaagacgtccaggacacgcagggcacacggccgcggccgggcgccgtgg

SEQ ID NO: 575607 - DNA, 635 bp, Homo sapiens
tggggatcttgctcctggagtgcagatgcggagcctgctggagagcgacagtgcaccctgcttccagtgtcctcgtgagccgcgcttgtggggtgctgggggtcccctgctgcccattgactacctccaccccgagctgtcctgtgctgttctggtgtgcagcagacggcagtgctggcatatcctgcggagcaggaagtgcgacagaacttcctatgtccttgctgtggggtcatggtgcatggcgtgtctgtttgtggagtttcgttatgttttgtatgtaagtactaacccaggacctggaatgccccttctctgatcagctgccttcttaccagctttgaatgcggcagtggcccagtgcgggtgcggggactgcctctgctcctccttggtgacctaaatcacaggagtccttggccacgttcagccataagacattattcacttgtggctgcgaaactcctggcaactatataggcatgggtgaggcccaagcccctgttgtgacagagacgtagtagtcatgttgtcaccccgtaagggctttcacaaggtagcgtgggttccattgtccacggagagatcagggtggcgcatatgtacataggtctatatctatagatataactgcg

SEQ ID NO: 575608 - DNA, 612 bp, Homo sapiens
  misc_feature (4)..(4): n is a, c, g, or t
  misc_feature (24)..(24): n is a, c, g, or t
  misc_feature (33)..(33): n is a, c, g, or t
  misc_feature (58)..(58): n is a, c, g, or t
  misc_feature (206)..(206): n is a, c, g, or t
  misc_feature (241)..(241): n is a, c, g, or t
  misc_feature (468)..(468): n is a, c, g, or t
tcanaaaacaaaacaacaaattanggatagggnttgagagaatggcaaagaggcaggnatgatttctgataatttgtgacaacctggagctgtgatatagggctcaatatatttaagatttagaatttaaacacaggcaagcattaagtatgtttagggaaaatacaagtgataaagaatgtattttttggccgggcgttggctgntcacgcttgtatcctagcactttgggaggccgagntgggtggatcacaaggtcaggagattgagaccatcctggccaacatagtgaaaccttgtctctactaaaaatacaaatattggctgggcacagttgtcacgcctgtaatcccggcactttgggaggccgaggtgggcagatcacctgaggtcaggagttcgagaccagcctggccaacatggcgaaaccccgtctctactaaaaatacaaaaattagccgggcatgntggcgcacgcctgtaatcccagctactcaggaggctgaggcaggagaatcacctgaacctgggaagtggaggttgcagtgagccgagattgtgtcattgcactccagcatgggtgacagagcaagactctgtctccaaaaaaaa

SEQ ID NO: 575609 - DNA, 519 bp, Homo sapiens
  misc_feature (9)..(9): n is a, c, g, or t
  misc_feature (12)..(12): n is a, c, g, or t
  misc_feature (519)..(519): n is a, c, g, or t
catcgaccnccnatttggagggaccgtgcgcaattgcgtgggacccgggaaattgggccataagggccggcctggcattaatgcactaaggcttttctgaacctatcggaccgataggaggctaagctgaccaagactgagttagaacaacatggttgaaacagatacctgtagtaaaactcaacctattagccggacatgctaggagttacccggacaacgagatctactatactcagttgctccaataactggtccaactgaacaggttactttaggatagccaggaagtgctattatagtgcacatatgagcgatagaggatgactaccttctatgtagaatcagggacatcccgatggtgcagccgctattaaaggatcgcatgtctaacgattaaggcccaaacgagatcttgaattcagaaccgtttaaagtatcaggccggattctaggtactattagggtcacttcgtgtacaggaccatgacggccctgcttgacagatctgcctgcccn

SEQ ID NO: 575610 - DNA, 635 bp, Homo sapiens
  misc_feature (25)..(25): n is a, c, g, or t
  misc_feature (37)..(37): n is a, c, g, or t
  misc_feature (50)..(50): n is a, c, g, or t
  misc_feature (102)..(102): n is a, c, g, or t
  misc_feature (128)..(128): n is a, c, g, or t
  misc_feature (167)..(167): n is a, c, g, or t
  misc_feature (171)..(171): n is a, c, g, or t
  misc_feature (219)..(219): n is a, c, g, or t
  misc_feature (233)..(233): n is a, c, g, or t
  misc_feature (260)..(260): n is a, c, g, or t
  misc_feature (266)..(266): n is a, c, g, or t
  misc_feature (269)..(269): n is a, c, g, or t
  misc_feature (272)..(273): n is a, c, g, or t
  misc_feature (279)..(279): n is a, c, g, or t
  misc_feature (285)..(285): n is a, c, g, or t
  misc_feature (308)..(308): n is a, c, g, or t
  misc_feature (355)..(355): n is a, c, g, or t
  misc_feature (461)..(461): n is a, c, g, or t
  misc_feature (472)..(472): n is a, c, g, or t
  misc_feature (493)..(493): n is a, c, g, or t
  misc_feature (533)..(533): n is a, c, g, or t
  misc_feature (547)..(547): n is a, c, g, or t
  misc_feature (558)..(558): n is a, c, g, or t
  misc_feature (566)..(567): n is a, c, g, or t
  misc_feature (571)..(571): n is a, c, g, or t
  misc_feature (574)..(574): n is a, c, g, or t
  misc_feature (584)..(584): n is a, c, g, or t
  misc_feature (597)..(597): n is a, c, g, or t
  misc_feature (606)..(606): n is a, c, g, or t
taggcgcgtgacctcggaacaactnacgacttctagnctgtccacatctngagcatagtcatgcatagctgggatgctactgtgtgctgaacattatatttnaagaaatgtactttgatcccatgttnagggaccccctctaattccttgtctccttgtatcctaantgcngatagcttcatcattgttctactactgctgtgcatctgatgacatgtntccattttgacatntgcttcgcttctattcactcctttgtngtgtantcntcnnatacangtggtngcccagtgccatgaggaaggatnggagagccacttgaggtcatatgttaaggtatgtaaaacacactgtnctgatcacttacatctgtggctctccagttttccttctaaggacttattttttcacaagcctggttatttgaggatgtgcttgtaacgtatgctttctcttctatntctcatagccnatgcttgtacctgaatagggnaggtacgaagagggacagccattcactaatttacttaatnccattccttcaatnatgtttctttnaatgggtnnccanatnatatgactcntgtggaagttaangaagaattnagttgtcttggtaggctctgtacgtagtt

SEQ ID NO: 575611 - DNA, 1094 bp, Homo sapiens
tgtagaactgtaataagaattggaagaaaatgtggtttaaaaggttactgtggggcataagaaattctcctttatgacgacttatgtaaaatttgcctaacataaggttaaatgtggatttttcttaatagtgcaatttggtttaaaaagggtttccaaatcgttaaacaatgttcaacggatttttaaaggacttttgggaaaaaccttcttgtaaaaaatgtagcaattttaatcatacgcatatctagcgaactttcagtccgacttgtagtctttcataaacctgaattattctgcggtatttaactgaatcttaaatactttccattgtcaacaggtggtcaccactcccgagttatagcttagacaatctgatagaaattacacgcatgtctctagtgtcacagtaacgggtgcctctaacttagttgtttctcattcctgtgtcatcccatcgtcttttcttacactattacggtgcttatcctctatagctgcttcctctattaaccagacctctgcgttcttatcctagggttagatctactagtcaataggggcacaatggagcccatagtgctatcggaaaccctacaacagtatggactagtatatggcaaatgggtggcaagtaccgccttatggtagtatacgggcaaccatggaatcaacaaggatttggagtagtatcatatgcaccttctgctagctctggtatggtgtgtgatttggtgctcagcctccacgcaaggacaagctcctaccccctgtaatacctcactcactgaaccgatagtccggtatataggtaatggcaagtgtacacaaacaacagtgagcacgggaatctatcaatagaaaattgtcaattcatgataggcattccgatttcactgtgacagtaagtaagacatcgaatagtagagcatcggagaaatgagaaatattgtattttaataagattgaaactgttatggaaccttatagcacagatttgtcttcggtgaaggacacgtgtcttctagttctgcctaggtaagtagtttgttcatgatggatatgacatgaattactcctgaggacaaaaacgt

SEQ ID NO: 575612 - DNA, 312 bp, Homo sapiens
atggtggtacctggttactgtttgggttatcgtgtgagcggtggtggacgaaattgacaagtcttggggtagtatagcttagttaaagtttcgtttattgctaagggttaatcagtgctgtttcccgtggggtgtggctaggctaagcgttgtgagctgcattgttgtgtgcttgatgcgtatgtcgcttttgatcgtggtgatttacgacgggtgacactcacctggaacggggatgcttgcttgtgtactcttactacgacgctacgtacgacaggctaggaccaaacctatagaccaggtagagccgag

SEQ ID NO: 575613 - DNA, 810 bp, Homo sapiens
  misc_feature (216)..(216): n is a, c, g, or t
ttgtgatgtgccccaccaccggggtgtaaaccattggcgagaggcaacaattgttctgaagattgcataggccaaagaattggttgccccgccttctggggtaaaatacactcgggacgaatgggccccctaaatatttctggaaactacctcggcgtggtagctagccgcccacctatatgtggataaaagggtttttctctggggccaagagcncaccatcgaggtgtttgtggagagcctttctcccgaactagataccaacacctctggggttcgtcatctatgcctgtgtttcgtgcggatatatagtgagcaccagaaccagcatatgtccgcgtggggtgtctcataccaaacaccagatgaggaccaagaaagagcgtgctggggagccatggccaagaggccaccaccaagtctgccacccagaaagactccagatagggctaacatagcgattattcatcccctcttattacctcgcccccccccatccttttatccactgggtggggaagagacgcgtgtctcagagcactgttttgttagtcacatatggccccatttagtcgttgtagatcagatgaaagacataggtgttgatagatgaaccaatagccttcgtgacaacctcttccaggaaggagaaggtagaatatttttgtggcgcccccttgggttttttttttgcgtggggccattttaagattattagatttttgaaaaccaagccattttttatgggaacacaaacggccccaaattgtccccggaatttgggaccccctttaaaaagttttatggaga

SEQ ID NO: 575614 - DNA, 220 bp, Homo sapiens
gggagcggggcttttgtcttttggtttccctggacttgagagagggaagattagaagccaagattaagattctcaaaatggtttattacccagacctctttgtcttgggcaagtcaaggaccatttccaacagggcatggaggaaggctcctaagggagcttcctgtccaaaggagtaaccccagagacgtgagcaccgtgctcctgatccatggcagca

SEQ ID NO: 575615 - DNA, 161 bp, Homo sapiens
gctaccttcacgccaatggcctcaattattctttatctgcctcttcctacacatcgggcgaggcctatattacggatcattctctactcagaacctgaaccatcggcattatcctcctgcttcgcacttatagcaaccagccttaataggttatgtcctcc

SEQ ID NO: 575616 - DNA, 193 bp, Homo sapiens
cccggtatcacgactaaagtctaactgaaattcctccatactagattctgaggttacctttacatcgacgagtactcgatagacacttgaggtgattctgtggtattaaaaaaaatcagagaaaaataaaactgatttagcctaaataagatttaggagaagaaatgcaagcctattaatatagcggtgaggg

SEQ ID NO: 575617 - DNA, 327 bp, Homo sapiens
  misc_feature (189)..(189): n is a, c, g, or t
ggccccccccccccccatcccgggaaacaaggattattattagggttttaggccgggaaggggcaacgcccccttttaattttggcaaattccccccacccccaaaggggtttcaaacccccccgggaaaaaaaccttgtttggttggggttgtttccagtctcttttcccccagcccctggcagggtnttggaaagcagcttttggagcccctttggttccccccccccattccttttggggggggggttttcccctcccaaaaaaaaaccccggggcgggggggttcccccccccccccaaaaaaaaaaagttttgccagggcca

SEQ ID NO: 575618 - DNA, 218 bp, Homo sapiens
tgtcgctgcccggataggggtggaggaggggacgcactgaactgttttgtccttcctatatactaatgatagtgctttagaatgagaattatgcctgaaatctggcaaccgaaaaatgttgctattgcaacaaagtgacaacaagctaacagtaaggatttatcttcacacataagctgtgataccgaatagaagcaaaacgattggctactagctct

SEQ ID NO: 575619 - DNA, 302 bp, Homo sapiens
tttttttttttgcttaaacttttaagaggatgaaaatatattgtattttcccctatttttactttttcatttgttctttctgttatccaaagattcattcttattatcatttttgatttgaaaaatttcctttattattgttcaccaactatacttcaattaaaattttaaattattttttaaaaataaatagataaaaaagaatttccttaaactgtcattttagaatagatctgctggtcacaaatctcttagttttttgtcatctgagactatccttttttttttttttggctatgatc

SEQ ID NO: 575620 - DNA, 368 bp, Homo sapiens
  misc_feature (10)..(10): n is a, c, g, or t
tttaaagggncctggtccacagaagatgtttattgatgtaacaaaacaatacagttagtgttagatccaaccacaaagagcaaaaggaatgaaaaatttgtacaatgtacatagaaaaaacaagatatttactgtgacaactatatattcctaaaataatgcttctaaaattactcaattattaacatcctttttttcatgtagatttcaataattgagtaattttagaaatctacatgaaaaaaaggatgttaatagcgacaaagtgcataaaatcaaacattgtattttgagcaaattaacatactaggcaattttgctaagaatgcatgattttttttttcttgtttacagctgctcaaaatatc

SEQ ID NO: 575621 - DNA, 209 bp, Homo sapiens
agccattcaggaacctgctttttatgtaaagttgggtctggttaataatgtagactaatgtttatgttctggatacattgaatcttccaacctgttggatagttctttacatctgcatttgttatacatgagatttcagtttccaaaaaatcagggcaaagggctgtaatgcagaattacattgaatttaatttacccagtgactaaga

SEQ ID NO: 575622 - DNA, 360 bp, Homo sapiens
  misc_feature (102)..(102): n is a, c, g, or t
  misc_feature (198)..(198): n is a, c, g, or t
  misc_feature (217)..(217): n is a, c, g, or t
  misc_feature (222)..(222): n is a, c, g, or t
  misc_feature (225)..(225): n is a, c, g, or t
  misc_feature (245)..(245): n is a, c, g, or t
  misc_feature (267)..(268): n is a, c, g, or t
  misc_feature (316)..(316): n is a, c, g, or t
cacaattgcaccagcaaacctgcgcagctggtttgccagggaggagcaagacctgttttcccacttagggctcttctcgcttctgatttcataggtggtcangtacatgtagggtttgaggtggggactgctggaagaagagtgcgggcaggaggtcattttgaccgcagcctgctttgcagaccccatagctgctgnaaggcctgggacagcagcnctacnctnactactaaccacaccctggnccgctacctgcgatgcttggcnnctaatcaggcttcacaaccaacagcagcatccggatccagaagtaccnagataggaacttcctttggtgtgactttgtaggccccttctggt

SEQ ID NO: 575623 - DNA, 1030 bp, Homo sapiens
ggacaggcagcaactgctgtggcagagaccgtggagagcctgttctacctgtaccgcgtcacagggggaccgcaaataccaggagtggtggctggtgagattctgcagagcttcatgccgcttcatcacgggtcccctcgtgggtggcgtattcttccatcaacaatgtgcaggatccttcagaagacccgcgcctacgggacaacgatgtgtagagacttcttcctgtgggggagacgctcaacgtatcttgtggcttggcgtcttctccgatgagccacaaactgtgtcaagcctgtgagcgcctaccgtgtttcaaacaccgaaagacccacacactctgtgctatcttgtagcccttgtgctagagggtggtgagtaggctgcatgggtggtgggggacatactgggtgtgtgcagatggcaccttgtcaagggtacttgtgcgcatcattccaatggtgggcgccaccgttatacaacccggcgcaaagcgccgaaagatgggccacgtgcgtcttgaaaactgggggcttgtggggtcctaccctcagacgtctagagtttaactccacggaacacacgtggagggacaacgttgagggatcagtcacggaacctttgcggatgggatgcattagccgcggggatatagtcatgtagtcgcagcctaggaaaacacacccggcccaggcgtatacacatccgccaggaaaggaacaacgcaagtcccctgacgatcaacgaaccagggcgtgaaagacctatgaagcacagggtctcataggcggagagcgaaccacaccaaaagcgtgggggcgtacgacagagcaagtgacccccctgcagctacaatacaggggatgaacccggaactatgggcacgagagcaccccagcggagtggcaagcaaccagggccagcggcacgcacgcgaacacccctcagtagtgggtcacccacaaaccacacgacagcaggcaagagacaagccgaggaagccaacaagcagcacagctgagataactag

SEQ ID NO: 575624 - DNA, 119 bp, Homo sapiens
tatggcactagtagaaccatcaaccgggtgtattgtacaggcatagagcactaatgcctgagcgatgtctcaacagactctggcggataagtcagtcttgtcttgtctactgaggactc

SEQ ID NO: 575625 - DNA, 158 bp, Homo sapiens
tctggtttagtaaaaacaatttcgctcatacaaaacaacagtttacaaaaaatcgaggtgcgtggacacaccactctgagaacaagggaggcgctgcaggcacccaggcgcccttcccccattacaacaaagacgacccctatagtttctaaactcgc

SEQ ID NO: 575626 - DNA, 627 bp, Homo sapiens
  misc_feature (165)..(165): n is a, c, g, or t
  misc_feature (193)..(193): n is a, c, g, or t
gactcctcctgggataacttgtccacacatcttccactagggtaaggctacttctggctgaggagacacttggatgtagctcaagtgctgcttaggcagtcctgatctctcctctcgtctcttcccagggagctgaaaagccagattcgacctggtagccaagcnatgtcacagcagaagcagcaatcttggnagcctccaaatgttcccaaatgctcccctccccaaagatcaaacccctgcctagctccctactcgactccttgtggtgctccccattcagaaggttgtcattccagttcccaaaggcctgaggttcagaagcctaggagggctcgtcaaaagctgcgctgcctaagtaggggcacaacctaccactgcaaagaggaagagtgtgaaggcgactgagcccagaagagttgaggcacaggtgcagttactctctccctgccccacctttgggtactaattcccccttggaaagccaggccctcaacctctcatttggactgagaaacacttcctgatccccagctctagagaagcgagaactaggctgagccacgctgctactgctctcttccattcaccccttcagctcagcaacaataaagctgctttacttgg

SEQ ID NO: 575627 - DNA, 179 bp, Homo sapiens
  misc_feature (175)..(175): n is a, c, g, or t
ctgaggacccctcttacgcggctctggagcctatacactcacgctagagatctctttaagagaattatctttctgtaaatagtttttaactattctacaacaaagattaaaaattttaaagatggcatggaatggaaacagctcttattttaacaagggcatcaaagtcactaancagt

SEQ ID NO: 575628 - DNA, 360 bp, Homo sapiens
gatccgttgttcaacagctaaaccgtcctaaaattggccttgtgcctgttaaatttttttcaatgctttcaaaggtaaattccaatttttatttactttttccttggggccgtttttctaaacaggttagggtggggatattttgttttactgtggatagtggatgttttgtactgtgtttgtggaaactttgccttaaaatatattttcatatgttttggtgggggccgggcccctttagtttggaagccaccggggtttttttttgaattggaggcaattttttcaaaattcctgtcaaggaaaggtggttttaaatgttaatggaatccccttttaaattaactgcctttggcccca

SEQ ID NO: 575629 - DNA, 596 bp, Homo sapiens
gactcctcctgggataacttgtccacacatcttccactagggtaaggctacttctggctgaggagacacttggatgtagctcaagtgctgcttaggcagtcctgatctctcctctcgtctcttcccagggagctgaaaagccaggtaggagatgcttggggtagaaagaagggaagagaagtggatccctgcaaaagaaagaccccaaataatctaacatgggagaaagccatagaagttagagggccagaaaagcagagatgggacagtcagacttaggagtctggggacagaataagacagagtaaagaaagagcagagacttggctctcctttgcacttaaccaggtggacattgggctgggaaaagtaaactgtcagctcaactaagtacaatttgtctttttttttttttaaggaagcatatatcattaacatggttattagtaagtgagtccccggggaagatttactcccaaatatttagtcctttcaagtccgtttttctcctcctgagatggagttcagggggtggtaaatgctggacttcattttggacagctccagttgggtggaggagagaaacagaagcccaa

SEQ ID NO: 575630 - DNA, 412 bp, Homo sapiens
tgcggtcgatgttccaggcgtgctgggcgtcgtaatagaccgccaattgcacacccttgtaggtctcctcggccaccctgtagcgggccgactggatggagacgaacggcatgatcggcgcctcggagacgaaacgcgcggtgcagcggccgttcttgacggtgtcggacaccttgtagcccggcgcgatcggcgtctggtcggccacggtggtcaccgtgatgtcggactggatgaagtcggcgtccttgcgcaggccgttgaactgcatcgaggcgacatcgcccagcttggccatccgctgctcgggcggcaggccgtatttacggcgcctggccctgtcggtcagcaggccgtcgcgcgacatgcccaggatcggcgcgatctccagattgttcacgaaggtcccgtt

SEQ ID NO: 575631 - DNA, 207 bp, Homo sapiens
aaagcaacgtgatatggaaggattggtgaagagatgtcagaatttctttggtctgctcataggggaggacgagcttatgatttgggactatccagtccccttgaaaggaggctccttgctgtatagacaaagctttctcgagtgggagagttcttgggtagagattgcatgggataacagagaaggagacggtgcgttggcccaacg

SEQ ID NO: 575632 - DNA, 155 bp, Homo sapiens
agaaagcaaaaattctttttaaaaaggtttccacatcttgctgaagcccaaaggtcaggtcttgtctaagcatgtctgaactattaaatttaccattttggttttcctggaataggtctgtgtacaggagtgaatatgtgaggtggtttataagg

SEQ ID NO: 575633 - DNA, 471 bp, Homo sapiens
  misc_feature (264)..(264): n is a, c, g, or t
cacgaggggccagctcccggtacacccgcgccgggcgcaggttggcgaagagctccagcgccttgcggatccgcagcagcccctgctcgggacgcttttccctgggaagcccgtcgtacttgggcgcgcccacggcgcccagcaggatggcgtccgccgtccgggcgagctccagggtggacgcgggcaacgggttcccctctgcgtccacgccggccccgccgatgggcgcctcggcccactccagatggagcccgtcgcggngcagccgctccagcaccttcaccgcctgggccgtgatttccgggccgatcccgtctcccgggaggatggcgatcttcattcagccgtaaatgctcaaccgaacagccatggcgcctcggcccgccgcttggcctcgtaggccttgatcttgtccacgtgccgcagggtgagcccgatgtcgtccaggccgttgagcaggcagtactt

SEQ ID NO: 575634 - DNA, 501 bp, Homo sapiens
caagtcatcacaaaagcaccatcacacgattctcacaatgcatgtgcatctgtacttcacgaacatggtcaacaaaatccatgtcacttcacccccgatttcatttcaaattcaagcaacaacaacttttcaataaagtggttacattcaaactttaacttccttagtaccatgctgcagatgtcagcactgttaaggtatagcaagaatgcccaaccctctggtgtctgatcatgtatctcagcacattgcagtatgaagaaaagagatgccccggtctcagcccatggactagttaatacagtgaagcaggttcctgtcttttcaccttcctgctcagaacataaaagcattaaggactaaaatcaaggaagcatgggagttttagagctggcaaaatgaagtctaaaagatagatcaaggcaaacaattactgagaacttggttgttgcttaacctggcaagtctaaaagcctttctttaaccttgtaggaattagat

SEQ ID NO: 575635 - DNA, 118 bp, Homo sapiens
ggccggtcccttatattttatgtgaagaagatagtcactgtgaaataatacagtgactatcttcttcacataaaatttaaagggttcatttattttccgtaactattaggagggattt

SEQ ID NO: 575636 - DNA, 354 bp, Homo sapiens
acggcagggtttctcaggaatatatgttataaaagtcgagcatttatgttcagctgtctatcactttgtccaggtccaggaccctggtgtagtccatgatagtgtttccagctcaacccttctttaatgtcatccaggtatggggccaggtatgaagggtagccggttaaggagcgacaggcagttatttttgggtgggattcgccacttttcccatgaagaggggagacttggtattttgttcaatcattaagaagccaaagggtttgttgaacttgacctcgggtgggatagacatgggtatggcctctatacacatggccccagcagcatcagtccctttctcgctggtcc

SEQ ID NO: 575637 - DNA, 316 bp, Homo sapiens
  misc_feature (223)..(223): n is a, c, g, or t
  misc_feature (247)..(247): n is a, c, g, or t
  misc_feature (272)..(272): n is a, c, g, or t
gtcgacgagccagcgaccactttggtcatcctctcccgacgccgtacgctcagctatcatcaccaggcgcaccaggcgatcacccaggcttgcagggtgtcgatggcgttgacactttctggcctttttccacgtcatccttgagcagttgcagcgcggcaacccccaggaatgcagcgaaaataaccacactgatgatcgacgtcggtttggcgcgcgcagngtcggcgaactgggttcgcgcttnacgaacgacagcagcaactgcggtngatattcaggtcggcgaccttgccgggcgtaatcacgtcgacgc

SEQ ID NO: 575638 - DNA, 227 bp, Homo sapiens
tggtggccactgcggccagtgtcgcgatagtaatccccttccatcttcaggtaaaatacttagctctcgtacagagtctcgctgcaattctctggatcaggtcgttatccagctaggctcagcacatcctggcatacaggcctccaactccttctctatcttctcccggtacgcacagaccatctcaatctacttctcattgccgtcagcagatatacttctgctac

SEQ ID NO: 575639 - DNA, 298 bp, Homo sapiens
attagaagttaggatgaatacatgttacactgttaacttttagcaaattttacttttgttgaaaactttgtgtttgggattttaattatccttcgcaattaataagacatcatttagtccaaattaacttagaattggtatagatgattccttcctggttctgtaagtactttaaggcttggctgagtacaaacagctcacacatttgagcagaccaattattaggcaattttcctaacttcatttctacaagagtttgtttccctattagttactggatacccatagtgtcttcttc

SEQ ID NO: 575640 - DNA, 187 bp, Homo sapiens
ccgctgtgcgcctgatatcttgacggcccaccacagcggcacagcatacccggcgttctctcaccttgtcctccctctcctcccgccgcactcacttacacagcagtggggtccggacaaccacaaatgaagaggagcatgacccggaaaaggcgctccagctgaaatatctgctgagtgcctttag

SEQ ID NO: 575641 - DNA, 449 bp, Homo sapiens
ttttcgcacaatcagtcactctgtacaaacgcaccaaatcagcactctgtgtccagctaaaggattgtaaatacaccaatcagcattctgcaaaatggaccaaacagcactctgtaaaacggaccaatcaacgctctgtaaaatggatcaatcagcaggacgtgggcagggacaaataagggaataaaagctggccaccccagccagcaactgcaacacgctcaggtcccctttcacattgaggaagctttgttcttaagctcttcacaataaatcttgctgctgctcactctttgggtccacaccacctttaagagctgtaacacttgccgtgaaggtctgcagcttcattcttgaagtcagcaagaccatgaacccagcagaaggaagaaactcaggacacatctgaaggaacagactccagacccaacacctttaagagctgtacc

SEQ ID NO: 575642 - DNA, 743 bp, Homo sapiens
gtggctcacacgtgtagtcccagctactggggaggcgggaggattgcttgagcccaggagtttgaggctgcaatgagctatgatcatgccactgcactccagcctgggcaacagagggagactctgtctcaaaaaaaaaaaaagaaaagaaaaatcagactgaaattcctcccagattacagggggaaatttccctgcagaggggatgctccttgaggaggaggaggtgtttggaccagagccattttctggcaacctcagcctagcctatggttgttcccaaagctccctttccctggaaacccttgccaacacccacaaacaaccaccgtctgaggcctccccaacccatgcccctcacagtctgggtcccgtggtctgtttctccggttacacaagcctgggtggggctgagagggtgggggactatccttcacaggaccgggattttcaggggacaaggtcaccacatccgtcctcagttcttcctgggggaattccatgaccttctgtcccgtgggacacaattattggccctggcccagagccttggggcaagaaccaagatggtctcaggggagcatggagggtcagctggtagcaccccgtgccctcacccagactagaatgtgggtaccttgcatgggaaaccccagagtgatctttcaaatggacaggaccagggagccggggctcagctggtacaaacccaagggtgacggagatgggggatacaataatcg

SEQ ID NO: 575643 - DNA, 408 bp, Homo sapiens
atttaggcctaaaaccaaatagctgctgggttttaggactcttctgatggtcaactattaataagaatgtgaaaatggaaaatggaaaaaatggaaaggcatggtagctttaatccttacatctctcataattgtggcaggagtcttaacagcagtgggatgttgtattaccccttgtgtgaggggactagcacaaagattaattaaaacagctgttaataaacaaatgcccataacttaccagcaagataacctactactattagaaactgaattaaactcactctcctatggaaaaaaaaagtaaatgacttctagagcaattcaaggaccaaaaaggcttaaatgaaaatgagaccaaaggaagtaaatagaaaagagttaatagaaaaaaaaaagagttaatag

SEQ ID NO: 575644 - DNA, 136 bp, Homo sapiens
agcatttctacactacgaagtactttcaaaacttgtagtgtttatagtaaatcaggcaataaaggtagagtagctgggacttcttaatcttctctgaactaataccctgctttttacatgacacatgggaaacagg

SEQ ID NO: 575645 - DNA, 115 bp, Homo sapiens
cctgccccccccttaaaaaatggcccctggctcccccccccccggtttccacgtggtgtatggatttgtggtcattgtccctctgcaaaataaaaattgttcaggcctgcctgga

SEQ ID NO: 575646 - DNA, 771 bp, Homo sapiens
  misc_feature (312)..(312): n is a, c, g, or t
  misc_feature (367)..(367): n is a, c, g, or t
  misc_feature (564)..(564): n is a, c, g, or t
  misc_feature (601)..(601): n is a, c, g, or t
  misc_feature (632)..(632): n is a, c, g, or t
  misc_feature (655)..(655): n is a, c, g, or t
  misc_feature (675)..(675): n is a, c, g, or t
  misc_feature (679)..(679): n is a, c, g, or t
  misc_feature (689)..(689): n is a, c, g, or t
  misc_feature (705)..(705): n is a, c, g, or t
  misc_feature (748)..(748): n is a, c, g, or t
ggacgcgtgggtcgacccacgcgtccgggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatatcagagaaactaggcttcaagcactttcctgaagcggggattcattatccagacantaccacagggagatggggaaggcccctcggccaccggactataatggtgcaactngtaggtttgggagaaattttacggatggatccggagaagcaatggatgggcaacaggttaccggcctgtgcaggtcctgtggtttgtacaggcagttcggcctggctggcagttactgcaggatggccttggggaggcactctggctggacgcaccagggaccaagggtggttggtggttggggagcggctcccatnctttcagtgggacttgtggtggttgcctggggagggnggatggtaacacacccagggggatttccatnccggaacaggcaggtggtggtgnggacccacttaacaaacggngggnggaaggaggngttcacccattctggnggatttaccctggctccccccccaccctggggtggatttttancattcggatggtgggccccggtt

SEQ ID NO: 575647 - DNA, 365 bp, Homo sapiens
acgttccatcccaacttttgatgcgggttcaccacgccaaaggttaccaccgccgacaacaatggcgatttgtgtgccaagatcgtgtacttctttcaaatcttgcgcaatttcagaaactacggcaaggtcgatgccttggctttgtcgccagctaatgcttcgcccgaaagtttcatcaatacacgtttgtatttaatatcagtcatgatttacctcatttcattatctagtccattataccaaattttcccgcaaagttggtgcgttatatgaaattaccgcctgtttataggcaattaacccaattgcttagcaacttcttcggccaagtcagtcactttcttttcgataccatcaccaac

SEQ ID NO: 575648 - DNA, 103 bp, Homo sapiens
agcggccctctccccggggacgcgcccagcccgcggccccggggagagggcgcctgacgaatcgagctggagatgggtggataatagacgtgtcgataatacg

SEQ ID NO: 575649 - DNA, 125 bp, Homo sapiens
gacaaattcccattttcaggcgatacccagaccaaaccacgccaaaaaccatgtcacaatcaaatttatcggcggaaagctatcgtttttccacaacacattttctgcccatctggaatgtcaaa

SEQ ID NO: 575650 - DNA, 159 bp, Homo sapiens
catagacaggacactgcgtgagtactcgatttggaaaacaatgtatgtatgctgaaatcccactttagtaaaagtgaagatatttccatgcacacactatgtactctagaaataaatacactaaatctctgtaatggtgtctaagttcgggggatcctc

SEQ ID NO: 575651 - DNA, 237 bp, Homo sapiens
ccactactggccctaaaacatactagatatcaacggaatatagttgtccttctaaggtagtttctttgaaagactaaatgcatattccagtgacactattagtattaacattttttttttcagaagttacctttggaaagagccattgggtgtttgaatctagaaaggagtcctctcaagagaataaaactgtgtcagaggctgaatcaagaatctttgggttgggacttattgcct

SEQ ID NO: 575652 - DNA, 182 bp, Homo sapiens
gactttctggtgactggagtccttagtaaggtcttagcaatcacaccaaattgaagtctcccttgactcttctgtgtatctgtgtgaatatgtgtgtatatgtgtgtgtatgtgtgtgtagaaattgcacacgtaccaattctcacacgatctttgttcataatcatgccaaagaacttgga

SEQ ID NO: 575653 - DNA, 197 bp, Homo sapiens
gtgcgtacggacgcacaccttcgatatccaggacggtaaatacttgaaaatctcttttttaggcgcgctccaacgctgtccatttccaggatatcgagcgatgacctctttgccgtcaacccagtcaatgtacgcggcggcaatatcgatcgtatagtcttccatcttcgctttgcgaaaaggggcgtccgtagcgg

SEQ ID NO: 575654 - DNA, 301 bp, Homo sapiens
  misc_feature (32)..(32): n is a, c, g, or t
gacaaaataacagcaacaggcccagcacattngacccacacctgtaatcccagcactttgggagactgaggcgggtggatcacttgaggtcaggggttcaagaccagcctggcggacatggcaaaaccccatttctactaaaaatgcaaaaattagctgagcatagtggcatgtgcctgtggtcccagctactcagtaggctgagtcataagaatcatttgaatctgggaggtggagattgcggtgagctaagatcgcgccactgcactccggcctttatgacagaactcgactccatctc

SEQ ID NO: 575655 - DNA, 306 bp, Homo sapiens
gtgtgacgaccttaactctctagaatataactccaaatctggaaggccatgaaagatattctcaaacatctgagagtatggttacaaagccatgccatcaagctctccttcagccagaactgatttaaaaggtatttaatagctagggtatctattccctcaggccatagaataaccagcaaactgatgaagaagaagaggcaacggatgacattacaataggcatatactgatcaccatgacaagtgacaagccaaagaaatcaacaaaactgaaaagaaggactatgcataacacaaatgtaaa

SEQ ID NO: 575656 - DNA, 783 bp, Homo sapiens
  misc_feature (349)..(349): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggctcaataaaagttattttccactgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaacaaaaaaacaagagagagaggagggaggagcgagagaggaaagagagaaagagaaaaagaaacgacaggagggggggggagcggcgcgcggcggaagagagagagcgacaggaggagcgagagagagggaaggaacggagaagcagagccacgagaaccacggagaaaagcgcgagggggagagaagagacgacagaagaaacgaggagagggacgagcgcgccggaggggagaagagagagagacagagagagggagaaacacgagcaagagaagagcaaggcggaaggagagagcgaacgagccacacagaagcgagaagaggcacgggg

SEQ ID NO: 575657 - DNA, 330 bp, Homo sapiens
gcgttgctccggtgtttcctcctatggtgaagtgaccccatgacttttttggctgaagaggctgtgtggtgggaacaaaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtctcaataaaagttattttcagtggaaaataac

SEQ ID NO: 575658 - DNA, 1020 bp, Homo sapiens
  misc_feature (193)..(193): n is a, c, g, or t
gctgtgcgcgggacgagaagtctgccctaacgaggttggactggacactgggcccgcggggacccatctgacaacgcccgtgtccccaggtaagcctgtgcgagccttcggtggaccatgccaaaatagacatcaggaacatgtgttgtttgggagggaagctgtggcgcactggacactgtctcgaactagntgactgcgccacccctccagcgtcaccattccgtgattccacagcaaggttggggtacggggaatggcgtagcatggagtagagagagagggaagtgggaagaaatttggtcatcggagagtaagctactttttatgcctttgctatcagtctgcgttgcgtttctctgatccaacttagtgctagcgtaacaatttatgaccgtgctcctggctgaggaactaggccctaaagcgttcacgtgggcgtttcggggagcgtagtggaggacacggcggcaggatcagtggaaaggagagggggaaatccccatggtatctgacaaaatcccagtgtcccggaagctgtccaatgcgcagtagaacaagctccccttgggcacttccccgacgtccagatgccgtcaaccttcagccttggattgtcagagggcaatcctttgcccctctgtgtgacatcttgggcatgacactagtcaacgactgagggttaagttcatcagtgtcttctgcttttaggcctcagaggacttatcctttctggcaggggaccagatctcctgggtggcctcatcatcgactaattcacttgtgcacctgtaggaaatggctaaaggtccatactggaaacccaagactgggaagtgagggcccctagaatttagaatctgtgggggtctatgaactgtcttaagtcaggcagtctcccaaagtgtggctccgaggatccctgtggtccctgacccctttcatactggccttgtcaactgcaaagcgtccttagcctgcatttcttcaccaaacaacgttcacacgccttggttgccc

SEQ ID NO: 575659 - DNA, 1805 bp, Homo sapiens
  misc_feature (1320)..(1320): n is a, c, g, or t
atacgttgctctcgtcttcgtgtgtggtgtcgtgttgtcttatcctccatcagtggtgggtgtgtgtctgctctcgtccttctttccctccccttgcgtgatatttgtggcggtgctcttccgtctccacctagacgtcgctcgtccactatttttgttgtgtgactctccctctccgttctgctgcctcgtgagtttctccgccgcgcgcagccaggggggggcgcccccctccgtgtgcgtctgtatctctctgttttatttagtcatatgggggggagtaaattttccgtggggggttttttatctcctactggcgcggtctgcctgtcttctcgtgagtggacttcgctcttcctctcctccctccggggggtttatttttctcctccctgccgcgctctgaataaaagtgtttggttgttggtccgccccactcgtctcgcggtggggagacgaccaacatcttttgtggtggtagtagggctcctgttgtcgtccgtccccccctctggtgtggtgtgggccgacctactttgtggggggggacgcaccgtcttttttttccctgcgcccacactttttgtggggcctcctctgaaagtagtgtgtggcgctgtctttttccccccgggggaaagttcttttattaggtcggtgtgaagttgttggtggtccccgggcgcccccacctcttgtgggggccggcttattattagtctcccccgcctcttctcctcctcttctccaagggggtggtgttatcttcctcctcggaatgtggtgtgtcccccccaaggtggcccagcccacaagagtgggggttttttaatatcacgccacgggttgtttttatcgcccacagcagattttttcttgtgtggatatatcgcgctcccttcgagaggagctctccactgataggagtagccccctcttctctggaggagtcgctcctcatcttcgcgtcacacagtaaagagagtttccacctctccccaacagagagtttctctcatatagagaggagagaggttccccccctcctctgggagataaaaaactctgtgagagagaatagtcacagctgtgtgtgagaagagcgtcttatataccccccactacagtaatcgcgcacaaaggagacacaacaatggtgcgcgctccggcgggagacacaccacaacaatggtggtggtgtcgtgctccacacggcgcgcccacggcgcggtatattctacacacagatggtttccccgcgggtgtggagagtattatatagggcgccacagcttgctggggcgtgtcaccacacacacngcgcggggcacacttctctaacacaagacgcccccacatattcacgagagttgagagataagcggcgcgcgcgcggttgttccacagcgtcacacaagagagagtcctcctcgtgtgcgtgagaggtgatgatagagaaaaggtagataagagagagagcgtctgtcgtcctgtgtgtgtgtgtgtgtataaagagagacgcacacgagaagagaacgcgctcctctctgtgtgtgggagaaaaaagggcaccgcacgtgtttcccacggaatccaccccccttctgtgaaaagaaagcctctgcacagagagagaagagatacctctctacacacagagaggagagagaagaaagcctctgctggcgattaaacttcttaaaagttggagtgtatttccactaaagggccaaatccattttgtggccgactttttttgtaaaaaaggaaccctggttataccaggccaggtggggaaccaagta

SEQ ID NO: 575660 - DNA, 993 bp, Homo sapiens
aatgtagagtcaaggtctcaccatatcacgcccaggctggtctcaaacccctggcctcatagacttaatgttttaaagatagctttaggtatatagaaaaactgatcaaaaagtagagtatgtagagcgctccctacatactacccctgccttccccccttccccattatttatgtgctgtgttatgtaccatttgttaaaattgataaccaatattgatacattagtaactgagtttatatgaactctcctaccacctttttttgttttacatcattgtagtaggtttcctcttcattcaacacttaatgttgatgtgtgttctttcaatgtttttatttacatttatatacatatgtagaaactactatagttagaattttgttttttaacataaatgaggtcataccatacaaattatttggcagctttctttctaactctgccttacagatttctgcacttacagatcccctaactctgcccttctcattctctttaattgtcgtcgcattgtctctagaaccacggtacgtgtagccagttccctgctggtgaatcttcagtggttcctcatcatccgtgttacatgaaacactgcattactctcctccggcttagctttgtgtcttgcttggaaaggctgtccccactccaagtcttaaatgaaaatgagaccatttttaataatctttttaacacatctagaatttatggaggcaattgttcttctgatttagcttttagtggctttgtagaaaagtgatgaaacacgtatatgcccaatttaaaatgaagaataatcctgatttaactttctagataataaccttatcccaggtacccagggctacgtctcttgtgtccatctattctcctacaggttacttgtttccctaatagatatttaagtttcctctatgtctaactgtggcttgatagtttttataggtagtaacgtaatggtaatattagagacaagagtctcgttgt

SEQ ID NO: 575661 - DNA, 198 bp, Homo sapiens
ctctccctgtgccgctggacctctgtgcgctatgagcggttgccctgttgctctgctggacctggacgcgggagtgctggagaacatcttcggtgtgggcctgagcagccttgtggccttcctgggctacctgctgctgctccagggcttcttcactgacatctgggtcttccagttctgcctggtcatcgcctcctg

SEQ ID NO: 575662 - DNA, 135 bp, Homo sapiens
gatcctgtgtatgacgagcttctgggcagacttggtgacttgccagctcagcagcttcttgtcactgtttgatgacaccaccgaaatgtctgtctcatatcacgaacatgcaagcgtcccaaggtggatagtctg

SEQ ID NO: 575663 - DNA, 449 bp, Homo sapiens
gaggaatcggacgcttgacattggtgacacctaactgctgcgcagtagagaactgcagcatcgcgagctgttgcccctgataccattagaaataccggtgcatggacttcctgcccccagaccgctgcctgtccttcttcatcaccatctattggaagagcagcaactacatcaatgctgccctcatggacagctactaacagccttcagcttttatagtctcccagcatcctttgccaaacacagtgaaagactttgggagactggtcctggattatcactgcacatccgtagattttgctaaatgatgtggatcctgcccagattgtgtccacggtattggccagaaaacggagtacacagacacgggcccatccaggttgaatttgatctctgctgacctggaacaggcaatcatcagcaggaatattccgcatttacaatgccgc

SEQ ID NO: 575664 - DNA, 123 bp, Homo sapiens
gccaaaggggggggccctgggccttgaagtttacgggaaccctccctaacccacaccccccgcttataccgcttcaggggcgtcttgagcgggtttttcttcccaccggggggtttaaacaaa

SEQ ID NO: 575665 - DNA, 392 bp, Homo sapiens
ctgggatgacagagtgagacgtctcaaaagagtgagagaacgaagtcaggcgcctctagaagaccaacagttgcaccactctagcaaataaccaggaagagatgaaagtggatgagaaacccgtgtgatgggggcatcgtgtccacgtggataagccaggtaggattctgctgggccatcagttacatgaagcagacaaatgatatcattcttagaaatgacgtgtgacacgtgaggataaagaatttttaggctgggcacggtggctcacacctgtaatcccagcactttgggaggccaaagcgggcagatggcttgaggttgggagttgcagaccagcctgaccaacatggagaaaccctctctactaataatacaaaattagccaggtg

SEQ ID NO: 575666 - DNA, 428 bp, Homo sapiens
aggtgcgcttatcattaaagggatgaggaacatctaacaagcaacatgaaaagcagataaacacatgagaagcagggtttgcaatcctaatttcagacaaaacagactttaaaccaataaagatgaaaaaagacaaagaaggacattacataataataaattcaattcagcgagaagacttaactatcccaaatatatatgtacctagtacaggagcacccaaattcataaagcaagttcttagctacaaagagtcttaaatatttacaaaataatagtgggagactttaacactccagacaggtcatcaagggagcaaattaacaaagatattcagaacctgaacttgacattggaccaaatggatttgatagacctttacagtactccgaacccagaaaaccagtatatacattcttctcattgcc

SEQ ID NO: 575667 - DNA, 347 bp, Homo sapiens
  misc_feature (121)..(121): n is a, c, g, or t
taaaaaccgggcccccccgtttatttttgtttttgggtaaaaatgcccgatggggtccaaaaccaaggggtttccccaggtgacaacccccccccctgcagcctgagtttcccagtccccngggtttgttttcacccggggtttaaaaggttaacccccccccgtatttcaggtcgggccaaaaaattcggaggcccaaacccaaccccttggggggttttaaagctttgctttggacccccccctgtttttcccccccccaaaaacccctgtttccttttaaaaattttttgtgggctgaaagccccccgggctgtgaaatttaaaaaagggggtatgctttgcta

SEQ ID NO: 575668 - DNA, 257 bp, Homo sapiens
cgcggtcatccgtgtatctttggggcatggtaacggggcccacttaaacttctctctctctctctccctctctctctctctcagcctctctctatctctctcagagttcctgtcgtggctcagtggaaacgaaactgacgagcgttcatgcagatggggcttcgatccctgccctcgatcagtgggttaaggatctggcgttgcggtgagctgtggtgcaggttgcaaactcggctcggatcccgagttgctgtggc

SEQ ID NO: 575669 - DNA, 347 bp, Homo sapiens
gctcggtacccagtgaaacagctatgacatcgtcacgccacacgccatttggagggtttaaggaatctggaaacgggagggagctgggtgaggatgggcttaaggcctacacagaggtcaagacggtcaccatcaaggttcctcagtaagaactcgttaagagcagcatgtcacgggaagcccagatcacagatccagctaattccacaatccaccttagaccaagtgcgttgccaaagctggttttaagagccatagaacacctctttcttatgttccaaagttaacttcttagacagaaaccccacaagattaagcaattcacgtcatacgctgtttcctggggt

SEQ ID NO: 575670 - DNA, 218 bp, Homo sapiens
cttggaagtaatatggtggacggaaacttccaatttgcacctgggaagagcatccagagagtcccatgtgcacgtcaatgacattgcagagctttggactcgacaacatcaacatgaccacactacatccagcaccgtgtcatttgtgggaggacatatccatggcagttgtgaaccccgctggaccacaccaagtgtcacgtgcgccccacagcctc

SEQ ID NO: 575671 - DNA, 1005 bp, Homo sapiens
  misc_feature (121)..(121): n is a, c, g, or t
  misc_feature (184)..(184): n is a, c, g, or t
  misc_feature (192)..(192): n is a, c, g, or t
  misc_feature (205)..(206): n is a, c, g, or t
  misc_feature (209)..(209): n is a, c, g, or t
  misc_feature (284)..(285): n is a, c, g, or t
  misc_feature (302)..(302): n is a, c, g, or t
  misc_feature (304)..(305): n is a, c, g, or t
  misc_feature (313)..(313): n is a, c, g, or t
  misc_feature (318)..(318): n is a, c, g, or t
  misc_feature (323)..(323): n is a, c, g, or t
  misc_feature (329)..(330): n is a, c, g, or t
  misc_feature (339)..(340): n is a, c, g, or t
  misc_feature (348)..(348): n is a, c, g, or t
  misc_feature (377)..(377): n is a, c, g, or t
  misc_feature (387)..(388): n is a, c, g, or t
  misc_feature (403)..(403): n is a, c, g, or t
  misc_feature (406)..(407): n is a, c, g, or t
  misc_feature (412)..(412): n is a, c, g, or t
  misc_feature (415)..(416): n is a, c, g, or t
  misc_feature (472)..(472): n is a, c, g, or t
  misc_feature (683)..(683): n is a, c, g, or t
  misc_feature (692)..(692): n is a, c, g, or t
  misc_feature (711)..(711): n is a, c, g, or t
  misc_feature (729)..(730): n is a, c, g, or t
  misc_feature (734)..(734): n is a, c, g, or t
  misc_feature (737)..(738): n is a, c, g, or t
ggcccccgtgcggcggccgcgcagtgctggctcctcgcgggctcgggcggcggtctgcggcggggctatggcgagcggcggtggcgggggtgacactggcgcgggtggggggccggggatnggcctgagcctgggcctgggtctgggtctgagcctaggcatgagtgaggccaccagtgaggcngaggaggnggcggccacggcnngangcggtgggacgcctggccactgacgctgtggctgcggctccgcgtgctgggaggcggtgctggcggcggcgcagnnggttgctggtgtgggananngccgctgnacagncttgngtcacnngctggccgnngctcaacnggcctcttctggttgctgtcttcctcgtncctccggccnnttcttcctactcagngtnntcacnttnnggcctattttctgctggatctctggcagcctcgctttctccctgacgtttcaggcntcatccccagaggagccacactctgacagtgaagtggtgctggtggtcatgtgcgccactggccggcacctgctgagtgtgcccgagttgtgcagataccttggctgagagctggctcacctttccagattcacctgcaggagctgctgcagtacaagaggcagaatccagctcagttctgcgttcgagtctgctctggctgtgctgtgtnggctgtgtngggacactatgttccaggnattatgatttcctacatnngtcntgnngagtatcctgctgtggccctggtggttatcatgaggctgatccagaggatgtacactcgcctggaggcccctgctcatgcagcttggactacagcatgaagggcagaaagcccgagtggccgtggatcagaagacacgaacgaggacggaaccgtcacgcgacagaatgcagccccaagggagcgtgatgaagccactgggagcagacaggagagtgaagcgaggacaccttggctgggcttctccccagtgtgcatgtgaggaaac

SEQ ID NO: 575672 - DNA, 565 bp, Homo sapiens
  misc_feature (466)..(466): n is a, c, g, or t
  misc_feature (507)..(507): n is a, c, g, or t
  misc_feature (548)..(548): n is a, c, g, or t
tgaagttggcatcagtggttgaaaacaaagttctgtttcagaaagaatgaggagggttgtgagctgtgtgtgaaagataaggactgaagatgtggggacaagcttgtttgaagtgatgcttggccagtgaacaaacgagatctagaagagattaaacaaaaagaggggagtgggctagattttaagttgggaaggatgacagtgccaagtcacagatggaaaatgttgctctaaggaaacctgctcggttgcccccacctcttgttgcacaagtaccaccacactttctctgctttaagtactgtattgtgggaattcaacccacttctaactttctaagcattgtaggaaaaagtgcttatttcctttcctagctgtccaaatggttgcacagtcagaatctattgtgctgcctgtacttctatattagagctaatactctcacattttcatacccatatccccnaattacagcaaccaaccagtattatcctgattttcctggcnatagggacctaattggctgtttgggatctgaatattctggnaaagtgggaaaagtaga

SEQ ID NO: 575673 - DNA, 904 bp, Homo sapiens
  misc_feature (121)..(121): n is a, c, g, or t
  misc_feature (184)..(184): n is a, c, g, or t
  misc_feature (192)..(192): n is a, c, g, or t
  misc_feature (205)..(206): n is a, c, g, or t
  misc_feature (209)..(209): n is a, c, g, or t
  misc_feature (284)..(285): n is a, c, g, or t
  misc_feature (302)..(302): n is a, c, g, or t
  misc_feature (304)..(305): n is a, c, g, or t
  misc_feature (313)..(313): n is a, c, g, or t
  misc_feature (318)..(318): n is a, c, g, or t
  misc_feature (323)..(323): n is a, c, g, or t
  misc_feature (329)..(330): n is a, c, g, or t
  misc_feature (339)..(340): n is a, c, g, or t
  misc_feature (348)..(348): n is a, c, g, or t
  misc_feature (377)..(377): n is a, c, g, or t
  misc_feature (387)..(388): n is a, c, g, or t
  misc_feature (403)..(403): n is a, c, g, or t
  misc_feature (406)..(407): n is a, c, g, or t
  misc_feature (412)..(412): n is a, c, g, or t
  misc_feature (415)..(416): n is a, c, g, or t
  misc_feature (472)..(472): n is a, c, g, or t
  misc_feature (582)..(582): n is a, c, g, or t
  misc_feature (591)..(591): n is a, c, g, or t
  misc_feature (610)..(610): n is a, c, g, or t
  misc_feature (628)..(629): n is a, c, g, or t
  misc_feature (633)..(633): n is a, c, g, or t
  misc_feature (636)..(637): n is a, c, g, or t
ggcccccgtgcggcggccgcgcagtgctggctcctcgcgggctcgggcggcggtctgcggcggggctatggcgagcggcggtggcgggggtgacactggcgcgggtggggggccggggatnggcctgagcctgggcctgggtctgggtctgagcctaggcatgagtgaggccaccagtgaggcngaggaggnggcggccacggcnngangcggtgggacgcctggccactgacgctgtggctgcggctccgcgtgctgggaggcggtgctggcggcggcgcagnnggttgctggtgtgggananngccgctgnacagncttgngtcacnngctggccgnngctcaacnggcctcttctggttgctgtcttcctcgtncctccggccnnttcttcctactcagngtnntcacnttnnggcctattttctgctggatctctggcagcctcgctttctccctgacgtttcaggcntcatccccagaggagccacactctgagattcacctgcaggagctgctgcagtacaagaggcagaatccagctcagttctgcgttcgagtctgctctggctgtgctgtgtnggctgtgtngggacactatgttccaggnattatgatttcctacatnngtcntgnngagtatcctgctgtggccctggtggttatcatgaggctgatccagaggatgtacactcgcctggaggcccctgctcatgcagcttggactacagcatgaagggcagaaagcccgagtggccgtggatcagaagacacgaacgaggacggaaccgtcacgcgacagaatgcagccccaagggagcgtgatgaagccactgggagcagacaggagagtgaagcgaggacaccttggctgggcttctccccagtgtgcatgtgaggaaac

SEQ ID NO: 575674 - DNA, 216 bp, Homo sapiens
ggtgtttgtagagacttccacatgtgataaggtgatatagaactatatacacatattgtaccaatgtcagtgtcttggttttgattttgtactgcagttacatagatgtaaccattggggaagcagataaagggtacatagaacctcactgtactatcctcgcaattccctgtgtatctgtaattatttcaaaataaaaagtttaaaaagtttaaa

SEQ ID NO: 575675 - DNA, 1310 bp, Homo sapiens
tagcactgcaaggcggcggtaggaaaggtgggggtggctagtttctctaagccatccaggtgccatccatcgtcggctggcaggcgacgacacggctctcagccggccgccatggactggacgcatgatggaccctatctggggccaccctacaaggggccaaaacgggctggggtaacccaagatcgggtaaataaccccggaagttcccgggacttgagatccttctccggcctctcagaaaataaagaccatacatcatggtggcgaaactggaccaggggatagaagaccaatcttatgggaatatccaacaggcggggctacagggggggtccactaccccatatgttggtgtagtgagatgtgtggagttatactcctctacaaatgggccaggttttggcgcccttctacagggctcccctggggagactgggaaaacctctgggcgcctctgggggatttctacacaacggggacaccacccacagaaggcgatcttcgggggggccaatacccaaggcgattgtggcttagcttgtgtgggccttacttcgctcttggacaacccgggcacgatttggtcttctgggatcctcagaaagataaaacaccatacaacgtctatggggaacattacgccgtgggcgctggtgttggcacacatacccaccgggctccccggggaaggcaggacgccccactacaacaaggtggcgatgatcaagggaagcatcccgagaacatccgcccccaaacaagcgcaagccaaaccccacaaacaacggaccaccccaggggggctggggaaacaacgcctgggtccaacgggctcatggcacaccccggggggcaaacgtggaccacgtgcagatcactacacacaccacatttgggggccccaccacaggggccaatacggaaaccaaggggggaaaggggctctcacccaggaatagtgataaccctactgggccggctacccgggagagccaaagagattaggcacagcggccatggcgaaggcgagcctcaacgaaagcggccaacaccatttacacgcgcaaaagagcggggggcaaccaaaatcaacagcccccggagtgctcgcccaacaaccggaagatgagagaagatgtaacaaggccccgcaccatcctgggatataacgagacgcaccataagatcacaacgacaacgacatactacacgcagaagcagagaaccattgaccaccactcgcagagtgacgacactctgggacaaacagaaacgaaagactcaccacctaatacatacaaaaagcg

SEQ ID NO: 575676 - DNA, 351 bp, Homo sapiens
cccgtcctacatcgtgttggaatgcagacctgccaggctgcttgagaatcaaggttttgcctcccccatctggcactcatggtgggagggggtgaaggtgagccctggaggccagaaacacgtgccccattcactgtgaccacccccggactcagcctgagctgatggacaggaggcctcagtccaaggtccccgccaggcacatcaatcctcatagctgacctccagcctcatgacagaaaggcggctgatcctacacagagggtggctgcttttgctaaggacaatataccgaggcttgacatggtatgaggtcttcagtcaggagccagatattggcagccctaaggc

SEQ ID NO: 575677 - DNA, 261 bp, Homo sapiens
  misc_feature (241)..(241): n is a, c, g, or t
  misc_feature (246)..(246): n is a, c, g, or t
gcgaggtgagtgcgatcggccaggtctgctaggtcattgctgacgtcaatcgtttcgctgggactatgctgtcgtaacttgacgccacgaatgaccttgtcggatgcgtaagttattgatttaaaaggaagtccgcttcgccgacgcaaggggaatcgtgtcggacagctgatggctgccggtggctgccggatgtgtaggtcttcccatgttgtgaagtaacggtgctccaccgcctcgnatcgnccgccactggctgtc

SEQ ID NO: 575678 - DNA, 163 bp, Homo sapiens
aggaaagggtcacatttttccaactccgatggctacgtttgccactccctctatagggggggtacatagccgagaaaccctcagccagtctcatctgagtatgggagcgcaggttattgtgaagccctgccagcacggattatgatttagtatccagcatccg

SEQ ID NO: 575679 - DNA, 352 bp, Homo sapiens
aagtagcgtccattgtgaagaacatctctccgtaactcaggctcgtgcacctcgccggcccgagtccagtgcacatcaattttccctgcggtagaagtcgtaggccaggcacgtcagattcttcgtttctcctggggtctggaggctggtgaccgccacagagggaggatcacgccggtccaggcatatttatgctgtatttcaggtatttccgcagagtcgcagtgcactcctccggcaggtaagccttggcccgctgcacgtagactggctctgcctcacacttctgcttggttatctgcgctgatgctgcatgtggcacaccggctggaatgtgtaaggtcaactgatt

SEQ ID NO: 575680 - DNA, 241 bp, Homo sapiens
ctgaacattaaaaaatatacttagaggctgggcgcgtggccacgctgtaatccagcgctttgggaggctgaagcgggcggatccacttgagggagggagttcgagcacggcctggccaacatggtgaagcccagtctgtactagaaatgcagaaaattggttgggcgtggtggtgcgcggcatgttataccatctaattggcgctcagtaggagggggtaccgaggctcgaacttacgtac

SEQ ID NO: 575681 - DNA, 212 bp, Homo sapiens
  misc_feature (5)..(5): n is a, c, g, or t
agtantgtctgcgacctacaccacagctcacgacaatgccagatccttaaccactcatcaagggcagggatcgaacccgaaacctcatgtgtcctagtcagatttgttaaccactgagccacgacgggaactccagcagctttcttctttttaaatcaacttcactgaggtacaatttatatacaaaatgtatagtagtttttcaaagtgcc

SEQ ID NO: 575682 - DNA, 373 bp, Homo sapiens
aagagcagatttagaagcaaagtcaatgaatctgtttgggacacagctggaggagccagcaatcataaaaacagacagaaaaggacatcaggcagttaaaaatgcagccctgttcaagaaagaaacatgatagagtaaatggttaatgcacacacagcctttgtgtgttccaggtggttctatgagctagagcgaggaggctgagcctggacactgtgaccaaaccatggactgttcccacattctacaacctgcattcattccttgtaaatctcttgatgaatttttcacacattctggcctcagttatgtggatatggtccccaaaagatgtgaaagtccttactgggacaaaagaactctttctctcccc

SEQ ID NO: 575683 - DNA, 690 bp, Homo sapiens
gggacgaggcagagtgcaggcagatggaatcggagaaggccgaagggagcaatgagccgctggaatgggacatgaacagacactagatgcggaggaggagctaggaggaatccggaagaagcggcctgtgtgtcgagcaacgaagctggtgtagttgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcaggagcagctgccggagggaaaaagcggtcctacagccaaggactacagcgacgggatgggtggacgttccgtgacaaggcgcatatgccaaagacgctgttgggggccagttctacatgaagagcgcctatgtgggtggcccgtagggcgccagccccctttaccgtccatggatctttggtgaaagccgtcacagtgtactttgcaacccgtttttcgacgctgtgatcccagacctcagtgcgtaggcaccctccggacccttttgagagcggccaagggttggcggcaggggctggcgcatttgaagtaagccggagcggttagcgtccagtgcccaaggcgtgcagcaccggagttctaatcttccaaacgtgtggaaacggggggacaag

SEQ ID NO: 575684 - DNA, 205 bp, Homo sapiens
agggaggtaggcagtgaggtggaccatactattatgtacataacacagagttgcgtatgaaactatattccctgtaaaaacaaataggaaatatgaatgtgaatccaattagacaggttatccttgagacgcccttccttctcacaccaggatattcacacttatctccatttcccagtggcaaaagtagggtaccgagctcgca

SEQ ID NO: 575685 - DNA, 208 bp, Homo sapiens
ttttatttaaaaaaaaaggttttccctgtggtttatggggtggggcccaaattttaaattcctggtataggttccggattaaggggggcctttttttttttagaaatggttgccataaggttaaaaactggaaaacccctttgggggaagcttttgaaatgatataattttttaagatatttaaccggctctggtggtggtatttgga

SEQ ID NO: 575686 - DNA, 267 bp, Homo sapiens
tgtgtagtttgagctgttgcccaggctgggagtgcagaggtgcgatctcggctcactgcaacctccacctccggggttcgagtgattcttctgcctcggcctcctgagtagctgggactacaggcacacaccaccacacccggctaattttggtatttttagtagagacggggtttcaccatgtgggccaggcgggtctggcttgggtttttatggtttcatgatcatagattatatggaataagggcgttatgattatttttaacg

SEQ ID NO: 575687 - DNA, 234 bp, Homo sapiens
cacacgatagtgttaaacagctggaaattgctgctagaggaggaggcttggcagaatgtgtaggggaggcaggagggttgtgtatctggcttttaacctctgccggatgtggcagctgccaccagctatagaccactttatgactttgacatatacagtcctgttcagacctgtgccacagctcaaggatattagtgtaaatcaatcagaaaaaactaaattctggaaaaccct

SEQ ID NO: 575688 - DNA, 100 bp, Homo sapiens
  misc_feature (4)..(4): n is a, c, g, or t
  misc_feature (32)..(32): n is a, c, g, or t
  misc_feature (43)..(43): n is a, c, g, or t
ctantatctggattcccttctcatctcccacncacactcctangacttgacagaactctctctagagagtacccctatgaatgtaagcagggtgggaaag

SEQ ID NO: 575689 - DNA, 87 bp, Homo sapiens
gccaacccatccaccttataccagacaacttggccaaaccattacccaataaggtatggcgttagaatttgaaacctggcgcaatag

SEQ ID NO: 575690 - DNA, 176 bp, Homo sapiens
ttcatgtcagcgcttcatgcgtgtatcacctaaagctcctgtttccagcagggttcatcgagttggcctggcctctttatactttctggggggaagagagctttgaacgcgaggagggggactttagacgagggatgaaaatgagccctgggaggcatgaagggcctcgacatgaa

SEQ ID NO: 575691 - DNA, 358 bp, Homo sapiens
  misc_feature (42)..(42): n is a, c, g, or t
  misc_feature (211)..(211): n is a, c, g, or t
gtctagaggatcccacctcctaccccacgttcgtgaagcganaccggcgaactgaaacatctcagtagctggaggaaaagacatcaaccgaaattcgttagtagtggcgagcgaacgcggaccaggccagtgccgacaagtgaatttagcagaacgatttggaaagatcggccatagcgggtgacagcccccgtatgcgaaaggtgaaatncgtcggactttgagtatgggcggggacacgttgtaaatcctggtctagaacataaggggtgaccaaccctctaaagcctaaaatactccgtattgcgaaccgaatagtgaacctggtacggggtaccgaagcctcgaatttcgtaat

SEQ ID NO: 575692 - DNA, 599 bp, Homo sapiens
  misc_feature (198)..(198): n is a, c, g, or t
  misc_feature (274)..(274): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (293)..(293): n is a, c, g, or t
  misc_feature (334)..(334): n is a, c, g, or t
  misc_feature (337)..(337): n is a, c, g, or t
  misc_feature (339)..(340): n is a, c, g, or t
  misc_feature (358)..(358): n is a, c, g, or t
  misc_feature (363)..(363): n is a, c, g, or t
  misc_feature (370)..(370): n is a, c, g, or t
  misc_feature (373)..(374): n is a, c, g, or t
  misc_feature (377)..(377): n is a, c, g, or t
  misc_feature (381)..(381): n is a, c, g, or t
  misc_feature (388)..(388): n is a, c, g, or t
  misc_feature (394)..(394): n is a, c, g, or t
  misc_feature (398)..(398): n is a, c, g, or t
  misc_feature (413)..(413): n is a, c, g, or t
  misc_feature (447)..(448): n is a, c, g, or t
  misc_feature (456)..(456): n is a, c, g, or t
  misc_feature (467)..(467): n is a, c, g, or t
  misc_feature (477)..(477): n is a, c, g, or t
  misc_feature (482)..(482): n is a, c, g, or t
  misc_feature (486)..(487): n is a, c, g, or t
  misc_feature (490)..(490): n is a, c, g, or t
  misc_feature (495)..(496): n is a, c, g, or t
ctaacgggtacttctgatggtagcacgagtattatctcgtaagattgatctacagtggtgtataagcaagttttttttagtgtaggagaaatacttttccattgtttaactgcaaaacaagatgttaaggtatgcttcaaaaatttgtaaatgtttattttaaacttatctgtttgtaaatgtaactgattaagaatngtgatagttcagcttgaatgtctcttagagggtgggctttgttgatgagggaggggaaacttttttttttctatanantttttncanatnacatnttctgagtcataaccagcctggagtatgatgggcctagatngcngnngaaaacagctcctgggtngaatnggataangtnnaanggcngaaaagnattatntgtnatacctccatggggnaataagcattaacccgtgagattcttactactgnntgagaacnttatctgcatntgccaaaaanatttnaagnncantgaanngctaccaatttaaagttaccggaatctcaccattttaaaggttaattggcttggtcaaggctattaaccaccaaaattactggatcggctgaaaaaatcccat

SEQ ID NO: 575693 - DNA, 436 bp, Homo sapiens
  misc_feature (33)..(33): n is a, c, g, or t
ttccaatttggaaagccattcccaatggagggncagatagcccttttcagtaaatggtcccaagagcaagtggacgacccagaggcatgtaagcctaaccctcccaccctaaaccccccacacttcatacccaaaaaattaacccccaaataattcagactctgaaatgtaaaacataaaacaataaaacttttagggaaccaaaaaaccagaaaatttttgaaatacagggctaggcaaagagacatcaaaagcaagatccctgagaaagaaaaaatgataaatttgacatcattaaaatgaaaattttttgatttgtggaagagtctgatagaggatgaaaggacaaactacagagaaaatgtttacagactccacacctaaaaaaggactggtatgtagaatatacaaaggactctcaaaactccggagtgaa

SEQ ID NO: 575694 - DNA, 989 bp, Homo sapiens
  misc_feature (304)..(304): n is a, c, g, or t
atctcacgttctaggaatactagtatatcgactcagcccagcatcgatatcgtccctactatgcctagaaggaataatactatcggcaggttcgactcataagctactactcataaccctcaaacaccacactcccgtcattagcccaagtatttggtgcctattagacaatatgtatggtctcttgcgcggcctgacgagtacagcgcgtgggtgcataagcacgcatacctagatcgtcaattcctccaaccacgactattgtgcctagaagctgacgttacagtacatgctaagagcctanctccattaggctaagtatctaatgtacgtcagccagacctcagttaactatctaactatcctaggtgtagcatggactgtatccgaaatacaacatccctatagtctgggaaatacacagaaccgagcagcccgaaaggccttatgtttagttagtgcttctagtcccgttctcactattagttcgagccgatatacgaacaaataagcctaatgttagccttgctagcgcccaaggcttttttcccctccgggtagccccttaaggaatacccctactccctaaagtatgtacacctaacactggatgtccctaaccccggtcgagccaatccattgggcctagttcaaacgaccacgattttcagttccaggtgaagcaatattgacgacccctacaactctgacttgatctacctactgtaattctcccactagccaattctccttaacttatcacagttcaatggtcaccacagaagcttcatcataagtcttatggctctttcctttctgaacaaccagcacatgaatcctcccacctggcggtatacatcaccctgagtgaaggccaaccgggcacgaaaaagcctgatgcggtggccgtacattccgtatactacaccccctagaggtaggctcccgttctctagtcctcgcggtaaatttccggacaacatcccttg

SEQ ID NO: 575695 - DNA, 199 bp, Homo sapiens
  misc_feature (149)..(149): n is a, c, g, or t
atgattagttctgtggctgtgaatgttataattaaggagattgtagggagattcatgatttaatgactgccatgctgggtttgaacttgcatggggcctatagcccccttttttggcaggtttttccctagatgggaatatttccccanaccccttgaaccctgagttgtatgtctggaagtaaagtaatttgtttttt

SEQ ID NO: 575696 - DNA, 338 bp, Homo sapiens
gtcagcctcgactgagacacatttctggcgactagtgagaatatatgtatttgtagttgcagccactgtgggtggttaacgtttcaataactgaagaagaacatactgctagcatttgctgggagccataatgagaacttatctacatcatctcatttgaagcttacaggggtttcgagggagtagatactactcttcccatctgtacagccgcgagtcctttgccaaagttactacttgaactcaggtattttctaccagagtggggctactgccagtttttaaggtctggtttaactagaagaaaaaaaaataattaccagggtttaaagctttca

SEQ ID NO: 575697 - DNA, 182 bp, Homo sapiens
acatcagtcggtactgctaggtggagtgtggtggccaaatccacagctccatgtctcacatcaccaggctaagcaatcctcccaccttgtagctgggactacagcgcacagcacactggctaaaattttttttttggttgagacggattctctcatgttgcccaggctggtctccaggctcc

SEQ ID NO: 575698 - DNA, 826 bp, Homo sapiens
gagatcgccgaagcgtcggactaccgttggtttccgcaacttcctggattatcctcgccaaggacttcgctatatagttgtttccgtcttttctggaaggatatcgctgcttcccgaaggtcttggacgagcgctctagctctgtgggaaggtttaggagctctctggctcggattttgcaatttctccctggcggacgtgccgtaggatgccgcatccactgtggatgtgataattgcaacatgtacgctggaagagactcgtggcgtgctgactaacgcggcgctaaaagatgcagacggtgaccgccgcggtggatggagcttttggtggccagttcagactgcctaggatgctgcctgctacatggtgggggtgtacgagtcggccaagtggatgatatgtggacccagacagcgtggtccatctgcctctgtggccattgccgaggaggaggaggatgacatcggcctgtaagatccattgttcacgctctttccagtctcttctgcttgtgactaatgatcatcaatcgtctgggcgggtgtcgtggcattggatcgcttggtcgcagctcctgggagagccggtcgaggacccagggttacaacgagggccgagagcttgtattgtctcctggtcacgtgaatctcaacacgtgacgcctggtaagagcgacggctatggtggaggtggccaggtactgcgaagaaaagcggggcaacaaccagtgggtcccctacatctctcttcaggaacgcttgaggcctttccagcagcagaatctgtgaagttgttgccacaacaaaattacatagttttggac

SEQ ID NO: 575699 - DNA, 310 bp, Homo sapiens
catcccccctattggtgtttgtgccaatttagctactactggtttgatagcttccttattgtctactgttagaaattgccacaaattcagttgcttaaaccaacacagctgtcttacctttcagtttaggaggtcagagtctgtgaccacgttcactgggctgatacctatggtgttgtcatgactgggaccccccgtggagtctggaggagaatctgttttcttgacttttccagcctctagaggctgccgcttcccttcgctcaaagccccttcttcccccttcaaagccaacggtgcgttggcccaa

SEQ ID NO: 575700 - DNA, 114 bp, Homo sapiens
ctcatgttatgatgctgctgagcgtggcgcgacgcatacttgtcgatggatggtccgcacatatggcggtggcaggcttccgctggacgggatctcctgcttaatgacccaggg

SEQ ID NO: 575701 - DNA, 503 bp, Homo sapiens
ggctctcacgtttcttgtgagctctggggagggtagtgggacttttgatacgaaaaatgcatttgtgcagctggtgaggtataattccaaagcaaaagcaggggcaaaattgatttcctgaagtatctctgttcctgctggttatcctccagaatctgtcatgttgactgaaagtgcgtgcttgctttctcaggcctcctggccaatagcacaggtcttgctggaaatcacccacatggtttttcattgcctgtgcagtcaggtgatgcctctatgtttttggaaggtccacctctgttgtttcttaaccttcccagccttcccacagtttgtcccagtgatttgggaagaaaggtctcttcatattctggccactttcgacgctgaaactgcctgtatggctcatagcatcctccatctttaagtccccaggtccatgtatcgagtccgggggtaacactgcttgtaacccttgcagctcctcagctccatgagctgtacgt

SEQ ID NO: 575702 - DNA, 298 bp, Homo sapiens
tacccattctcgcaaggtgctaagcacgcggcacacggtcccgatacaaaaaaggacgattatcgtgcaatacgcaggcatattacacgattcgccccagtctgctcatacttctattctacgtgtcacccgacattttaaattaatccatggcaggaaacgtgacataaaaatgtgagtttcttaacattacacccggtcaactaactgccgtctcatcatctgtcatcccttgcaaacgatatagggtatagtaacggccgcgttggccagtaaccgatcatggtcccccgctcga

SEQ ID NO: 575703 - DNA, 278 bp, Homo sapiens
ggggggggtttaaatgttttccggggaaaaatttcaggggtttcccccccttgaaaaaaaaaaaaagtttttttttgggaccaaatttcctggggaatggggtttgttggcccccaaattttttttttttcgggcggggttcccccccaaaaaaaaaagggggtccccttaaggtttggccaatttcccttaaaaaacttgtttgggggcggggccctttttttaaaaaaaaaaggggtttggtccccaaaacggggaaaaaaattttccttttttga

SEQ ID NO: 575704 - DNA, 1088 bp, Homo sapiens
ggcgctactgaggctcgcggactccggactgcggattggggcgggaagagccgggggcgtggtgtgacagtggagcatgccgcatgactgttgagggccgatgctacctccccgccctgaggtggggtgcaccaccagtgatgagcaatgctgcccagtggagctgacccgagtacttggtgcgcagcctgcacttgccgtggccgtcccgtggggcgtccgtctactgtcccgagcagcccgatgatgccttctccgtcgtcgatcggtccattcctgcctgccttgatgaagctgaaggggccactctctgagtgtccggccgcactcgttcttgtctcgtctcggtcgcagcttcgacctgcatcttcagtctcgcatgcatctggatcatcgaactggagataccaatcagcaagagcatccagtggagaacgtctggaccgcatcggagactcatccatcgtacaaatgtttaaaacttccttcttcgatcatcttgtgtccctgtgccgtatcgttcccgcgttctctggactggcgtcctaggctagtaggccgcggtgcttggaggctccgggcacgggatgagggtgagtatgcggtcacgacgcatggtgtccacgtgcaattcctcatttgtcaaggtcatcctctcttgagctgctcaggcaaatggggcacttttggcctacctgctccccatcgtctctttttgtcctcgcctggtttggaagcaccttggttcctttgacttcacgagttcctaccccaggacagctgaagaggggcgatgggaatctttgccggccaggttgctggttggccggtgggaccccttggtggttctccgggtgactcttgtccgagggggacaagattctttttacaaccccacaagaaattcctttgccagcggtctggacaacttgacttcacgaatgcatgcacgtttgctgggaaacgacagagttctctctgctcctcgcagcgggagtacattccgcacgggggaacgcaggccacggtaaggggtgatccaacatctggccccggacagactgggaattgaggagaaactgaatggg

SEQ ID NO: 575705 - DNA, 360 bp, Homo sapiens
gaggacatgttgggcatgaatatgagctgtatcaggaggttcaattcctagaggtggaattatcgggccagagggtattgtacttataatttggacagatgctggcaaagttctatctatacgagtggtaccgatttatatatccactagcaaggtatgataatgacagatttcgaaccctcccttctgctccgggcaacattctattccctctctgaatctgccttccttatatctcattattccccaacaagagcctgatctctctgggcagggcagttaccataaagctagttctcacttcctccttctaactcgcagcggtacgattcgtgccaatctgaagcactcggtccgggg

SEQ ID NO: 575706 - DNA, 1126 bp, Homo sapiens
ttgtcgttgccgctctggtggctgctgtctttatctgtatctcgttcttgctgtcgtcgtgtttttcctaggctgttctggtttgctgtctttttcttgtttacgctcctttgtcgtgctctgcggtgtttgcagctctgccgctcggtgggtgcttccttcttcttttcgttgttccccgtgtctccgtgctcttcgggttgcgcgcgccggattgtttggcggtataccggtttaccgcatgggccccactgtttgtgcctcttcggggtgtgcaccctgtcgctgcgctgtgttttttgcgcttgtgcctctgtgaccccgatagttgcctgtccctgtgtgtattcacgcctcgtccttttgtgtgtgacacgtcgttttttgtacctgtggatgccctcctctccgctgtccccaaccccccgcggtcagcctgctacttggcctcctaattattttaccacctttagcctaccggtgactcaatcctctgaacaggggtgagcatcaaactcccaattacccccctgatcgggcccactgcgaccagtagccccacaccaatctcaaatgaagtcacccttagccatcattctactatcaacattactaataagtggctcctttaacctgtccgcccttatcacccatcccacaggacacccttctgattactcctggccatcaggagcccttggccataatatgatttatctccaccacctagcacgagacccaccggaccccctttcgaccttgccgaaggggagtccgaaatagtttcaggcttcaacatcgaataccccccaggccccttcgccctatttcttcatagccgagataccccaccacttattataataaacacccctcacccacctaccaattcttcctagggaccaacatatgacccactctcccctgaactctacacaacatattttgtcaccaagaccctacttttaacctccctgttcttatgaattcgaacagcatacccccgattccgctacgaccaactcatacacctcctatgaaaaaacttcctaccactcaccctagcattacttatatgaaatgtctccatacccattacaatctccagcattccccctcaaaccta

SEQ ID NO: 575707 - DNA, 142 bp, Homo sapiens
tacagattagcattgttccggatgtcccaggtttcctcctgtccaggtctaagctgacacgatgtttcttactaccgtcaaacaggagctccgcaccagcgtccgaactccacctccactgacaacggccatggggatcctc

SEQ ID NO: 575708 - DNA, 220 bp, Homo sapiens
  misc_feature (66)..(66): n is a, c, g, or t
  misc_feature (113)..(113): n is a, c, g, or t
  misc_feature (164)..(164): n is a, c, g, or t
  misc_feature (170)..(170): n is a, c, g, or t
  misc_feature (201)..(201): n is a, c, g, or t
  misc_feature (209)..(209): n is a, c, g, or t
ggggctggtccctgtcaggagtgggcaggtcgctgtcaagagagggtaagttccttgtcagtaggnggcaggtccctgttaggagggaactgctttcaagtcagcagccaggnttcaggcaggaaggccaggtgtctttcaccaaaaggcaggtcccaatcagnaagggngacgttctaatcaggaagttacaagctttantcaggaanccaatttccaa

SEQ ID NO: 575709 - DNA, 302 bp, Homo sapiens
cgtcatcagtgcctggattcagtgtccactcatggacgtggtgggagacggccatggtcacgtgctgactccagaatactgctacgtgcgccgaggcagcaggagcccatacatccccccgcacgcggcctgtgccttgaggtgaccctgaagacggctgtggacgggcctgacctggagattgctcacggggcaggagcgcgttggcccttgccaaccggaagcgggagtgcgggaacgcccactaccagcgggcggacttcgtcctggccgccaactcctacgacctcgccatcaaggct

SEQ ID NO: 575710 - DNA, 506 bp, Homo sapiens
tgagacggagaactcactctgttgcccagacgggagtgcaggggacgatcttggttactacaacctccgctccggggttcaagcgatcctcctgcctcagccccccactagctgggactacaaggcacatgccaccatgcccggcctaatatttcatggtattcatatagtagagaccaggcttcgccatgtttggccaggctggatctcgaaccccttgagcctcaggtgatccacctgcctacggactcccaaagtgggaaatgggtcattatacaaaaggggcaaaagtgataccaatccccttgcaactccgtgggcatccgtgctcatctcacaatgccacaaggatatggcagtggatggccaggcctgagcccccgaccaagtggcgttggagagcacaaaatgaactctgcgaggagcacgaggtgggccctgatcaacgggagggcagtgaagaccaccacagcccaacagtggattaatcaaccctatagaccaaa

SEQ ID NO: 575711 - DNA, 110 bp, Homo sapiens
tcactctatgaggatcccccattaccctatagatcagtactcctattcatcagatgctcttccacaatcctatgcctacccgccgcagtactgatctatagagagtggtg

SEQ ID NO: 575712 - DNA, 923 bp, Homo sapiens
  misc_feature (4)..(4): n is a, c, g, or t
  misc_feature (110)..(110): n is a, c, g, or t
  misc_feature (198)..(198): n is a, c, g, or t
  misc_feature (261)..(261): n is a, c, g, or t
  misc_feature (296)..(296): n is a, c, g, or t
  misc_feature (329)..(329): n is a, c, g, or t
  misc_feature (337)..(337): n is a, c, g, or t
  misc_feature (355)..(355): n is a, c, g, or t
  misc_feature (394)..(394): n is a, c, g, or t
  misc_feature (398)..(398): n is a, c, g, or t
  misc_feature (419)..(419): n is a, c, g, or t
  misc_feature (423)..(423): n is a, c, g, or t
  misc_feature (434)..(434): n is a, c, g, or t
  misc_feature (440)..(441): n is a, c, g, or t
  misc_feature (454)..(454): n is a, c, g, or t
  misc_feature (460)..(460): n is a, c, g, or t
  misc_feature (476)..(478): n is a, c, g, or t
  misc_feature (485)..(485): n is a, c, g, or t
  misc_feature (487)..(487): n is a, c, g, or t
  misc_feature (490)..(490): n is a, c, g, or t
  misc_feature (503)..(503): n is a, c, g, or t
  misc_feature (515)..(515): n is a, c, g, or t
  misc_feature (535)..(535): n is a, c, g, or t
  misc_feature (543)..(543): n is a, c, g, or t
  misc_feature (566)..(566): n is a, c, g, or t
  misc_feature (582)..(582): n is a, c, g, or t
  misc_feature (586)..(586): n is a, c, g, or t
  misc_feature (609)..(609): n is a, c, g, or t
  misc_feature (776)..(776): n is a, c, g, or t
  misc_feature (828)..(829): n is a, c, g, or t
  misc_feature (855)..(855): n is a, c, g, or t
  misc_feature (899)..(899): n is a, c, g, or t
atanaaagtacaccttataccccacttaaaggtacactgagaggaataataaaataccttagaggattttgaataatatcatatcaccttatatatgtgtcacacatatntgaaaatgagtatcttgcccaaatttgtagacccacttaaaatttgataattactttttaaatggttcaaatcaaactaaaaagtcantaaccatgaaagtataatcactgaataaggcaaatattatattacctatgttttctcatttgntataaatatttatttatatttatatggcaccttangtgtttccacatctattgtccatagtagagganttttttgngaccttaggttgcttgcnttatgacatgtagctgattttaagactttggtctttgcngtcnaactgcacaaactgcacaggnaggncagattacttntaaagnnagggtcgattcancaaatngctgactttatagcannngtgtaancnttnagactgtagaatnctttcaaagtgnttagagaaaataattttcantctttttncaagttattactatctttgaaancattttaaacccaaanttgngagtattttctaataaaagatcntcacttaaaagagcttctaacatatatgcttcaggggaaaaaaattagtgccagagtctataaaagcagaggagtgatgacacaagaaaatggtaaataacattgtctaatttgcaggacagaaaaaaaaatagtacagaactaataatacagaactaaaatgctgngcaatgatagtataattcagtaggaaagtgactgtatccaaaggtcactctnntattacataaaagaataattatattnacttcaggcttcacagaaatattaaaatatccagaagaatccangataggagtaaaataagtatttgt

SEQ ID NO: 575713 - DNA, 161 bp, Homo sapiens
gggcccccccgggggtttttctggggggggttttttttacggggccccgcccccttttccccggggggggcccggggccccctttttgggggggttttccccccccctttttttttttttggggggggaggggggttttcttaaaatttttttccccccca

SEQ ID NO: 575714 - DNA, 452 bp, Homo sapiens
  misc_feature (34)..(34): n is a, c, g, or t
  misc_feature (87)..(87): n is a, c, g, or t
  misc_feature (90)..(90): n is a, c, g, or t
  misc_feature (127)..(127): n is a, c, g, or t
  misc_feature (132)..(132): n is a, c, g, or t
  misc_feature (136)..(136): n is a, c, g, or t
  misc_feature (156)..(156): n is a, c, g, or t
  misc_feature (158)..(159): n is a, c, g, or t
  misc_feature (184)..(184): n is a, c, g, or t
  misc_feature (188)..(188): n is a, c, g, or t
  misc_feature (211)..(211): n is a, c, g, or t
  misc_feature (214)..(214): n is a, c, g, or t
  misc_feature (224)..(224): n is a, c, g, or t
  misc_feature (230)..(230): n is a, c, g, or t
  misc_feature (234)..(234): n is a, c, g, or t
  misc_feature (243)..(243): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (257)..(257): n is a, c, g, or t
  misc_feature (261)..(261): n is a, c, g, or t
  misc_feature (263)..(263): n is a, c, g, or t
  misc_feature (268)..(268): n is a, c, g, or t
  misc_feature (272)..(273): n is a, c, g, or t
  misc_feature (278)..(278): n is a, c, g, or t
  misc_feature (280)..(280): n is a, c, g, or t
  misc_feature (288)..(288): n is a, c, g, or t
  misc_feature (295)..(295): n is a, c, g, or t
  misc_feature (300)..(300): n is a, c, g, or t
  misc_feature (315)..(315): n is a, c, g, or t
  misc_feature (332)..(332): n is a, c, g, or t
  misc_feature (342)..(342): n is a, c, g, or t
  misc_feature (349)..(349): n is a, c, g, or t
  misc_feature (364)..(364): n is a, c, g, or t
  misc_feature (389)..(389): n is a, c, g, or t
  misc_feature (406)..(406): n is a, c, g, or t
  misc_feature (419)..(419): n is a, c, g, or t
  misc_feature (428)..(428): n is a, c, g, or t
  misc_feature (443)..(443): n is a, c, g, or t
gctttcaaataatgcacacatagtatcgcatggntcaaattccgtacatttcaatatggtcatgagataggctgtattccaaaattnggnatataaatccatacataatatatactatatacattgnctttnaatnatctaactatgtcatttttnanngtcaaagccacttatttctaatggnagtnaccatatgcatgccatattgccnccnattccatagncacccncccngcccccccncntngngggtgctntttntnctggngggnnggtgngngtgggggngcttccnttggngcgtgtgctgtttcncgccggcggttgggtgngggcggcttngggggtngcgggcgttattttnggtcgggccggttcggttttgagtntttaggtcattctcatncaacttcctctantttagctanaaccctcggcagggntttattgtt

SEQ ID NO: 575715 - DNA, 128 bp, Homo sapiens
cagatattattcttttcattcccatcaaatgggcaaactagttccagcaaagtttaatcaacttcaccaggcagcatcacagttcaggcaggtaggggctccaacacccagtcccagctcccagcagt

SEQ ID NO: 575716 - DNA, 635 bp, Homo sapiens
  misc_feature (90)..(90): n is a, c, g, or t
catttcatcgggaagtttggctgatacattggtgggtctgtggtctagtcagtaaagcaggacactggagttcatctcgccaccttttanatgcccagccactgatagcaaaatcatcatattcacaatgcaatgaggagaggtgacctaatttgtgcctgtgaaagccaatgccacaaattagagttggcctatgctgacgtctatgttgaacccaatgctctgtctacttaaatgatagctgccagcttcactgggggctaataacagtgtttacggaaccaggcaaagcagaaaattgagtttgtgtttacttttccccccaatatgctttagtatgccaaaatgccttaataacagctgggtggttgaagcaaagcaggcctcccaaataacaagggcattttcagaatcaatgtgggccgagcctgtgaggtccaaggagaggccttcatctcagatatgtaactgatctgtacttgacctgtgaatttatccccatgttctttaagcagctcacacccttccccacattccattcaatatcaccagactagattgtaccgtatgtgaacgatttaggaaaaaaacctgaaaccaagaaagttgaaacaaataactcacaacaggggaaa

SEQ ID NO: 575717 - DNA, 618 bp, Homo sapiens
gggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatct

SEQ ID NO: 575718 - DNA, 266 bp, Homo sapiens
ttattgaaggggcatttaattcatctggtttgttactttcactactacagtctaaatatagaattattctggagttcctgtggtggctcgttggttaatgaatctgactaagaaccatgaggttgtaggtttgatccctggcctcgctcttgtgggttaaagaatccatcattgccgtgagctgtgatgtaggttgcagatgcagctcgaatcccacgttgctgtggttctggcataggcttggcagctacaactccgatgagacc

SEQ ID NO: 575719 - DNA, 225 bp, Homo sapiens
cttggacgcttctacatgacgtggccccagcaggttggacagagatctagctagctggttagtaactgaactcagcatgctcctctgctgtccgctccttggggtcacaaggtactctcccctccacaacagcattcatcttcccacctgcatgggaggaaggccagggcacactctagatcactcatcccccattttcacagggcaggaagctaggcaacccag

SEQ ID NO: 575720 - DNA, 88 bp, Homo sapiens
ggggggggggggggaggggggtcctttccccccccccccccagttttttttttccccccaaagggaaaaagtttttttttcctttcca

SEQ ID NO: 575721 - DNA, 837 bp, Homo sapiens
  misc_feature (24)..(24): n is a, c, g, or t
  misc_feature (31)..(31): n is a, c, g, or t
  misc_feature (474)..(474): n is a, c, g, or t
  misc_feature (479)..(479): n is a, c, g, or t
  misc_feature (481)..(481): n is a, c, g, or t
  misc_feature (484)..(485): n is a, c, g, or t
  misc_feature (487)..(487): n is a, c, g, or t
  misc_feature (491)..(491): n is a, c, g, or t
  misc_feature (531)..(531): n is a, c, g, or t
  misc_feature (590)..(590): n is a, c, g, or t
  misc_feature (619)..(619): n is a, c, g, or t
  misc_feature (626)..(626): n is a, c, g, or t
  misc_feature (658)..(658): n is a, c, g, or t
  misc_feature (689)..(689): n is a, c, g, or t
  misc_feature (705)..(705): n is a, c, g, or t
  misc_feature (731)..(731): n is a, c, g, or t
  misc_feature (763)..(763): n is a, c, g, or t
  misc_feature (793)..(793): n is a, c, g, or t
  misc_feature (811)..(811): n is a, c, g, or t
ccagaccaaaacgagagaagactncacgggnagctaggatgaggccacggtagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaacccaaaaaccaaaacaaactaacataaaaaaacccaacaacaacccagaacaaagcaaaacccagcagactgtacttagcattgtctaaatccattctcaaattccaaatatcacagacacccctcacacaaggaatataaaaaccaccaccctccagcctggncaacntngtnnancctnatctatacaagatttaaaaataagctgggcgtggtggtanacacctgtggtcccagctactagggaggctgagccagggaagaacgctccagcccaggncttcgaggctgcaatgggctataattgcntcattgnactcccagcctggggaacaggggccctgtttnaaccaccaccaaccaccaacaaccctacttnccctggattcaagggnaaaatttgagtttgtatggtggaagnggtggggaaaaccccaacagggaccccggganatccctccagttttttccaatggggttttnaggccctggggtttttgnaaaacatttccccggggaccggggcc

SEQ ID NO: 575722 - DNA, 1060 bp, Homo sapiens
  misc_feature (11)..(11): n is a, c, g, or t
  misc_feature (18)..(18): n is a, c, g, or t
  misc_feature (39)..(39): n is a, c, g, or t
  misc_feature (67)..(67): n is a, c, g, or t
  misc_feature (93)..(94): n is a, c, g, or t
  misc_feature (136)..(136): n is a, c, g, or t
  misc_feature (139)..(139): n is a, c, g, or t
  misc_feature (154)..(155): n is a, c, g, or t
  misc_feature (159)..(159): n is a, c, g, or t
  misc_feature (172)..(172): n is a, c, g, or t
  misc_feature (195)..(195): n is a, c, g, or t
  misc_feature (209)..(209): n is a, c, g, or t
  misc_feature (215)..(215): n is a, c, g, or t
  misc_feature (275)..(275): n is a, c, g, or t
  misc_feature (304)..(304): n is a, c, g, or t
  misc_feature (329)..(331): n is a, c, g, or t
  misc_feature (337)..(337): n is a, c, g, or t
  misc_feature (356)..(356): n is a, c, g, or t
  misc_feature (360)..(360): n is a, c, g, or t
  misc_feature (364)..(364): n is a, c, g, or t
  misc_feature (372)..(372): n is a, c, g, or t
  misc_feature (381)..(381): n is a, c, g, or t
  misc_feature (414)..(414): n is a, c, g, or t
  misc_feature (419)..(420): n is a, c, g, or t
  misc_feature (428)..(429): n is a, c, g, or t
  misc_feature (434)..(436): n is a, c, g, or t
  misc_feature (438)..(438): n is a, c, g, or t
  misc_feature (440)..(441): n is a, c, g, or t
  misc_feature (456)..(456): n is a, c, g, or t
  misc_feature (466)..(466): n is a, c, g, or t
  misc_feature (472)..(472): n is a, c, g, or t
  misc_feature (474)..(474): n is a, c, g, or t
  misc_feature (485)..(485): n is a, c, g, or t
  misc_feature (498)..(498): n is a, c, g, or t
  misc_feature (500)..(500): n is a, c, g, or t
  misc_feature (503)..(504): n is a, c, g, or t
  misc_feature (518)..(518): n is a, c, g, or t
  misc_feature (526)..(526): n is a, c, g, or t
  misc_feature (535)..(536): n is a, c, g, or t
  misc_feature (548)..(548): n is a, c, g, or t
  misc_feature (551)..(551): n is a, c, g, or t
  misc_feature (563)..(563): n is a, c, g, or t
  misc_feature (603)..(603): n is a, c, g, or t
  misc_feature (625)..(625): n is a, c, g, or t
  misc_feature (629)..(629): n is a, c, g, or t
  misc_feature (632)..(632): n is a, c, g, or t
  misc_feature (634)..(634): n is a, c, g, or t
  misc_feature (641)..(641): n is a, c, g, or t
  misc_feature (646)..(646): n is a, c, g, or t
  misc_feature (648)..(649): n is a, c, g, or t
  misc_feature (653)..(653): n is a, c, g, or t
  misc_feature (681)..(681): n is a, c, g, or t
  misc_feature (698)..(698): n is a, c, g, or t
  misc_feature (702)..(702): n is a, c, g, or t
  misc_feature (729)..(729): n is a, c, g, or t
  misc_feature (744)..(744): n is a, c, g, or t
  misc_feature (754)..(754): n is a, c, g, or t
  misc_feature (788)..(788): n is a, c, g, or t
  misc_feature (791)..(791): n is a, c, g, or t
  misc_feature (794)..(795): n is a, c, g, or t
  misc_feature (799)..(799): n is a, c, g, or t
  misc_feature (804)..(805): n is a, c, g, or t
  misc_feature (839)..(839): n is a, c, g, or t
  misc_feature (847)..(849): n is a, c, g, or t
  misc_feature (857)..(857): n is a, c, g, or t
  misc_feature (873)..(873): n is a, c, g, or t
  misc_feature (876)..(876): n is a, c, g, or t
  misc_feature (884)..(884): n is a, c, g, or t
  misc_feature (897)..(897): n is a, c, g, or t
  misc_feature (905)..(905): n is a, c, g, or t
  misc_feature (914)..(914): n is a, c, g, or t
  misc_feature (920)..(922): n is a, c, g, or t
  misc_feature (940)..(940): n is a, c, g, or t
  misc_feature (950)..(950): n is a, c, g, or t
  misc_feature (959)..(960): n is a, c, g, or t
  misc_feature (969)..(969): n is a, c, g, or t
  misc_feature (1025)..(1025): n is a, c, g, or t
tcttttgcgtngccagcngagccacatcgtctctagtanaccatggggtaaggtgaaggtcggagtnaacggatttggtcgtattgtggcttnnttggtcacttagggctttttttttaatttcttttttaatttnttnttttttccattaatnntttntttattgtttttntttattttttttatttttttttntattattttatttnttttanttttttttttttttttatggttttttatttggttattttttttattttttttattttttntttatttatttttttatttattttattancccccccaaaaaactaagtgcgggnnnaagccnggcgctgtagtacgtcggngganttcnactgcgtntcttccacnacccatggtagaaggccgtgtgctccaatatgnagggnnggatgccnnaaagnnncnanntcccccttccccctnttttgtagcnccccantntccgtacatgnggtgtgaaccaananaanntaagatcaacagcntctaagancatcagcanngcctcctgcacnacnaactgcttagcntccctttccaaggtttttcatttcatttttggtatcgtgntatgattcatgttttcagtccntgcnatnanttctacncagangnntgtngatggcccctccgggaaactgtggcgtnatggccgcggggctctncagnacatcatccctgtctctactggcgctncaaggctgtgggcanggtcatcctnagctgaacgggatgtttttttgcaatgccttccntgntcnnactnccaanntgtcatttgtggaccgaccttgtcgtctataaanatctgtcnnntattatgncatcaagaaggtggtnatnaggcgtcngtgggccccccangggtatcntgtgcacanttagtnnntggtggctcctctgactncaacagcganacccactcnncacctttgncgctggggctggcattgcctcaacgacactttgtcaagctcatttcctggtatganacgaatttggtacagcaacagggtggtggactcat

SEQ ID NO: 575723 - DNA, 798 bp, Homo sapiens
  misc_feature (24)..(24): n is a, c, g, or t
  misc_feature (31)..(31): n is a, c, g, or t
  misc_feature (435)..(435): n is a, c, g, or t
  misc_feature (440)..(440): n is a, c, g, or t
  misc_feature (442)..(442): n is a, c, g, or t
  misc_feature (445)..(446): n is a, c, g, or t
  misc_feature (448)..(448): n is a, c, g, or t
  misc_feature (452)..(452): n is a, c, g, or t
  misc_feature (492)..(492): n is a, c, g, or t
  misc_feature (551)..(551): n is a, c, g, or t
  misc_feature (580)..(580): n is a, c, g, or t
  misc_feature (587)..(587): n is a, c, g, or t
  misc_feature (619)..(619): n is a, c, g, or t
  misc_feature (650)..(650): n is a, c, g, or t
  misc_feature (666)..(666): n is a, c, g, or t
  misc_feature (692)..(692): n is a, c, g, or t
  misc_feature (724)..(724): n is a, c, g, or t
  misc_feature (754)..(754): n is a, c, g, or t
  misc_feature (772)..(772): n is a, c, g, or t
ccagaccaaaacgagagaagactncacgggnagctaggatgaggccacggtagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaacccaaaaaccaaaacaaactaacataaaaaaacccaacaacaacccagaacaaagcaaaacccagcagactgtacttagcattgtctaaatccattctcaaattccaaatatcacagacacccctcacacaaggaatataaaaaccaccaccctccagcctggncaacntngtnnancctnatctatacaagatttaaaaataagctgggcgtggtggtanacacctgtggtcccagctactagggaggctgagccagggaagaacgctccagcccaggncttcgaggctgcaatgggctataattgcntcattgnactcccagcctggggaacaggggccctgtttnaaccaccaccaaccaccaacaaccctacttnccctggattcaagggnaaaatttgagtttgtatggtggaagnggtggggaaaaccccaacagggaccccggganatccctccagttttttccaatggggttttnaggccctggggtttttgnaaaacatttccccggggaccggggcc

SEQ ID NO: 575724 - DNA, 164 bp, Homo sapiens
aagaaagcgctaaattaagcttaatataattgagtggtcctcaaagtgtgatccctttttagcagtattatcagcatcatcccaggcctccccagcaatgtggaactctgtgcaatcattgcacaccctcaatgaccagatttcccattttattgtcaccaagt

SEQ ID NO: 575725 - DNA, 395 bp, Homo sapiens
aaaaacccccccttcgggggttttttttataagcaggctgtacggtcggaatctgattgtgaccaccgtcgcggacgcgtgggtgaccagctcgccacgaccgattcccgggagggtttgaagatgccgcatttggcattggcatgaattcccaaaatttctgcttgcttgcttttactattgatatgcttatacacttacactttatgcacaaaatgtacgggttataataatgttaacatggacatgcatcttttccttttaattaagttttcctaacctttgtggaacgcttggctggttcttcccaatttgcttttggaagtggtaatttcttgcagcccagggttttgccttccccacagggttagtcgtcctatgcggacggggctggg

SEQ ID NO: 575726 - DNA, 586 bp, Homo sapiens
  misc_feature (1)..(1): n is a, c, g, or t
ngcttctgacacttaggaatgctagagagcattcaatactatgcttgggggccaacagtgaaatcatacacacaaaagaggacaaaaatgcaaaaaacatggccatatatagactgcaaatgatctcatttgggaacatgtgcattgggtgactaaaatttttcaccactgtgcacattgccttgaatgaccttgaaagtgctgtggaattacaaatgacttttgaagtacaaattaattttagcacacaggcgaatttccaaatacagaccaagcaaataatgatcaactataccaagaatactaagagaaaccaatgtagattagattccagtgaaattcctccaacactctaaaagcattccttggaaataaaaagaatcttattaatacctagaggacacatgccacttctgatcctaatattcatcttgctttaaacagaccaggagaactgtttcctttgtggaaggggtggggggaataccatttttgacttgaaattgtaacatggtatgttgattcatgaaatcacaaattttaactctctaaacacgagtttcatgggaatctaagtaaatcatag

SEQ ID NO: 575727 - DNA, 786 bp, Homo sapiens
gcagcaaatggcggatgacgccggtgcagcggggggtcccgtaggctgctgttggccctgggatggggaaccagcggtggcttccgtggaggtttcgtgcattggacaattcggggccggggttcgtcgtgccgtggtacggggccggtgaccgaggaccgtggtagactcgacggaggcaagggccgcaggaataaggatgtgtgatgcccgtacaccaagcttgggccgcttggctcaatggacgatgaagcatcaagtccctggcatgagatctatctcttctccctgcccattaaggaatcagaggatcattgatttcttcctgggggcctctctcaaggatgcaggttcttgcaggattcatgccagtgcagaaggcatcataccgatgccaggtggcagctgcaccagggttcaaggcactttgttgctaatcgtgggacgtacaactgggcccacgtcgtgtctgggttgttaagctgctcctaaggaggtggtgctacgcgccatctcgtgggtgcgcatctatgctgtgccaagactctgcatcgtccccgtgcgcagaggcgtactgggggggaacaagatctggcataggcccacacttgtcccttgcaacggtgacaggcactgctgctgggctctgtgcttggtactgcctcatccctgacacccatggggcatctggacatcgtcttccagcacctgtgcctaaagaaggctgctcatgattggcctggtatctgatgacttggtacacctcagatcctgggcttgagtgca

SEQ ID NO: 575728 - DNA, 158 bp, Homo sapiens
cgatagacagaggctatcccaggccttagtctttgggccttctgtctagcacgtacttcgtatcgccatgtgttgattcacttgcatctttcatcttcctcttccacctttttccgggcaactttagcaggacccttggcaccatcaaactttccttt

SEQ ID NO: 575729 - DNA, 149 bp, Homo sapiens
attggacactggaccttaagtcctttgacgtcacgctgcatctggctcacacctatatccaatcatctttggtaggctagatggcagcgtgcacgttgacttaagctcaggagtttgatgatcaatctgttctacaatctgggtactga

SEQ ID NO: 575730 - DNA, 157 bp, Homo sapiens
ctcccgcttgcgcggcgaacggtgcgtgaaaggattaaagacctgccgccatctaaagacacagtcaaggaatttgacttcaatcgccaaggtatttcgagtcgcgttcgcggcttgatctaccagcgcgccggcatttcgctggcctacagcacat

SEQ ID NO: 575731 - DNA, 286 bp, Homo sapiens
gcatactggactcctggcatatctgaccttctggcatacctggaccttctggcatacctggaccttctggcatacctggaccttctggcatacctggaccttctggaaaaccagaaggtcctctagtgaataaaagataaatctatttaagcgaatcttctccagatgtatctgggaaaggctcggagacataataggagaaatgtcgaatccgagcatagcacatcatacttagttcagcctttggatcaacgaaggtccaggtatgccagaaggtccaggtctg

SEQ ID NO: 575732 - DNA, 174 bp, Homo sapiens
gttacaaggctccttcattcattcctggtgtgtatgacaaagccaaggggaagaatttgtctgtcttctgtttccgtgggagtcctcactgcctcggatctgacagcatctgtctggacagcgggcatctttcaccaccaccatgcccagaaccttgcgctgactcgttcacag

SEQ ID NO: 575733 - DNA, 150 bp, Homo sapiens
caatacagagagcagcacatatgaagtggacagacagaggaggcagtgtaccacagcattgtcagaacagagtgaggatggtctagcggttaggattcctggttttcacccaggcggcccgggttcgactcccgcctcctctgtgctgat

SEQ ID NO: 575734 - DNA, 932 bp, Homo sapiens
ggtgaactggatgtagccgaagtcgcatgatccgcatggccaaggagtgtggggctgattggtgccaatgttccgatgaagcagtgtagctatgaagttcaagtttaatcgagacaagcctatgagagaggccgagtacacctcgaagcattccgtgggggaagaccttacggggagcacaaacgacatctggagttcagccatgaccagtacagggacgctgcacgagcgtacgccgaggaggttgggatcttcttcactgcctcatggaatggatgagatggcagcttgaattcctgcatgaagctgaatgtaccagtgtgttgacaacagttgggatctggacgacagcgtaagtaattcttccttatctgggaaaagacagccaacaaaataggtcgcccaattgggtgaatctccagtcgggactgcacgtccaaattgggaataggcgatggaaagccaaagtgttcatcgaggatccggtgaaagcccactacaacccccaaactttcctgcctgtcttcggccagatggtagccagcgacattacacccggcatccaacgcgccctggagggaccggttccagaagcgtggcagagggttcaagtgctacgagcaaattaattcaaggacacggactctttgagcctgggaccaatttgccccaataaggcggtaaatctaccatgggggccacttggacagccacgggcatttaaccagaataactactcgagagcgaccgggccacgacggcacattcctggaggagtggaccacaaggcaaggataaggacaacaagcgaaacgagcgcattgagcgtttttggggaccacaaggaaaccctgggtcaaagtgcaggaaagatgtgaacccaacatccgaggacgtaccacatggagaagaaccctgaggaatgaaacctg

SEQ ID NO: 575735 - DNA, 95 bp, Homo sapiens
gccagcaccaaccagacatctatgtacctctgtgccagcagtcccggcccaggggtccgggtacaccttcggttcggggaccaggttaaccgttg

SEQ ID NO: 575736 - DNA, 171 bp, Homo sapiens
  misc_feature (37)..(37): n is a, c, g, or t
gcgtcgaccgaaagacggccctgccttccagggctcnctagatccttggttcctgtcgtgggaagctgaggcaggagaatcgcttgcacccaggaggtggaggttgcaatgagctgagatcacgccgctgcactccatcctgggtgacagagcaagactctgccgtcgacg

SEQ ID NO: 575737 - DNA, 150 bp, Homo sapiens
caggtatccgaggtatgatacctgtcagcatgtgattttcaagggaaattgtctgtcaactgcctgctcttccaatatgtctgtagcttggacctatagaaatagatttgcttacaccgacctccattagctagctggatgttgcttctc

SEQ ID NO: 575738 - DNA, 147 bp, Homo sapiens
gaaaagggaggagttaactcaggctgcagcagtgacagtgcccaggcctctgatgtgtctctcacagcttgtaaagtgtgagacagctgccttgtgttggactgagaaggcagagttgtcctgcccttccctttgtgacttgaagaa

SEQ ID NO: 575739 - DNA, 316 bp, Homo sapiens
tcctggggttttttggctgactcatgcaaatgaggcgagaaccccttgggcctttccaagttgggtccaacccccactgggcttccttttcaggagtttaacttctgggattttcaggattccctagtttttttcccttaaaggaacacgccaagaaacacaccccttttatttaccccttcccctttaccactcccccccccttttttgttggtgttgtcaaataaagggacctgctttggggggtgatttttacggcctgtccttttttgacagtagcccccggctactttccagcctttggttggggaaagga

SEQ ID NO: 575740 - DNA, 144 bp, Homo sapiens
agaaagcaatgtgttaaatggataagatactctgtatatattaaacattattgagatttatgataactacattttaactagaatgtctaaagtgattatctatttttccccctcaagttagtctttaaatctttctgggtttga

SEQ ID NO: 575741 - DNA, 263 bp, Homo sapiens
  misc_feature (72)..(73): n is a, c, g, or t
  misc_feature (99)..(99): n is a, c, g, or t
gcctgatggtatatactgttttgcaattgcatacaactgtgcattacaaattaatagtaattatggtttggnngtaaaatcgagtttcagaataaaatnaaaaacaataaaatccaaagaacgatgtaaacaaaaaagcttttgttttgttacaaagtatattaaggattttctgctaagattcagtttaagagttttcctcgtgaaaactaagtagaaacacaatgccaacagctggccagtaatcagtgctgtgtactcca

SEQ ID NO: 575742 - DNA, 838 bp, Homo sapiens
  misc_feature (31)..(31): n is a, c, g, or t
  misc_feature (82)..(82): n is a, c, g, or t
  misc_feature (638)..(638): n is a, c, g, or t
ctaccgtaatcgatcaacggatgctcacgtngccgcgagcgccgggacgccgtggagaggagcatgactcaccgtatgtatngcgagcaccgcgttgagtctacttacacgtctgcttcaatcccaggcaggtatcggttcagaaacgaattcttgcccggccgctggcgcttgatggaaaactaccgtgcgccagtagaggggcccaatgctaccgacgttacctggcatcagtatgaaatgatttcaaggcataacaatttttacggtgttttaccgcaagccattgtgcgctggaacgttcaaaacaatgaggctctgcttgctacgcagcagcaggaaggcatgctggagcggtttttggccagtgagggcaatggccgttcaactcagagaatcatgactgctttcggcctgcgtgctacgggtatcacgcgacaggaagtttacgattatcaactgggggcggacgttgacatcatagaggttcatgtcgagcctcagcctgttctcgaacccgctccgatggttaggagcccgtccctggaggctttgactcgagcagtagagcgagacttgcgccgtgcggcgcgcaaccctgtctcacgggttgcccatcgtgtttggcgaaacatgcntagagtcattcaaggtagcagtgcccgacgtgccctgaggtaactctgtgaaggccggacagccgacggatattttgcgagtgctcctcgacctaaatgtgcgaacggggttgagaacaaaaatttcacgcttcgtgttatatcgtaacgaattgtgtgcaaatgggcgttgagcagagccagtggatctagagggttga

SEQ ID NO: 575743 - DNA, 2445 bp, Homo sapiens
gccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagctctgcttggcagtaccccagtggggactctgtgtgggggctccaaccccatatttccctttgacactgccctagcagaggttatccatgaggcccccccgctcccgtgcacagcaaacttttgcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggcaggagcagctgggatgcagggcaccaggttcctaggctgcacacagcagggggttccggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactctagaaaaaaattcttattttgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgttctcacactgcaaataaagacatacctgagactgggtaatttataaaggaaagaggttgaattgactcacagttctgcatggctggggaggctcacaatcatggtggaaggcaaggaggtgcaaaagcatgtctcacatagtggcaaggcaggagagagcatgtgcaggggagctcccatttataaaaccatcagatctcatgagacttagtcactaccgcgagaacagtatggggggaaccatccccatgattcagttatctgcacccggccccacccttgacacgtgggaattattacaatgcaaggtgagatttgggtggggacccatccaaactatgtcagtatgttttgacttcttgcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttatagtcccagcgacttggaaagctgaggcaggaggattgcttgatcccaggagtttgaggtagtgtgcgatgatcgttcttgtgaatagccactagccactgaactccagcttgggcaacattgagacaccctgtctcttaatttaaaaaaaaaaaaaaaaaaatggaggaaagaaagtggtctcagtttttaatgtaaatatttttaatgggatactgatattttaagattaatgtatattgtatatcagttaactgcaggtcaataattatataaaacttaaggtacgaaaaacatttatttttgctaacatatctgtgagttgactgttgttggcttggtgaggctgcaagctgcaaatagagtctaggtatgttttcttggggtttgttcccccttggatcagggggactacctgagaaaggggttcttgtcacagtgatagaaatcccagggaaacctccggtttgggaggtcctttttaagccctttgctcgtgcccttcg

SEQ ID NO: 575744 - DNA, 305 bp, Homo sapiens
ttccccacttgatgccccttgatgccagtcacatacactctcttagcctgtccagtcacgacatagctcaggcgttagtgaagaatccaccacctcctacagtcgaccaggctcgacgcacagcacagtcattccctgactagtcaccaccacgccaggcctcagtcggcattctacaacttcccacagcagcccaggctcgaacggatacgacactgtttcctgccctgttgttcgcccctggcccgggactcgaagggggcacctacggtctccagtcggaattctttattgccaccacccga

SEQ ID NO: 575745 - DNA, 129 bp, Homo sapiens
aagtgtgcaagagcagagctatgggatgggaatgggagtaaacaaggtactatttaacttttttctttatattacctcactgctagacggtgtgggaacttctcactcattggcttctttcccacagga

SEQ ID NO: 575746 - DNA, 2231 bp, Homo sapiens
gccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagctctgcttggcagtaccccagtggggactctgtgtgggggctccaaccccatatttccctttgacactgccctagcagaggttatccatgaggcccccccgctcccgtgcacagcaaacttttgcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggcaggagcagctgggatgcagggcaccaggttcctaggctgcacacagcagggggttccggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactctagaaaaaaattcttattttgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgttctcacactgcaaataaagacatacctgagactgggtaatttataaaggaaagaggttgaattgactcacagttctgcatggctggggaggctcacaatcatggtggaaggcaaggaggtgcaaaagcatgtctcacatagtggcaaggcaggagagagcatgtgcaggggagctcccatttataaaaccatcagatctcatgagacttagtcactaccgcgagaacagtatggggggaaccatccccatgattcagttatctgcacccggccccacccttgacacgtgggaattattacaatgcaaggtgagatttgggtggggacccatccaaactatgtcagtatgttttgacttcttgcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttatagtcccagcgacttggaaagctgaggcaggaggattgcttgatcccaggagtttgaggtagtgtgcgatgatcgttcttgtgaatagccactagccactgaactccagcttgggcaacattgagacaccctgtctcttaatttaaaaaaaaaaaaagattagcttgattgaggattgccaaaaattgcaaaacacttttctcaacagtgctgcggcaaacagttcctttacttacattcctttttccttctctttctcacccacattctgcttattttggtttaggcattc

SEQ ID NO: 575747 - DNA, 159 bp, Homo sapiens
gcaccggcgagttataagatgccagctccaccattacccctcctaagcagaggctggagagaaagccacaaacattacgaagtgccggtcctgaataagggaggtggctgtctgagcttgaaggaggaggaggtcaagaaaggggggtcaccttctctc

SEQ ID NO: 575748 - DNA, 201 bp, Homo sapiens
ggagagggttcagacatgtgcaaatcaataaacataatccagcatataaacagaaccagagacaaaaaccacatggatatcgtcaatagatgcagacaaggccttggacaaaattcaacagcgccttcagtgctaagaaactcaagtaaagttagggtattgagtgggacgctatcgtcgaaagtcgtaagcagcgtattt

SEQ ID NO: 575749 - DNA, 1979 bp, Homo sapiens
gccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagctctgcttggcagtaccccagtggggactctgtgtgggggctccaaccccatatttccctttgacactgccctagcagaggttatccatgaggcccccccgctcccgtgcacagcaaacttttgcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggcaggagcagctgggatgcagggcaccaggttcctaggctgcacacagcagggggttccggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactctagaaaaaaattcttattttgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgttctcacactgcaaataaagacatacctgagactgggtaatttataaaggaaagaggttgaattgactcacagttctgcatggctggggaggctcacaatcatggtggaaggcaaggaggtgcaaaagcatgtctcacatagtggcaaggcaggagagagcatgtgcaggggagctcccatttataaaaccatcagatctcatgagacttagtcactaccgcgagaacagtatggggggaaccatccccatgattcagttatctgcacccggccccacccttgacacgtgggaattattacaatgcaaggtgagatttgggtggggacccatccaaactatgtcagtatgttttgacttcttgcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcagatggccgaggtcacgcgcgaagggtctccgtctgaagaagatccttattgaggagctgggagaaggcacgggaggagaagcagaaaaagctcattgagcacaggctggggaggagtctctggaagaccagt

SEQ ID NO: 575750 - DNA, 425 bp, Homo sapiens
  misc_feature (59)..(59): n is a, c, g, or t
cgttatccaaaagctgcggaactgggcgtctgggcaagacctgcaggcgactacatgcnctaccaggagatcccaagcggacccagccacctccgaaactccccgtggccccagtcacaagctgtccaacaattactactgtactcgtgatggccgccgggaagttgtgcctccctcaatcatcatgtcctcacaaaaggccctggtgtcaggcaaggccgccgagagttctgcaatggcagccactgagaagaaggcagtgacacctgctcctcccatgaagaggtgggagctgtccaaggaccagccatacctgtgaccctgccctaggttaccttgctatatatgtctctagggccacatgactgcttttcctccttggaactcctctggggagagtgtgacctaatttgtaacaaatatat

SEQ ID NO: 575751 - DNA, 384 bp, Homo sapiens
tgccagagggtctcactctcatgtggagaaacgttaacaaggagatcgctagtcaagatagtccgtggccggaacggtcaagaaaaagctgcgaacctgaagaaagacttggcagagatgcaggaatggatgacccaggccgaggaagaatattgggagcgggattttgagtacaagtcaccagaacgacgcttgagacgtgctgtggacagacgactgccgacgggcaacagacggatgtgttgcagccggacggtgacacgtgaagattctcaagagacaacatcaagttattagctgccaaggtgccctcgtggtggccagagagttgacgtctagagctgaactgtcgtgctggaagaattaccaagattctttggtaat

SEQ ID NO: 575752 - DNA, 1106 bp, Homo sapiens
taaacaaccgggccatcaattttttaaaatagtggacttaagccttcttgtgcaaggggtgaacttctcaaccttcaactctcgcggggcctcaatacgtagagtggaagttaactcgtggtttaacaatctctcagaagaggacgtggtgcaagctcaagtgaagctcgctgtggtgaaatccctcactcgtggaaaacgattcccacgttcttaaacacctttcaccaacaagggaggtttactcgtgtggtagaggattctcctcaaaggtctgggaaagggcatttcagaaccgggctccttacacttggaaaaaattctttccatttggcgccctctatatcaaggttcatgaaccagcaccttttctccaaaggggatttttaacggttggcgggctgtgtgatacaggagggtgatatctcagaatcttcggggagagaatgtgggcgccaccttccgggctactcccagcgggggtgattattcaccgggtatattctctttaaagagcgccaggtggggttgattggcagccggcggggtatctccgtgacgcgaacgtgtggttccccctcgagggcgagagaaaaggcaaaacagacgcggggtgagaatcctccacgggaaagccgaggaaagcgcggtgggcggacaccccaaaaaataatccgcgggcgaaaaactgcggcagaggtactactcgtggggagacaccccgaagggggtgtgtgacccccccggagcccggcgggagacctacccgcgcctctgccgggccgcaaagcgaagcatgttctccccaataaacaggcggtcaataatctacgaggcaccaaaggcttccagcgtcggcagaccacacagcgagtacaagccagcccatctcgaggagaaagaggccctatagaagcagcacgagaggggcgaaatccacccgaggagacgcggtaaatacgaggggcgcacaggggaggataactcagccatttattcatcacggcagcacgaccccacaagagaaaatacaccaacaggggaggagagacaccacagcggcgaggaccccaggggggcagaataccaccgagagggaacccacc

SEQ ID NO: 575753 - DNA, 191 bp, Homo sapiens
cggaatggaccaatctatcaccctatagaagaactaattgttagtataagtaacatgaaaacattctcctcggcagaagcctacgtcagattaaaccacccaactgacaattaacagcccaatatctacaatcaaccaacgagtcattattaccctcactgtcaacccaacacaggcattgctcataagga

SEQ ID NO: 575754 - DNA, 735 bp, Homo sapiens
taaccaggggtgtgtctgacttggattcaaaaattaattttaaatttataaaaagtgaccccacaatccgggtcaatcaaaccaaaagtgaccaggccattgtgcccccgtgccggggtggctgggggcctcagggggctcaggtgctgcagcgagttgcccgggggacggggggtggcctcgtggtggctggctctgcagggggcccttgcggacagttctgcaaatggtgctgttggggtggcctctgcaggtgtggctctggtggacttgactgtgcggggtggcctcgtgtggggtggcttctgcggaaggctggttggacacccgtggctttcagcattgtcccggcacgggacagccgtgtccttcctcctgtggctttctccgccatgtggggttccttcagaagcctcagactccctgtgggcaccgcctttctgaatgtggaggggtctccaggcctccagaattttctctggggaggctcccagcatctagggccactcgggccgactattcccaacaacactttgtgtcgttgaaaacccccgggggacaacgcccagttgaataaagggcctaaccagagaaatgaccgtgggattggtttgccgcggaaaaaacataatacccggggtgatgctcaccaagcgacctcatataaataattcccatactatctataagacaaaggactgggccggaagtttgagaggcatcagaaatataggc

SEQ ID NO: 575755 - DNA, 648 bp, Homo sapiens
  misc_feature (519)..(519): n is a, c, g, or t
ccgggctgaaagattagcccacataagtgcccttcaacccccaaaccaactggacaaaatctttgatacagacctatttgctatgggtgctgcccgggatttggggtcagaatctggccccctatcttctgaccaactgagtcatgagggcggcttatctctctctcccacttttgttccccagccaagctctaaagcacatgtaggcgctgagacctcctgtgtctgctgggggcaggcttcctttacaccagacccgcgagactatcgcacgttgcatcaggccctgcccataaggatgaaccctgagccctggagcttaagggatttttctcaagccaaccccacaccagctccttacctgaagctttgagggtttcttggttggaagctgcagctggcccaaaaaaaaaaaaaaaaaactccagggggggcccgggacccaaatctccctatagtgagtcgtatttgcacacaacaggccattttttacaacgtacagactgggaaaaaccatgnccttacccacttaattcgcttggaagaacatacaccttttttaacatgggggaatacataaaaagacccgcaccaatcccctttccaacaattctccaccctgaatggctggtgtagccgtattttgtt

SEQ ID NO: 575756 - DNA, 288 bp, Homo sapiens
accccggattatttttacaacgatactcatgagaacagtgtatgatttcaatggctttattgattttcagtctgttgaacgtgggcacctggaaatttatgggctggcttcattgactctgttttgatgtaatatatagttgtttttagaatgtgctataaaaagtttctggcatctgacctttcctatagaagatcattaacctgtaatttttaaaattattttcaaaggtcttacatagagtaatagtaaatcattaattttaattttctataaaattataaaagg

SEQ ID NO: 575757 - DNA, 359 bp, Homo sapiens
taaaaacctgggggtagggtgggggtgggggcccttttacccccatggggccagtcagggggaaccccttatttttgttttgcatatgaggaaccctagaccagccaggtggggctctctagtttaataaaaatcatggaaagcctcttaatgcagcctctttttaagggttaatagggattttttcagcttattttgggtgcagtttccaatttttaaaaatgttggggtaatctttccccccttcccaaacctaattttggtagaggccttagggttgaaccaaggctttttcatgtcccaattcttgggataggccttcttttcagatgttttaaacaacccaaaccccttcccca

SEQ ID NO: 575758 - DNA, 1006 bp, Homo sapiens
ggtagaccggaatcctgctgacgggcagagtggatcagggcgggagggtcgagacactggctggctgcaggtctgagacaaggctgctccgaggtagtagctctcattgacctggaggtggccacttcattcctggagtgctgctgaggagcgagggcccatctggggatctctggaagtcggtgcccaggcctgataggactagccccccattgcgcttcccatgcgtgctgctggcccggcacttctcagaacgaacgggcagtcacttccagcccctgcggccgcaggtgacctgctgccatggcttaacccacatcaggccggacgcccctgagctgactgacttctccatgctgaagaggctggcctcgagaccagcatcatctatctgctggagcagcttcctggaaacaaaggactttcacttcattgaggcagatctccatgagcccctatggcatcgaattgccaatgtctccatcctgcacacgccacacacgaaagtagaacaacgctactacaccggtggacgaacaagccagccctcaggtccaatgaaccattgttgccttcttggtcagaccaccgcatcacggactatgcgatacattggccagatcttgtcaacttgctgacccacttcggactggccgcaccttcgccaccataccacacagctgcatctttcagcccctcacacaggttctactgcagtgtgcaaactggtgcccttgctgacacaccggcatctatgcaccctcttaggccgacgacaaccatgtcacctcggtcttgcagcacatccaactctgtgcatcacggaatcgcagttcacgctacaccgcagatacgccacgatgtcctatcccctacagacaggaatacactcgagtgcaggcgtccccacctcggccagtccatagcgcccccaccgcctcactccgcactcactacgtgtgaagcctccaccccacgcgcccacaacttgcgtcaccccgccaaa

SEQ ID NO: 575759 - DNA, 949 bp, Homo sapiens
  misc_feature (636)..(636): n is a, c, g, or t
ggtgctgctttgttcgttggtgtggttgtgcgtagtcttgtgttggtccgtcacctgttgttcgcgggtgcgcccctctcgcgctgtttgttttgggccccgattattttttcccgccgctgggaattctcccgttggctctctactccggagaggccgcttgaacccatggttgggtcgtggctatgttctcttggcttcctaggggttttcctgtgggccccccccaacatctgccgttgggattgaccgtgtgacaccccgagcctagtttccccctccccgtccattatcatcggcttttccccccccggcgtccaagttatttactggctcgcccccacctccccgggagtccatattggatgagtttgctgcagtgctttgagccctaggactcatcgtttgcttgttgcgccgtaaggtggcccgactggccttgtattagccgactcactcacctagagcactcgtgctacaccgaccccgtgactaccgcttgtagcccccttcccctagtgtcctcatccataggggctgtatttgcccacactaggaggcttcattcacctgaggttcccctatttctcacgggtaccaccctagacccaacctacggcccaaatcccttgtcanctatcatattcactcggcgtaaatctacctttcgtgccccccacaccttttttcggcctatccgggatgccccgaacgttaactcggagtaccccgatgcactacacccaccctggaacactcctatcatctgtaggctcacttcatttctttacagccgtaatattaaaaaatttcatgatttgaggagccttcgctttgaagcgaaaagatccttatagtagaagaaccctccattaacctggagtgactatatggatgccccccccccttccacaccttcgaagaacccgtatacattaaatttagacca

SEQ ID NO: 575760 - DNA, 655 bp, Homo sapiens
ttcgccccccccggggggcccgcgccccatttttcccctccgggggggtttctcccaaattgttttttggggccccgagagaggcgcgtccccccccccggggttttaattcctcgcggggccaaaaatttggtgtgggttggcgcttttctccccccccccgcggggccctttttttaaaaaagcccccgggttttttccagaaaagaggggtttgttgtgggggttataaccccggtttttcccccccccccctttgggggcccccaaaaaatttttttggtttccccccccccgcggggcccccccaattttccccaaaaaaaaaaaaatttttttttggggggccccccccggtttccccccgattttccgggggggggggcccccccggaaaaaaaaaggggggggggggccccttggggggttttaacccccccccccgggggggcccgccccttttttgtttttaccccttttttccccccccggggggggggccggggaaccccgggggggggggggggggccccccccccccctttgggggccccccaagcccccccttttttttttttgggggggttttttttgggggggggggggtttgggggcccctttttttttttttccccgcctttttttttgggcccca

SEQ ID NO: 575761 - DNA, 404 bp, Homo sapiens
aagcattgtcccgaagcgatatgcgtagagggtatcctgatgtcttgcgatccggctctcagctgccggtgcacgggatgctgacacgaggctcagaggagatttccatgggctccccttctgaccgctctccactgtcccctggggcttctgctgaggctgggcttctgcttttctttggcttatcaaaccggaagtccgcggggtacaggtgcatcctcaccatgtgatccttccggtctctgctggtcttgaacttctctgtgcagccttctaccaagcactgatacatgtcctgcctctcagacaggatctggaagagcgaatcgtgccactccaggatgtgggcgtccagcagtggtgactgccccccactccttttctgagtctgaaggcagtctgga

SEQ ID NO: 575762 - DNA, 414 bp, Homo sapiens
caccttctgagtcctggatgtgatacctagacagcatgtactgcttggggtccattcacaggtttacaactttttcattgagttgcaatctgtgaactgtgtgaggttggccagcgtaagtcaccatcaataggtcatagttgttgcttgttgagcatggtctcaaagtcatcgggaactattttcggtacttggttaaccaggctcatcaggaagcggcccatagtattgtcagctgacacctttccagacagtacatcctctgcatattgcaacactgtactcagggcatcctggatgcgacctgatgcccctcctacttggtgcaagtcacttgagagtccaatcactctgttggggctaaagcaggtcttcatgatcaggtcaactccgatgcgttcagtgtcgtagtac

SEQ ID NO: 575763 - DNA, 938 bp, Homo sapiens
cgaaaatgaagcacgagagtggagtcactttagttatcggacggctcggggcacacggtgctcggtcggtgtccaagtggcaacccgggtcagcagttcctgaagaaaggcgcctgcatgtgggctgcgcaagtgacttcctgggatcttgcgttcaagccggcgttgatcagctcatgttcatcaacggaggacctcatccctgccgcgactaccacaccttctacgatcttcatcatcagccagggcgaggggtaagagcgggtccgctctgtcagcttcgatgtgcacgatgacgtgcgcctgctcagcgacgccatccatggagaaggtacgagtcgcacgcgggcaagttggtgctgcgcagctggtacgagatagaacaagcacatcttccccgccagccgctgggacggcctatgatccccgagaagaagtgggacaaggtacatccatccgcgtaacaccacgctctgccagagcggaaaaccgggaggtatgggtggagacactcaatttctaggccccatcacctagtcactgtgactttcgtgcaccttgatgttcttcccaccaaagtttaatagaagacacgatgggttctcatgattcacattggttgtgctattgctcgatgttatgatttgattgcttggttggtcttcttctgagtattttagtgttgccacctggatttgctgcattgctctgactgagctgtatggaaaccatgactgggcccactgtcagacagaaattagaataggaggcacattttttacctggtggttatgagcctggactcgggggccacagtgactgagtttgattcccgacacagcctcctccgtgctgtgtagttttgggtaagcttattgacccccatgcctcagtttgctcacctgtataaggaaatgacaagagcacgtactgtatta

SEQ ID NO: 575764 - DNA, 303 bp, Homo sapiens
  misc_feature (103)..(103): n is a, c, g, or t
  misc_feature (293)..(293): n is a, c, g, or t
gacgctctctctgtggggccggacgggcgcctcctccgcgggtatgaccaggacgcctacgacggcaaggattacatcgccctgaacgaggacctgagctccntggaccgcggcggacacccgcggctcacgcttcacccaagcgcaagtgggaggcggccctgtgtgtgcggagcaggacagagcctacctggagggcctgtgcgtggcagtcgctcccgcagatacctggagaacgggaaggagacgctgcagctgcgcgggtaccagggtgcagtggggagccttccccnattctcctat

SEQ ID NO: 575765 - DNA, 286 bp, Homo sapiens
gcgtgacctccaaatatcgctgagctgagcctgtaacgagtctagaggatcctccagtagccgagcatacatgaatgcctgcagtgaagacgtgtacacagcactgcggttcatgcctcccatagaagaagtcccggcgacacgtgagccccgtgctgacctccaaatatctgttagctggagcctggtcgacgtgtatacaccaatgcggtgcatacctccctgtacaagttccgtcgacacgtgagcaccgtgctgacctccaaatatcgttaagctggagcct

SEQ ID NO: 575766 - DNA, 825 bp, Homo sapiens
agatcgcgccactgcactccagcctggcgacagagcgagacaccgtctcaaaaaaaaaaaaaagaaatttgtgcaaagcttaggtaaatattttcctttattaaagcttctcactgagaagccctcttttattttgggtaaattgtcactctgttggtaggagatgtctgctttcccagtgaatttgaaattagtggcgctaaagccctgaaagaggcaagactacaattgggctgaacacagtgggtattagcaaccccagagaagtgctctcatttccttttatagtagaacgcaggtccatgtctttggtgggttccctgcacttcttgggagtagttatgacttctcagttttcccccccttaaactggcttggcctattctttttccctgacttgctatcaggtatcagtgtgtggaatacattaatgctggctgtctcagacttacgtactggtcatcacccattaaaagatttgcagccttcgttggcccccagtgacctcccacaaaacaaacaacagacaaaccaatacacaaaacaacctttgttgcgccgcctcctcgggcccccttaaaaaaaaaatttttctagcacccacttcgtgtggggccgcgccggcccccccttatgttgtgtcgtcgaccccctgtgcccccagaggcggtttccccccagggaccaccgctgggcacaggcacacgctgcctggggttctcccccccagtgtagaaagcgccgcgcgggaccccccggcgtgtttctgacacatccgcatgggggaccttcgggagccccaccggcgctcccccccgggggtcg

SEQ ID NO: 575767 - DNA, 241 bp, Homo sapiens
cccccgtttttttaaaagggggcccccttccccccccccccccaagggggggggggggggggggggggccaacccccccccacccccaaagggggggttttggggccccccccgtttaaaacccccaggggggtttttttcccgggcccctttttttaccgggcccctttgggaatgccctttttccttttggggggatttttgtccccgccggggtttttttaagggaaaaaatggggga

SEQ ID NO: 575768 - DNA, 803 bp, Homo sapiens
  misc_feature (679)..(679): n is a, c, g, or t
  misc_feature (693)..(693): n is a, c, g, or t
ctagctcaaacgacgggggcctttgcaatctccacgtgcgatggatccttggacccactttgttaactcttaaactttgtgtcttgtctttatttcttttctcattccctcgtctccaccgggaaggggagagcctgcgggtggtgtatcaggcaggttcccctacatctttggcacccaacacggtctccttgaacccaggtgaagttacacctgagcgtggtcgttgtgaagaacggtctgtccaggaactcccgagaacgtgtggtcggccttgcggtaagcttgtgcactcggagcattccagggacaccatgggacaatccaaaagtaaacattctgcatatttacattttattaagctcctcttaaagagggcaggaattaaggctagcacagaaaatttgattactctgtttccaacagtagagcaatatcgtccttggtttcctgaacatggtaccatggacttcaaagattgggaacaggtgggaattgccttaaaacaagttgtaaggaaggaaaatttatccccctaacagcctggtcaaactgggctatagttaaaagcagcctcggaaccgtttcaatcggaaaatgagggcttatcctccagcagaaagaatttctgcagaggaaggtggtgatgctgctgaaggaggagaggatagtgaagcangatttggggaaatncagacaacttgggatgagtaattctttggggccctggacttcggcggtcccaaataagagagcctttttgcccgatttacacaagggcttggacacggccctgggacccg

SEQ ID NO: 575769 - DNA, 501 bp, Homo sapiens
ctagctcaaacgacgggggcctttgcaatctccacgtgcgatggatccttggacccactttgttaactcttaaactttgtgtcttgtctttatttcttttctcattccctcgtctccaccgggaaggggagagcctgcgggtggtgtatcaggcaggttcccctacatctttggcacccaacacggtctccttgaacccaggtgaagttacacctgagcgtggtcgttgtgaagaacggtctgtccaggaactcccgagaacgtgtggtcggccttgcgacaaggctcaaaggaaccatatcctgatttcattgctcgccttcaagacgcagcacagaaggctctcactgatgaaagtgccaggaaggccgggtgcggtgctcatgcctgtaatcccagcactttgggaggccgaggtgggcggatcacctgaggtcgggagttggagaccagcctgaccaacatggagaaaccccgtctctactaaaaatataaaactta

SEQ ID NO: 575770 - DNA, 621 bp, Homo sapiens
ggttcatggaacacgatgaacctattctgaagcacttgaaagatattaaagtgagatgttctcagatgctggccagcctgatggagtttgtcttatgaagtttcactttgaacccagatgaatattttacaagatgaagtgctgacaaagacagtacaggatgaggtcagaatcagatgattctgatcccttttctttggattgtgaccagtaaattatgtggtttgtcaccatgggtgctcagatcagtattgcgaagaagaaggaaagcaatcgtcactatttggacacagactgattacatgacaagaagctacgatagactacaaggtgacgtgggacatggacgtactgtgacttaaatacagttatcgcaaatgacatcttatctatgtgaactttatttggcccctcctgaagttcctgagaggggcagatctggatgatgatgctgaaagatatccgttgcatagcagacttcgaaattcggggcacttataacgtgagccgtataatcccgtagatcagtgtgatattttactggagaagctattgaagatgatgatgatgattatgatgaagaaggtgaagaagcggatgaggtaatgtttagcaaagtga

SEQ ID NO: 575771 - DNA, 480 bp, Homo sapiens
tatcgcttagaaaagtttttataaagataattgttttagtgctaaaagctcaaatttttataaggaagggatttttatataaagttatattcatctcttgatagacattgatatcaaatagagaaaagtagctagtaaaaataatcgtagtttctttccactctaccatcaaactgaaattataaaatgccccaaatgtgagcaatagaaaggcagaaaggagtacagtcttgacattatacaactcagggcaccactcacaggaatacttctctcagaaactgtgaaaagaaatttactattagggaagcaatgtggtgaaacaaaaagagcaaataagctaaaatgtggcttcagatataggcagcattctttaccttgtaatacagtggcttaaggctagtcactatttattattgttacttaaggaggccaaaataactgtagttattgttccaggtgcttaactctgcttaagcg

SEQ ID NO: 575772 - DNA, 249 bp, Homo sapiens
tgcgaataacctactgaatacagaccttaaatcagcgttattaagtggctgctgagccacatgaaattcgacatgcaatcaaacgcaggtatatgtgtatcttccctctaatccttactaaagttctgttcttatgcagaagtctcaaaaacaaaacgctcgagggacaatgtccagagtggtgtaaaacatacatacctatgtaaacctacagtgaagctgaccaagggaccagttcaagtgacttat

SEQ ID NO: 575773 - DNA, 184 bp, Homo sapiens
gtgcctcccaaagtgctgggattacaggtgtccctgccccttttaatagccaatattttgtaatccttcctttcccccctgaagtgaatgtcatttatgctataacctacccataatgtaatttcagaaaatccctgtactatcccaaaggcaatgaaaaggagaaatcaaaggggggttttta

SEQ ID NO: 575774 - DNA, 402 bp, Homo sapiens
  misc_feature (224)..(224): n is a, c, g, or t
taatataaagcctgccattaaccaaggccttgatcggacttattcaagaccaattgaagacatgtttcttagaaagcatccttggagtctgcgtaatagttaatgatagtgttagattttagtttgcttgtacatacaatctgggagatgagagactattagaaacttgaatacacaaagtttctatcaattaagtctgtcactgctttctgtgttcccatgcnatgtccatcttttcaacctcagatccagatatgtaacaatctttattctttctgaagccatcatccacgaagcccttgagaaagttgcttctgggcgaacatcaaaattagttttctttagagagtggtcacagaagtactttataaaaataaaaatgaaaaataaaacatctcttta

SEQ ID NO: 575775 - DNA, 1779 bp, Homo sapiens
gaaaaatgaaaatgctagagtttgtgcaacataacagtagcagtaaaaaccaagtgaaaagtctttccaaaactgtgttaagagggcatctgctgggaaacgatttgaggagaaggtactaaattgcttggtattttccgtaggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatcccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccattgtgccttactaaatatgggaatgtctaacttaaatagctttgagatttcagctatgctagaggcttttattagaaagccatatttttttctgtaaaagttactaatatatctgtaacactattacagtattgctatttatattcattcagatataagatttgtacatattatcatcctataaagaaacggtatgacttaattttagaaagaaaattatattctgtttattatgacaaatgaaagagaaaatatatatttttaatggaaagtttgtagcatttttctaataggtactgccatatttttctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattattttttaaaaaactcgtgcc

SEQ ID NO: 575776 - DNA, 172 bp, Homo sapiens
  misc_feature (43)..(43): n is a, c, g, or t
agccagcgttattcgcatcatctgaatcagccgcagatttacnatatctgtggacctatgctccagctccaggagcagaccgcttccagatatactataagagtatcacatcctcctcctcttcatctatctgactctgcatctatcctccacagactactaacgtgctgtc

SEQ ID NO: 575777 - DNA, 342 bp, Homo sapiens
cgggagcggaagacattctctcaagtcctctcgtgcgcaagcgccgagtggtcattgtggaccccgagacaggcaaggagatatcaatgtaccaaggctaccggaagggcctgattgaccaccaaacgtacctggaactttcccaacaagaatgccaatgggaagaaaacactattttcttcttggacggggtggtcaaatccatgatcattgaccggcggttcgggcgccagtaccaaattgatgatgccattgccaaaaaccttattgaccggttggcacttgaccaataccgggccggcacgcttttcattaccgaattcgccgacatgcttttgggca

SEQ ID NO: 575778 - DNA, 552 bp, Homo sapiens
  misc_feature (506)..(506): n is a, c, g, or t
  misc_feature (514)..(514): n is a, c, g, or t
tacttctggcacccaagcgggagtcatttacacttatcttaacttactggaacctttattttccgggtttaagggatttttcttgcttagcctcccaaggagctgggattacaggcatgcgccattacacccaggtaattttcggatttttaggagagatggggttttaccattgtggccagaatggtcttggactcctgaccttaagtgatacacccaacttagcctccaaagggctgtgattacaggtgtgagccaccggtgccggcacaacctttttttgttatgaacactgtgtcttgtgtgagatatgctgcaggggccgccctaatcacaagaaagcaatggatagaagcatctgacttttgcatagaaaaaaaaaaaagcaaaattgtgggaaagaggagtcccactagtcttgctgcactgtcactgggaatcagctcaagggaacatctcttttcctcccaaaacgctggaggaagtccagccctgctgttactggngtctgggnttacttgggcactcctggtgatagtggtgcctgcagcg

SEQ ID NO: 575779 - DNA, 285 bp, Homo sapiens
ggcggatgcgcgggtcggacgggtgcgcggttatggagtacaggaggcccagagcttgtcggcggtgagagtccgagtgaagacggatagctgcttgggcctgaagtcagcgggatgatgtttgctgcagaatggaatacctgcagagggcacaggtcccagatatgcagtactgactgtcgcccagcaaagacccccagtaaatacccagccccactaggagcacgttgccaggacgccaggccctccctccctccggggcagctcctaccccagctggcatcg

SEQ ID NO: 575780 - DNA, 299 bp, Homo sapiens
gcatgcggagatgggccagtgcatggtggcccacacctgatagggggagcactaagcgcggccgaggcaggtggctcacctgaggtcaggagttcgagactagcctgagcaacatggagacgccccgtccactaaagataccaacttagctgggcgtgctggcgcatgcctgtactcccagctacccaggaggctgaggcaggagactcacttgaacctgggaggcagaggttgcagtgagctgagctcgtgccactatactccagcctgggacagagcgcagctccgtctcaggaaaa

SEQ ID NO: 575781 - DNA, 499 bp, Homo sapiens
ctagaggatcctcgaaaatgacatagatggcaggaatttggcaggaacatcagacattggaagtgttagatagagactagagcagtgttggaaaactcttagtggtccccagagcagcattagagatctacacagagtgggccccaagtggctgcgactccagtgagctgagacccccgcaggtagggaggtacctactagacgtgagacactacacaaagttgaccccagttacagcaagggtacagaggaaggtctgtgagggagaagagagtaaagggccctgggtgggcaggaggctgacggagggagcctggggagagcaccagggcagggcatcaggccagtgcctaggacagtgtaggccaaagcggtctctagctgctgctctgctgctcctgctcatggatgagttaggcgatggcgccggtgatgccgcctatcaaggtccagtactcatcgaagctgatgcgcccatcatgattggcatccaggtact

SEQ ID NO: 575782 - DNA, 671 bp, Homo sapiens
tacaaatgaggcaatttattaaacccagctgggttggtgcctaagggcttctggtgggcagctggccaccggtccggcgattctggtccaaatctcttggtccctgaggggtcagttgggggccgccatctggtgtccttttccaccattttcagcccctccagggctgggaggaccctggggggccacactctgggagcctcggctgaagtggctgggcatgacgccgtattctctgacgtcccccataaatctgggtcatggagccaaccccagcgccaccccgggaggtacaggtgccgcgctgtggaagcagctcgcgtgtagaaccagttctcatcgtagggagcaagctcttggtgctgggccagcttgagggtatccacccattcggggactttcagcttcccggacttttggaggaaggctgccagagctctgacgaactccgggtggtccacgtctttacagtaactccgggctatcgggcgggctagacggagcatggcgctttctggatcaaccagatgattcaccggttgttttaaaagagaccccgtgtaacctgggggcaccccgaaaacacgcaacagagaacccgcaacaagaacacgagaaaagacaggcacatatacaccagagaacaaagacaggaaacccaccgagtcaaa

SEQ ID NO: 575783 - DNA, 853 bp, Homo sapiens
agcgggctggtggtgcgcgctgccgcttgtggcacaggcggtcccggctgcggcttctggctgcgcggtcttggcgcgcctcccgggcggattcctgccccgagcgggacatgcgctgtcgggaagcgatgagatttctctctgatcaaatcggacacgttcgaggactccaggaaatcgtacaggtgattagacatgtttcacgcgatggacaagatgaacgagtagacaagagtcaatatgcgggccacgtgatggcccagctgtttagtggatgatactttagcttgtagcccaagaaaaagaatcaaacagcctggcttcatctggtcctcataatcttacttatcctctaggtcccaggaatgaagacctctcacttgactatgcctcttcagtccagcaaatcttcagtatccctcagcataatgccccttgctgaagacatcaaaggttcttgcttccaaagtgggaataaagtggaaccatgaacctattatatgttccagaaagatttggaaacagatagtgtggggctatgcgcagtaagttcccatttcccaagcgaccagagacaagtgacgcttccttgtagatggccacactgttaagttcgtgaatccacagattttcactgctcatccggataccatgctgggaagggatgtctggaccaggagagagcagtacaacttacactcgggcccaattgaagaagtggagagtatgagattgctgacgggagtcactgggcacgtgtatttcgggcgcatgtgctgggataattaacaaaaaccgggaatcatcacattggacctgaataggaatcctaatcccaagattctaagaagat

SEQ ID NO: 575784 - DNA, 873 bp, Homo sapiens
gccgggtatgtcttgaactggaccctggtgtcatgcacagctcctgaggacaggagctgtgcatgacgaccacgggtgtgatcttgcgccgagttcctcgtgcgtcagtgcatatgtgtcttggatacaggactgtgcttgaataagcatgtagtatcactcgcactgatatatcggctagaactccgagtgttgagtacctcagccatctattggaggagagatccacacggaggccttcggtggtgcgacaactcgatcatttgcggtatgcattgaagacttcggtgtcgaacgtctccgcgtgctacgctcggcaacacgtatcacctgtactcgtagttgccttgttcccaacacgagcccattctggggcgccgtcgcgtgctgcgctacagttgtgcatgggtgccggtgccgccatccgccgttctccatgtacttcttggtctcctgcgtgaagctccgtgtctgctccccagggggcaggcgtggtcttctcgtgtatcgactattcctctctgttcaggcaggagaccacctgtgaggcagcaagacttatgggagtgtgcgtgagcggggggccgtcgttggtacgtgagggtgggcttcgaagacgcgatgatgcgcagcgtcagctcagtgaactcttgctcaactagtccctgctttgggcccccctcctgttgacctcaggggtttggcccatggtgtccctcccagtgcccttgccccaatgatttcctggccaggaatattcgtggtctcctggcctcccacttcagctgcgttctccggtctgtgaaatgttggctgggcccggggtcccccttgtgttgtggctccctgtcctgggcagattgctgcttagag

SEQ ID NO: 575785 - DNA, 138 bp, Homo sapiens
acctcgtccgtgtagcgacgtcagaacctcaaggactaagctggatggaagagatgctcggactggcccggagcctcaagaccaataccctggccgcccagagtgtcatcaagaaggacaaccagaccctgtcacact

SEQ ID NO: 575786 - DNA, 450 bp, Homo sapiens
cccagtattcccctaaatagatgtattataagtcatttaagcaggctcctagctgtgaacattttgattacttctaatttgcaaataaagctgcaatgactatcctttcacattcatcatttgatcatctgcccagttaggttgtttcttttaaaaaaaattaagtactttccaatggatttcaaatacaaatcaatatttttggttgctctttaaaggtcagacaacttggcatcactgactgccactcctgcttggcaacagtctccagagttgaggaactacatcctttaaagaaccctttcctttccagttgttctagaacccccctccctgttgtcttcccaactcctcctgcccctacaggcgtctgcatgcatgagcccctggtaagactgagaacatatgcaaatagtgcctggaatgaaataaatactcaataaatgctaa

SEQ ID NO: 575787 - DNA, 129 bp, Homo sapiens
  misc_feature (95)..(95): n is a, c, g, or t
ctctatagatacacatgcagccccggattgagtcacctctaatcacacgatcaaagggacagcatcaagcaccgagtaatacagatgttagctancacaccccacggaacagagtgataaccttagcaa

SEQ ID NO: 575788 - DNA, 791 bp, Homo sapiens
  misc_feature (85)..(85): n is a, c, g, or t
  misc_feature (129)..(129): n is a, c, g, or t
  misc_feature (146)..(146): n is a, c, g, or t
  misc_feature (188)..(188): n is a, c, g, or t
  misc_feature (194)..(194): n is a, c, g, or t
  misc_feature (222)..(222): n is a, c, g, or t
  misc_feature (224)..(225): n is a, c, g, or t
  misc_feature (253)..(253): n is a, c, g, or t
  misc_feature (257)..(258): n is a, c, g, or t
  misc_feature (269)..(269): n is a, c, g, or t
  misc_feature (275)..(275): n is a, c, g, or t
  misc_feature (278)..(278): n is a, c, g, or t
  misc_feature (289)..(289): n is a, c, g, or t
  misc_feature (297)..(297): n is a, c, g, or t
  misc_feature (304)..(304): n is a, c, g, or t
  misc_feature (315)..(315): n is a, c, g, or t
  misc_feature (318)..(318): n is a, c, g, or t
  misc_feature (327)..(327): n is a, c, g, or t
  misc_feature (342)..(342): n is a, c, g, or t
  misc_feature (382)..(382): n is a, c, g, or t
  misc_feature (392)..(392): n is a, c, g, or t
  misc_feature (396)..(396): n is a, c, g, or t
  misc_feature (423)..(423): n is a, c, g, or t
  misc_feature (427)..(427): n is a, c, g, or t
  misc_feature (431)..(431): n is a, c, g, or t
  misc_feature (450)..(450): n is a, c, g, or t
  misc_feature (452)..(452): n is a, c, g, or t
  misc_feature (458)..(458): n is a, c, g, or t
  misc_feature (468)..(468): n is a, c, g, or t
  misc_feature (486)..(486): n is a, c, g, or t
  misc_feature (494)..(494): n is a, c, g, or t
  misc_feature (498)..(498): n is a, c, g, or t
  misc_feature (509)..(509): n is a, c, g, or t
  misc_feature (514)..(514): n is a, c, g, or t
  misc_feature (517)..(517): n is a, c, g, or t
  misc_feature (523)..(523): n is a, c, g, or t
ggatgagcaaacggaagagaaagagaagtgtacaggagggagagaatctgacgaaggcgttcgcgcggagtgccgccggaagacnacaggcttggacaggtcgccagtagcttatttcgcggcgaaaanaattccagaggtggcancggtcggctggcgtccctcttcagttctctggagccccagantcaaancgtgtacgtgcctgtgcctaaaaaaaanannaaaaaaaagaaaaggaatgaggaggaanaaannaaatcccagantgaaanaanaatttcgcaanaaaatgcnaaaaaantgaaagagaanaanaaaaaaaanaaagcagaaaaaaanttggaagaaagggaaagcgctctagcgagtgctgatttanaagaagaaantcancagaaaaaagggcagaaaaggaaaaantctnaaantggtgttaaagtagcagananaaaaanaattgatganacagaagaaaaagttgtnagtaaaanaaanaaaattcaaanaaaanaanaagaanagagattaaagaatgagagaaatgtgtttgttgggaatttgcctgttaaatgtaataagaagaagctgaagtcgttttttaaagagtatggacaaatagaatctgtacgatttcgttctctgattccagcagagggaaagctatccaaaaagttggcagaaataaaacgtaaaattcatcctgatcagaaaaatattaatgcctatgttgtgtttaaggaggagagtgctgccacgcaagcattgaaaagaaatggggcccagattgc

SEQ ID NO: 575789 - DNA, 241 bp, Homo sapiens
atttgttcctcccccgccccccccccttttttttggccatttttgctttatttatttcgaagttttttgttgggggaaacccgtttatgattggaaggctttttgatgaactgacctctttattattatggaacaaatcttttcatgtctagttaaattccctgttttgaagtccctttcatttgggattaggggtgcccctcgggcttttttttgattaaagttcccatgatatttttta

SEQ ID NO: 575790 - DNA, 233 bp, Homo sapiens
gttcaatagcaggaagagttcaagagctctatgtataccatagtaactctaggattttttggtttcgttttttaatggttaagttccaggcacatgtggaggatgtgcaggtttgttacttaggtagacatgtgctgtgatgttttgctgcacttatcaacctatcgcgtaggtattaagcccagcatgcattagccatttttcctgatgctattgaaacttctaaaactagg

SEQ ID NO: 575791 - DNA, 374 bp, Homo sapiens
  misc_feature (90)..(90): n is a, c, g, or t
gcggccgcctactactactaaattcgcggccgcgtcgacgacaagtgaagttttagggtcctcacagctatcagatatttaggtacatgngactagtttttactagatttattgcttccattctggcatgtacgtcgtggaatgtttaagcttccagtgttcattttaaggagcgctagagcctacgtaagtgacgacagctctgttgcgagcgaggtggggagagaaacacgaaacacaatgacagacctttcctgtttgagcaccgcctagttatgtttcagtctccagggtagtgcttgtgctttaccactgtctgacaatggctaacccaagctttagagcttacaattaaaaaaaaaaagtcgacgcgg

SEQ ID NO: 575792 - DNA, 369 bp, Homo sapiens
cctaaatgcattgctacttgtggagattagtttagtccctcaaaaaattttcccataatgtccggcactgtggctcatgcctgtaatcccagcaccttgggaggctgaggagggtggatcacctgaggtcaggagttcgagaccagcctagccaacacggtgaaatcgcatctctaccaaaagtacaaaattagctagtcgtggtggcgcaggcgtgtaatcccagctacctgggattacagtaatcctcctgctgaggcagagagatctcttgaacccgggaggtggaggttgcagtgagccgagattgagccattgcactccagcctgggcaacaagagcgaaactccatctcaaaaaaaaagtcga

SEQ ID NO: 575793 - DNA, 1289 bp, Homo sapiens
ggcatcttgacccgtaatgaacactgtgtgccctggagaagaactcgagatcagcggccatatcgtcaggcttacgagttgcccaggaactgtggcaaagaccttaagagagatgacgagcagacttcagggagcgtggagacaggcatttgaagacaagattcccaaaaggagattctctgagatgcaaaatgaaagacgagaacaggcactagcggactgaaaataatacattgcccagagaagcatcagtgaaacacaacgtctcttccactactttatacccacttcggacctattcataatcattacattctatgacagcttctggtctctatgctgatcgtagaattatgccaaaaggaaagcatagcgtacactgcacgaatggcgactcatactccaagcacggccatggagactgcaattccattcgcatcacgtgactacaatcatgaagttgaaaaaaccagacttctgaacggctccacgcgtacggctcaagttactcacgtatgccacgtccacccacaagccagctttctgactaactccggtcatgccacgcaagttatagaccgatccgctgaccactctcttgaacggactaccagcttaccagacgcgccaaccactaagacctcgggatctgtctcaacctgctccccattcatcgcccacatggaccgcccgagctatacaccagaacatgcattagtacgcaccattagcctcctcacccaacactattgcgacacctaacgacgctactccgcccatcgcatagcatcacacacataaacgctcacaacgtcctcgaacccccacaaacatgtcagaagcacctctgactgtcctatacagaggacacacgatcattcagaagacatggccacgtgcaaaaccgtgtacgttcatcgagaagctgtaacaccgggcctagcccgtgcccgcatacctaaacatgaggactcaaccagagccaccgcggactagtctacaggcgtcccacagccggcgcgcccgccccccccacgagccacaccaagaagagctgcagacagacccgccacaaacacgggggaacaaagaaagcaagcacggcgcacgggacacgagccggctagcgcggacctgcacggggcaaacgagacccgaggtgggcacagcgcggcggctgacaaacgcgacgggacacggaggccgcgacgacgcagcacgcggcgcgcacggcgcgggcagcgaagagcgagcaaggagcgaacccagccaccccataggccaagcgg

SEQ ID NO: 575794 - DNA, 1210 bp, Homo sapiens
ggactagaaaatctgagttttacagctcatactggttaagagtccgttttgaattagacaactagacgtaaaacacgtgtagtaatagctagaagcttaacatcgattaagactatccaagccaagtagctagtaatttgtttaagggcacaataaagatgattagctcagcttgaagagtaacaagtcaggtaacgatcttaacaaatgtctcatgactgtgaagaaaatggttgagaagatatccaataccttgagagatgtacaggtatcaacttcttcacatgataatatggcagtctagcagccggattgtattaatcggggaggaaacactgcgggtgtagttgacacggccattttatggtaaactctttgaaacatttggatagaagacagtctaaaacaaataatttcgtgacgttcgggaaggaagaatcgaactttgtatgaggaattcagatcacagtatgtgcttgacagttatcgtgagtgagttcatcgtaagatctcgtttttgccccatgacatataaaacagttacaggttggcccgttggggtagtgctagtaatggatagcatccatgctaactgtctaagctatcatagaaactgatggatcaactcccgcaattggcacgagggcagtggataagcaaactgatgacttgcactccaggtagccagggggaattgtcagggcagggcttcgttgaacaagacgtaatcctacattagtccgtacgagttcagtgcatctttcacaagtgccctgagaccagttcgggctctctttcaccaattcacctgtagtgtcattaatcatgtcctgaatagtgtcaactgttcattcgcaggtcgggtttgccctcattacggaaagtcaagccaccacatggtttcacacgggttgtgaacggctcgggttgcccttgggtgacgggacatcgttaagggctgtctaccatgttggtctcacccagtgcgcagtgcgacgaagagctggagctggacaaatgttcggcagcacacgagtccgtggctagtcaatatgaagtgtgtaccccaaaaatgggaaacacgtacgcgtgggcctgggtcataagacagcttgtgtacaaggaacgtttgattggagggacccctgggtacccgtggggatggtaaaagaacaacacagggggcgtcacagatctgcaacgtggtgtc

SEQ ID NO: 575795 - DNA, 622 bp, Homo sapiens
ggccggtacggccccgggtttgggcaacctcgattacgggcggcctccagccccgccagcagcgccccgtgcatgcagccgaactgagaccgagaaagccggaacatcatatgcagaaaacagacatgcaagatcagaagacaaataacgacagaaaaaccagagacacaacacaataaaaaaagaacgacacaacacagttaaaataaacacaacaaagaaggaaaaaaacaagaacaaaaaaacatacaacagacaaaaaaaccaagaaaaccaaagaatgacacaacagacgagcaccacacacaacaatcagaacaaaacacacacaaagaaagaacacatataccaaaaaacaccgaaacaggacaacaaaaaacaccaagctaacacaacacaaaacgcaatacatgaaaaaaaagacaaaaagaacaacaaaaaaaaccaaaaaaacacaacaaacggacacaacaagcatagagcccgacacaaaaagcaaaactgaaaacagacacacatacccaacagacaacaaacacacaccaaacaacacagcgaaacgaacaaacaaacagaaaagaagaaacaaacaaaacaaccaagaaacagaacaaaacaagac

SEQ ID NO: 575796 - DNA, 167 bp, Homo sapiens
aagggtttcttttcaattttgcattgctggtgccagatgaagaaatatgggtttagaaatggagtagcaggctgagcgcaggtggctcatgcttgtaatcccagcacattggtaggcagaggcgcgccgatcacttgaggtcagcagtttgaagccagcagtttgat

SEQ ID NO: 575797 - DNA, 324 bp, Homo sapiens
  misc_feature (5)..(5): n is a, c, g, or t
gctgntctagaggatcccaaaagccatttctcttaaactctaaaattacgtgggcttacacatgacttcaggttttttcccgttgctgtggtagaaaagtgttgagaaatgtaccttagctagttctgaaggaaaatattttttttttggagacagagtctctgtcacccaggctggcgtgcagtggcacgatcctggctcactgcaacctctgcctcccgggttcaagcaattctctgccccagcctcccgagtagctgggattacaggcacccgccaccacacccagctaattttttcatttttagcagaaatgggctttgg

SEQ ID NO: 575798 - DNA, 499 bp, Homo sapiens
  misc_feature (23)..(23): n is a, c, g, or t
  misc_feature (26)..(26): n is a, c, g, or t
actctgtcttaaaaaccaaaaanaangtcctttccccattggcaatgaaatcttgttttgtcataaatgaggtgactccattagtgtgggtcagttcctggctggtgtgtctattatgaagccagtgccacactgtcttaactagctttatgataggactcactctgtgataagttcttcagctttgttcttttccaagatttccttttcaggccgggcgtggtggcttaagcctgtaataccagcactttcggagacctaggagggaggatcgcttgagtctaggagtttgagaccagcataggcaacatgatgaaacccctctttagaaaaaaaatacaaaaatcagctgggtgtggtggtgcacgcctgcaatcccagctactctcctatccagctgaggcaggagaattgcttgaaccccagaggcggaggctgcagtgagccaagatcatgccactgtactcaagcctgggtgacagagagggatcctgtctca

SEQ ID NO: 575799 - DNA, 86 bp, Homo sapiens
ctgagaacttcaggctcctgggcaacgtgctgggctgtgtgctggcccatcactttggcaaagaattcaccccaccagtgcaggct

SEQ ID NO: 575800 - DNA, 934 bp, Homo sapiens
  misc_feature (2)..(2): n is a, c, g, or t
  misc_feature (366)..(366): n is a, c, g, or t
  misc_feature (432)..(432): n is a, c, g, or t
  misc_feature (460)..(460): n is a, c, g, or t
  misc_feature (463)..(465): n is a, c, g, or t
  misc_feature (469)..(469): n is a, c, g, or t
  misc_feature (483)..(483): n is a, c, g, or t
  misc_feature (485)..(489): n is a, c, g, or t
  misc_feature (498)..(498): n is a, c, g, or t
  misc_feature (501)..(503): n is a, c, g, or t
  misc_feature (506)..(506): n is a, c, g, or t
  misc_feature (522)..(524): n is a, c, g, or t
  misc_feature (533)..(534): n is a, c, g, or t
  misc_feature (538)..(539): n is a, c, g, or t
  misc_feature (542)..(543): n is a, c, g, or t
  misc_feature (545)..(545): n is a, c, g, or t
  misc_feature (583)..(583): n is a, c, g, or t
  misc_feature (588)..(588): n is a, c, g, or t
  misc_feature (590)..(592): n is a, c, g, or t
  misc_feature (919)..(919): n is a, c, g, or t
tnatatatatgtcttgtgtgcgtgcccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatntttaagtcatattaaactcttaagtcaaattaagcagacccggcgttggcagtgtagccataactntctgatgttagaaaaaacaaaaatggcnacnnnaaancaaaccacgccaangnnnnnaaacacccnccnnnaanaaaaaaaaaaaacacnnnaacaacacnnatgnnaanngnccagaatctcagatgtttgttgtgtggattttgtttanttgtngnnnttttttttttttttcagtgaatgtctggcacattgcaatcctccaacatgtggttatctttgttgtattggcataatccagtgacttgtacattcagccatagcatttgagcaagttttatcagcaagcaatattttcagttaataaggtttccaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtcccctttgttgttgtcaantgtggtttattttca

SEQ ID NO: 575801 - DNA, 179 bp, Homo sapiens
  misc_feature (154)..(154): n is a, c, g, or t
aagcatgctttgataggtctctaggtgataggctggagtgcggcatcaccactgctttactggaatatgtgatcactaatagcagaactgtttgcttccattcttgagatctgactgtatgttcagtttcattcctcgagaacatatccagtanaaatgattcctcaggctccacagat

SEQ ID NO: 575802 - DNA, 260 bp, Homo sapiens
ttctgtattggaattaatgtgctttgttggggtttaattttgggattggttttgggttttgtttttagttgttttaatggtaagtattagggcctttgtagattttacagtaaaatatggaattgtcccttcaatcgagttaatatgtgcccccatgttttccttaaatactgctagcccttctcttcaagattatgagtggatattatttttaccttatgttaaacagtaatatgctttagacaataatataaataata

SEQ ID NO: 575803 - DNA, 895 bp, Homo sapiens
  misc_feature (2)..(2): n is a, c, g, or t
  misc_feature (366)..(366): n is a, c, g, or t
  misc_feature (432)..(432): n is a, c, g, or t
  misc_feature (460)..(460): n is a, c, g, or t
  misc_feature (463)..(465): n is a, c, g, or t
  misc_feature (469)..(469): n is a, c, g, or t
  misc_feature (483)..(483): n is a, c, g, or t
  misc_feature (485)..(489): n is a, c, g, or t
  misc_feature (498)..(498): n is a, c, g, or t
  misc_feature (501)..(503): n is a, c, g, or t
  misc_feature (506)..(506): n is a, c, g, or t
  misc_feature (522)..(524): n is a, c, g, or t
  misc_feature (533)..(534): n is a, c, g, or t
  misc_feature (538)..(539): n is a, c, g, or t
  misc_feature (542)..(543): n is a, c, g, or t
  misc_feature (545)..(545): n is a, c, g, or t
  misc_feature (583)..(583): n is a, c, g, or t
  misc_feature (588)..(588): n is a, c, g, or t
  misc_feature (590)..(592): n is a, c, g, or t
tnatatatatgtcttgtgtgcgtgcccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatntttaagtcatattaaactcttaagtcaaattaagcagacccggcgttggcagtgtagccataactntctgatgttagaaaaaacaaaaatggcnacnnnaaancaaaccacgccaangnnnnnaaacacccnccnnnaanaaaaaaaaaaaacacnnnaacaacacnnatgnnaanngnccagaatctcagatgtttgttgtgtggattttgtttanttgtngnnnttttttttttttttcagtgaatgtctggcacattgcaatcctccaacatgtggttatctttgttgtattggcataatccagtgacttgtacattcagccatagcatttgagcaagttttatcagcaagcaatattttcagttaataaggtttccaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgc

SEQ ID NO: 575804 - DNA, 145 bp, Homo sapiens
  misc_feature (15)..(15): n is a, c, g, or t
ttgggtgcatgcatntggacatcgagcatgagaacaacaacgctttgaggagtatgagtggtgtggacagaagcggatacgggcaccactctcctggaaagctggcttcctgaggctctggcttcatcatgtgcagcgcgcaaaa

SEQ ID NO: 575805 - DNA, 426 bp, Homo sapiens
  misc_feature (281)..(281): n is a, c, g, or t
  misc_feature (314)..(314): n is a, c, g, or t
cagagtctcacatctgttgcccaggctggagtgcagtggtgcgatcacagctcaccgcaacctctgcctcttgggttcaagtgattcttgcgcctcagcctctccagtagctgggattacagaacttggctaagattaaagagtggtgcacttcagcctgggcgatcagagtgactctgtcaaaaaggaaaggcaaaaaccggaccctgggagctctgtgggccctgattgcaggcccctccctgtgtgatgagggatgagtcagcttggggagccacttngccagcctgcatgcctgggtcatcaggaggttnagaaaagccttgaaagttgttgaagcactgaggcagattacaagtgtttgttaatttttgttaggaatttaacttttcccctttgggccctttattctccaaagttggggat

SEQ ID NO: 575806 - DNA, 323 bp, Homo sapiens
cgatatgacagatggctagtgttgctaggtcatgaaaagactctgaaaatagtttaccttcatagctaatcgctgctgtagcattattaaccaatggtcagatcctgcattaagaacaagagactaaaatcacaaatagtgtcttctttttaaatcagagatgctggacttcccaactttgagtcaggcagatatatacatgtgatggtaggtgcttcgaaaacgtttactcatgcacagagcttgatatttgctagagatagctgaacctattttaagatgactgtatgcccattttgagtttgaaccggcggtgcggcgtg

SEQ ID NO: 575807 - DNA, 385 bp, Homo sapiens
atgagtctcaagctgccgcccgtttgggtgtcacagtctgagtcatcgcatgagacaggcacggcctttacctgtgggcaacctcctcataaggtagttccgcttgcccaggttcacagcttgaacaccgccaccgtttccgccagtgcggcggtctggtgcttgaggctctcggccgccgcggcagactcttcgaccagggccgcgttctgctgtgtcacctgatcgagctggttcaccgcgtcaccgatctgtccgatgccccggctctgctcgtcactggcactggtgatctcttcgatcaagccggccaccttctgcacctgggccaccacgtcatccatggtcttgtctgccgaattgaccaatcggagttgtttttcct

SEQ ID NO: 575808 - DNA, 398 bp, Homo sapiens
  misc_feature (87)..(87): n is a, c, g, or t
  misc_feature (130)..(130): n is a, c, g, or t
  misc_feature (145)..(145): n is a, c, g, or t
  misc_feature (189)..(189): n is a, c, g, or t
  misc_feature (238)..(239): n is a, c, g, or t
  misc_feature (266)..(266): n is a, c, g, or t
  misc_feature (290)..(290): n is a, c, g, or t
  misc_feature (299)..(299): n is a, c, g, or t
  misc_feature (322)..(322): n is a, c, g, or t
  misc_feature (351)..(351): n is a, c, g, or t
gtggtcatggaggcgctgccgctgctagccgcgacaactccggaccacggccgcaccgaaggctgcttctgctgccgctactgctgntcctgtgccggctggagctgtgcagggctgggagacagagganaggcccggactcgcnaagaggagtgccacttctacgcgggtggacaaagtgtacccggnagaggcatccgggtatcggtcgccgaccacttcctgcacctaacaaagnnaagatttccaagccagcgcctactggnaaggaacagctgtgatcgatgganaaattaagnacttaagttactgatatcgtggnaaatcttggtttcttcttctacccttganttacatttggtgtccactttatcgcttttggcacagacttgagttag

SEQ ID NO: 575809 - DNA, 704 bp, Homo sapiens
  misc_feature (47)..(47): n is a, c, g, or t
  misc_feature (134)..(134): n is a, c, g, or t
  misc_feature (171)..(172): n is a, c, g, or t
  misc_feature (202)..(202): n is a, c, g, or t
  misc_feature (234)..(234): n is a, c, g, or t
  misc_feature (264)..(264): n is a, c, g, or t
  misc_feature (270)..(270): n is a, c, g, or t
  misc_feature (305)..(305): n is a, c, g, or t
  misc_feature (330)..(330): n is a, c, g, or t
  misc_feature (342)..(342): n is a, c, g, or t
  misc_feature (355)..(355): n is a, c, g, or t
  misc_feature (369)..(369): n is a, c, g, or t
  misc_feature (384)..(384): n is a, c, g, or t
  misc_feature (388)..(388): n is a, c, g, or t
  misc_feature (404)..(404): n is a, c, g, or t
  misc_feature (411)..(411): n is a, c, g, or t
  misc_feature (429)..(429): n is a, c, g, or t
tcccttttggagacggggtcttactctggtacccaggcgggagtgcnggggtacaatctgggctcactgaacctctgcctccggggcccaagggatccttccacctcagcctcccaagtagctgggactatagngtgcttgccaccatgccgggtaatctttggcagcganngggatttggccagtggcccaggctgatctngaactccggggctcaagcaatcctccctcttnagcctcccaaaattcggggattacagggcntaagcnatggtgcccatccaaagttttatttattaattttnggagagggagtctcgtaaagttacntttaaaaaaaangttctatttcccngtatgggtatctcnttaaataaaataaantatncctatggtaagtgatntgagaantttttaaccagctttatntaaaattaaaagagagacgcttgtagacatcacgtattgtgtaactgtgtctcgggttgtgtgaccaagggcaggttttttttcacccatttttataattaatcttctatcctgattaacatcagggccggcatatttaagggtacaactcactctcttgtcggaacctttccagacatcaggggggaatcccaagaacacgggtacctctgaaacctgtgacggtggatataaaagggtataaagaaatgggaaacgtccaggagagggtcacc

SEQ ID NO: 575810 - DNA, 1304 bp, Homo sapiens
  misc_feature (926)..(926): n is a, c, g, or t
  misc_feature (1089)..(1089): n is a, c, g, or t
  misc_feature (1095)..(1095): n is a, c, g, or t
  misc_feature (1117)..(1117): n is a, c, g, or t
  misc_feature (1124)..(1124): n is a, c, g, or t
  misc_feature (1130)..(1130): n is a, c, g, or t
  misc_feature (1137)..(1137): n is a, c, g, or t
cacgcgtcgagaaacttagattttttttttaactattgtaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtctttttttttttttttttggaaatggagtttggttgcccaggctggagttgagtggcacagtctcggctcacgtgcaacctccacctccgtgggtttcaagcagttctcggtgccgcagcctcccaagttagcgtgggactacgggcttgcgccaccacgccaggctaatttgggtattttaagtagagagggggttcccaccatgttctcaaactccgtgacctcgaggcgatccacccacctcagcgtcccaaagtgcgggggattataggcgtgagccaccgaaccgggcctatgaggtggtcttttaattaggaaccaattctattggaaaggagagtttgactgaagttgggcccacaggattgtgagctgggcagtgccttcatgaaggcttgccaccttgggacgccccagtttactgggggtgtcttgcggagtgcaagaaggctttctgggcagctgcctggtttgggccagacctggctcccttcccgcnggccaaccccttagtccccttcctgtctccatttgcattcaggggtggctgctgtcctgagaactttagacctgggacgcagagatggagtcccatggattttgggggggcattattctaaactttcgtatccaagttagtccccctttttccactgtggttngccgtnctaagcagttactgatgcctgntgtgaanagctgntcacagnaggggggggcggcctggactggccctgtataggctgcgttcgacggtcttggaattcttggccgacacaattcgtcctgcgtcagattttttgctcccttggtttaattgaacccgtggtagatctccttgtgtcttggactgtctttacatggcccgtgcccgtca

SEQ ID NO: 575811 - DNA, 93 bp, Homo sapiens
tcaaaaaagaaaaaaacagagaggcagaaagaatgtagtagactactatagggcgctaggcggtcttttgtttagccgaacgaccgagcgcag

SEQ ID NO: 575812 - DNA, 141 bp, Homo sapiens
ttcgacggaagcagtgcccgtctggtgtgtgttctatacatcctcaccagctggagcttcttctcctctgtcacgtattcggaattcagtagtgcccacattgttggtttctggtccactagtcccgttcccagtgtgatc

SEQ ID NO: 575813 - DNA, 184 bp, Homo sapiens
gtccatcagcttgactattctcaaatagtgaataatcctaaaatcatctctatcaagtgtttattttaggtggtgtttttgttcttctgttttaaaggaagaattttaaaatgagatactcattttctaaacattttccaaaaaaataataataactaagtcaccctgatgggagaagactgcg

SEQ ID NO: 575814 - DNA, 364 bp, Homo sapiens
tgagcaatctgaccagaaaagaacaactcgtagtacacagctcagtgaatttaggcaacgggagcgcagccctgtgacaaacacatagctccccggaagcccctctaatgtccctccctagtcattgacacacatacccattcctgagctcacagctgtcctcacctctatcaccagagattcattttgctcgtttttaggcagcaagttcctacaatatacactcctgtgtctggctgtcttgtaatagtttaaaattaatcaatatctttactttctccatattgcatccctctttaacttactgtaactccaattacagccctcttgatttgtatgttattattgtcatgtattttaattc

SEQ ID NO: 575815 - DNA, 304 bp, Homo sapiens
gggccctggttcccccttgtccccccttttttgggggcctgcaactttttgttttttattgggtggctttttgagtattttaaccccagtcctgggtccccctcctttttccttttatgtccccccttttcggggggggggcttaggctaagggggaaatgggtttttttagggcttcccccttttccccctcccggtttccaaaaacccagctttttaaaaacagggggtgggcatttccctgcccctataaagggggcctggggcttttttgggggtgggggggaataacccctgtttttta

SEQ ID NO: 575816 - DNA, 1039 bp, Homo sapiens
gagcgggggtgcagctgagcgaactgggagcagcggcgactcgccaggggctagggcgccatggtggcagtgtgggctccgtgctgcgcggggctcccccgtgctgccagcagtgctagtgctgccctgcctgcctctgtgcctgcctcagaccatccctgcgcctgcccgcattgttgtgaactgatgtgagccaggactgcgtgcctcggctggggcccggtgccgaacggctgcggacacctgggcgccgatggagccgatgctgcctgccgcactccggcatggatcagtgcgtgacggatggaggcgcgagcttggagaaggtgctggaacaaagttcatcgaggctactggggcagacatgtgcgaagcggcgtgacctgcgaggaagccgtcactcgaagctaacaccgtgacgtgatactcacaggtcacggcaggaatcccctgcaggaaggccaatcgtggcccacagcacatgcttgtacactctatccacggggggaacaacattataccaactaatgcgtctttcggaaccaaccagaggtggccctttggtgacacgacacgaacacgtcacaccactgggaatttacccattgcgttgttcccaaaacaacaacacttttgggggacgccttcgccggaaaccgtccacacgtagaagcaaggaaagccagttctgcaaaccacgcacccacgatgggtgttacctacacgtggcggtttttggtggcgcagcaacaccaatggcaccccaacacttttggcaagcttcacaccgccgtcgcacatttgtcccgacgccgattgatgatgtaaccagagcaaagggacaagctcttttgggggggaaaacacaagcgcgcttccattttgctcccacacgattctattgcggggagccagacgctttgttgtggcggttccccgttatgttcgccacccaaacttctcacggcgcacggtcaatttggacgcaacaacgtgatgtgaatgtcacagcgcttggtggttccgcgtggtggtaaca

SEQ ID NO: 575817 - DNA, 546 bp, Homo sapiens
gagttagaacaggaatacccattcttttcccattacgaatatacgcatcccaaacatgcggatcgaatgccattgcctttttccacgtttcatttgcgtatacatcaaacaacgagccaacttcacggaaaaagcctgaatcaattaaatcttgtgctaacaactggtcacttaccactacaaaatctggtatttcctttccggaagataaggcaagtcgcaatttcgtttcaaaagcaccatttacatccgcaacgtaccaaattgtcttaatttgaattcccaactttttataagcccatctagtagcgacattatttgcaatcgtttccccgttttaaaatgataaattcggattaacagcacgaacagtactgatcgtaacaggaggatcatacatgtccttgtatccttctaatattgattttcttttaaatgaaagactttctttaatagaagaaccagataaacttgaaaatataaacataacgataattattaataccgaccgattcaacagtattctcatgaggtgatctctgcacg

SEQ ID NO: 575818 - DNA, 320 bp, Homo sapiens
tcctcagcagacgcagtcctggcatagagtgcatagaagtgtctgcaccaaagcccatggcttttcatgcacggagacaggctctggatgtgcaggcttgccatcccctgccccaatcctccctgagagctcctgcctcagtgcccggggctggtgagggagaagcctgtctgcgcctgcctaattccagctcctccaggaagcaagggcttgtagtcagagctgcagggttggccacgcggtggggcggagtccgccaggattagagagcctggccctaatccggcccgctgggttaaacaaggatcagagcggcgtct

SEQ ID NO: 575819 - DNA, 296 bp, Homo sapiens
actgaatcagctcctgagtagctgggaatacaggtgcgtgccacatgcctggataatttttgtattttatagtagagatggggtttcatcgtgttaaccaggatggtctgaatctcctgacctggtgatctacccacctcagcctccctagttttttaccagataatttctatctctttatcattatcttctatatggtaagacattgttcttctactttcttttatttctttacacatgctttcttttagtattttgaacatatttcaaatagctgatttaaagtctctgtttag

SEQ ID NO: 575820 - DNA, 522 bp, Homo sapiens
  misc_feature (1)..(1): n is a, c, g, or t
  misc_feature (29)..(29): n is a, c, g, or t
  misc_feature (204)..(205): n is a, c, g, or t
  misc_feature (249)..(249): n is a, c, g, or t
  misc_feature (262)..(263): n is a, c, g, or t
  misc_feature (278)..(278): n is a, c, g, or t
  misc_feature (283)..(283): n is a, c, g, or t
  misc_feature (300)..(300): n is a, c, g, or t
  misc_feature (313)..(313): n is a, c, g, or t
  misc_feature (329)..(329): n is a, c, g, or t
  misc_feature (338)..(339): n is a, c, g, or t
  misc_feature (350)..(350): n is a, c, g, or t
  misc_feature (353)..(353): n is a, c, g, or t
  misc_feature (357)..(357): n is a, c, g, or t
  misc_feature (363)..(363): n is a, c, g, or t
  misc_feature (368)..(368): n is a, c, g, or t
  misc_feature (384)..(384): n is a, c, g, or t
  misc_feature (395)..(395): n is a, c, g, or t
  misc_feature (411)..(411): n is a, c, g, or t
  misc_feature (427)..(427): n is a, c, g, or t
  misc_feature (434)..(434): n is a, c, g, or t
  misc_feature (468)..(469): n is a, c, g, or t
  misc_feature (474)..(474): n is a, c, g, or t
  misc_feature (484)..(484): n is a, c, g, or t
naaactagaaggaaccagcaatcattccnactgtcctggccaaggtacacctcagtactccccttcccaaactgaagtggtatgaggctagctctttccaaaagcattcaagtttggcttctgatgtgactcagaatttaggaaccagatgctagatcaaataagctctgaaaatctgaggaacattgtaggaaaggtttgttnngcatctcttaagtgccatgatgagcataacagccggccgtggtngtcgcgcctgtgnncccagcactttgggnggccngggtgggaggatgacanggtcgggagttcnggaccagcctggccancatgctganncctcacctctnctnaaantgcaanaattngctgggcatggtggcncatgcctgtgntcccggctgcttgggnggctgaggcaggagantcgcttnggccggggggcggaggttgcagtgagccgggacnntgccngtgcactccngcctcggtgacaggcaaggctccgtctcaataattaaa

SEQ ID NO: 575821 - DNA, 280 bp, Homo sapiens
cttttatgtacctggtaacctagggggggccttgaactaatgtaaggaagccaaggagtgcagatctagatagcagagaagtacgtctcatactaaaacattgcaactactgttagcgtccaacccatgaagctgaaaccgatggtgtatctatgactgactacgattagtatatatatgaacagactaaaacaaatgtggcaagctaggttggctgtgctgtctcagtgtgacatggacagaatccagataacaccctctgaagaccttggacctacgt

SEQ ID NO: 575822 - DNA, 107 bp, Homo sapiens
aagtgcgtgttgcatcgtaagtattggtgccgtcagcacctatcacgcctggagcgccatgggcgctgatatacagggtgggtaattttccgtccggtcgttcttgc

SEQ ID NO: 575823 - DNA, 680 bp, Homo sapiens
cacaggaaggaaccaacctgttaaaccactaattccgcatataagaagaaggttttccaggaattccaaaaaaggtagaagtgagggagggtcccacttggcctcctgggtccaagaggggcctcaaaaacttgtgaaactcactcatttcctgaatgggacttaccttgggtcctggatgaataaattgaaagatatgtctttaaaacattcctaacatcagaatttgcgcttgtgttttcttccccaagaaagctataacaagcgaaaattttgttgtaagcttccctgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgtactgtcactctgcttaataaagccta

SEQ ID NO: 575824 - DNA, 326 bp, Homo sapiens
cgagggccccactgatcgccccacccgatcacagccttcgcgattaagcgttattccgatcagacggactgcgatatcccttggcaacagcatcgctgcggcggcgttcatgcccgcagcggacgtagcgttttgagggagagcaggacatggacgcgatcaccgaaggcagcccacttagcgacccgaacaagaagcccgcagcgctgcgcagcctgctgggccgcacctcgcgcgactggtggcccgaggcgctgtcggtcgacatccttcaccagaagggcgtcagcggcaatcccgatgggcgacgacttcgactatcgctc

SEQ ID NO: 575825 - DNA, 1369 bp, Homo sapiens
  misc_feature (254)..(254): n is a, c, g, or t
gacccttctcgcctatgcgccaacgacatggtgcttcagactcttgcgtggcacgagttcgaggctggtggtggcctcatgtgcatcacattccggagcacgtcaatgccgaagcagcttggtcagcgactcgtgagaatgctctttgcgactcagaaccagtggctctagggtcagagtagggaacctatggcgcttccaagtgaggcgatgaccagggtcgcattgctcatttttgccatagattgctagtngcctagggcctcaacatagcaatgtgtacgattcccttgcgagatggtattaactcctgactaccaatggtaggcacccaccacgaagtaaatgtcatcgcttcgcgggatccgagatgtccctagcgcacaacgacaagggtgcccaagaaatctagtcttaatttgagctttatacattttgcgaggcgagagacccacctgacagggaaatgaggttgccccatccgtgaaagtgaactctgtaagccctcagagaagaggtacatcccgggccatccatgtccacccagaggggaattgcagccgaagggacttctctatggcatgcgggctattcttaaatagcccttttgatggcaaatgtagccaggtggtgacagagtcccatggcagggccacactaagcaaagtaagattcaccaagttaaattgtgatgagctttaataacgagaagcaggcgccatatgcccaccaaagaacggcggcaaggaacttgcgttacctcttgagaacaccatgggccttatccgtaagcccccagaaaaaagcaaagagcaagccccttggaggttaagccttgaagagggagtttagagcttagtgttgtggaactgtggggcttgagcccccttgtggatttgactttcggtgagtttgagccccattgggcaatttgcgccctttggccgtttgcgctatttgggccgtataaaggaattgcccataacctcgcagcgggctagagaggaaaaaaccgaaatttcagaacccctggtgtctcggctctttaaagggtaaaatcagaatgcgcctggtggcccttcacacatataggagccccaagaaggcataatatgtggtattaacacgcccttatgtgcgcggcaatatggcgaaacggcagctgcccccgcagcgagatagttgtggcccaaaagcgaaaaaaaggagctggaccggcatgacgccaattagtgcttttccccatagagtatatccggacattcgcttatagcacaaggaaggcgcttaatatagagaaaaggcgcacttcgaaaaatgtccccatcaagcaattctacgtgcgcaacttcgtatggtttccccctag

SEQ ID NO: 575826 - DNA, 210 bp, Homo sapiens
taacacgaaatgacatcagatgtaccatcactgggtccatgcctttgcctctggaacactctggacctggaattcaaggtggaggagccatagtccagagagactattaagcggcgaccagtgtctggattaagactgatgatggacgaagggaacagtaaactttttgagagtgtgatgactatcagattgtctaacgaataagtgagc

SEQ ID NO: 575827 - DNA, 229 bp, Homo sapiens
agtacgcgatcagcgcgaccaccagcaccagggtatagatgcccagcccggcgcgtccgccgtcgcccaggatcgcgaaggtgccgataccgatcagcagcaccagcgagaaggcccaggcgatgcgcgccttcaggatcagcccgagcgcgatgatatgcaggcccacgcccagcaccagccgcgggatctccagcaggccgaccacctgaatcacgtcttgccagtt

SEQ ID NO: 575828 - DNA, 490 bp, Homo sapiens
accccacccgatgagctggccttttacagtagttgctggaggagtcggtcttcagaataatgcagtccttcagcacctcccagagctgaaaaacccaactgtgagtctcatgtgtcacacacagacccaaagttccaggaagctatcaggtcacacaagaaatagcaaagcacctcaaaaattaagaaataaccaccaaagcgcgggaacaattgtgactgctgcaagagcttacattctaggccctacttcctgtatgtgagagcattttcaaacaaaattactccccaaacaaaaactcgtcaacaatcgaacctcttattgaggtcatccaccacagaccatagcagaaatcgtggtgttaagtgagacagatcatagacaggaaagaggagaaaacaggaggccctctggtttcggcttccccagggtgtccgcccttctccacctggtcaccataatccgttggctggacaccgccgaccgcgat

SEQ ID NO: 575829 - DNA, 571 bp, Homo sapiens
  misc_feature (25)..(25): n is a, c, g, or t
  misc_feature (87)..(87): n is a, c, g, or t
  misc_feature (89)..(89): n is a, c, g, or t
  misc_feature (135)..(135): n is a, c, g, or t
  misc_feature (155)..(155): n is a, c, g, or t
  misc_feature (158)..(158): n is a, c, g, or t
  misc_feature (168)..(168): n is a, c, g, or t
  misc_feature (205)..(205): n is a, c, g, or t
  misc_feature (241)..(241): n is a, c, g, or t
  misc_feature (247)..(247): n is a, c, g, or t
  misc_feature (343)..(343): n is a, c, g, or t
  misc_feature (348)..(348): n is a, c, g, or t
  misc_feature (364)..(364): n is a, c, g, or t
  misc_feature (414)..(414): n is a, c, g, or t
  misc_feature (482)..(482): n is a, c, g, or t
  misc_feature (486)..(486): n is a, c, g, or t
  misc_feature (501)..(501): n is a, c, g, or t
  misc_feature (532)..(532): n is a, c, g, or t
gggggggggggcccacatcagggcngggggccacatggggagggacagtcctgccccctgcagcccggaccccaggggggggtcttngngatgggggagggctgctgtcccgaaattccacagcccgccggagcntccttgagcgggggaaaatnagnggcccattgngctcccggggttcgtcaaaggtggtctcaaaggtccncctggttgtgggtgattggtaattcttgttggtgtnaatttnttccaagctgaactccttcttgttcaacctgattggtcgaggcagtcccattggtgtaaggtttagctgaggacgggctggtgttctgcgtattcngaatngggaaacctttcccanggtcttggtctcaggttctgaaagcacctggtcctttgaggcccttggcnccttccctttggttgaacccaacctgggttctgctggttcggagaaggaagtggatgccgtggacgancaanaagtgggggagaggnaggggggggggcccactcctccgaggagggnaagacctcttttccggagaacagggaccgaagggggtgg

SEQ ID NO: 575830 - DNA, 328 bp, Homo sapiens
gctcgacaagtgaccgggagaatggaactaagttgtgaaacacttcaggatataatccagttgttcctttccatatttagtgcctccattaggagctcttgtaaggcaggcctagtggtgacaaaatctctcagcatttgcttgtctgtaaaggattttatttctccttcgcttatgaaggttagtttggctgcatatgaaattctgggttgaaaattcttttctttaagaatgttgtatattggctcccactctattctggcttgtagggtttctgcagagagatccgctgttagtctgatgggtttccctttgtgggtaacctgac

SEQ ID NO: 575831 - DNA, 676 bp, Homo sapiens
tattaaggtagaaaatgaagacgagttaggaaggctgatgtgacagagtagaggacacttaaatctgcgcatctacgaagaagagtttgatgagaattagtcgtaagaacaacaataagaaagaacgatctcgcccttttgagccctcactattgtcaaggtcttctggaactcaggcactgggggcctgggtttcaagcaagggcagggcattgttgaaaatgggaatttggccgggcacagtggctcatgcctgtaatcccagcactttgggaggccaaggcggatggatcacctgaggtcaggagtttgagaccagcctggccaatatggtgaaaccccgtctctactaaaaatacaaaaattagctgggcgtggtgactcagcatgtctgtaaacccagctactcgagaggctgaggcaggagaatcacttcatcccgggagacggaggttgcagtgagctgagattgcgccactgcacttcagcctgggcgaacagtagcgagaacctctggttcctcaaaaaaagaagacacctaaaaaacacaacaggtgcgccagcaaaaagcggggccaccttgtggggaacgatattcccccgagaagggttacaggtccccaaagaggcccggaacccacaggggtctacgggagagcaggaccaacaaccacag

SEQ ID NO: 575832 - DNA, 112 bp, Homo sapiens
accacaggtagccacccagatgaattactactagctcacagcaatataaaaacttttattgagttgctttctagtttgctgacaagcctcattccctctgatggacttgtca

SEQ ID NO: 575833 - DNA, 974 bp, Homo sapiens
gaccggcgaacagtaggtgtgcgccctgagagcgccaggtgggtggagtatcttgcgtaggaagaagtcattgtgggaatctggcctgcaaatgccgcaaagtggtcgagaagaaactgggttttacactacttcacaggtcgactggttctgcatatgctgacagtggagagatcatgcatgtcgatttatatggagtgagttgataagaagtcctgctcagtgtgggtgtgccagaagtaagaaattgaggggcatcgtggtgctctggccctcgtgattgtcacgaagagactcacggtgcaatgcatctgggaagcctgttgtgcatgcgagagcctaatataaggtgagccccaaggatggattctacagggcctggcttgtgaccctaggtgtgccgaaggccgaggagacgagtcgaacaactgatgcaataatgtagccgtggggattctgtctcagagctacgaagtctgttggcgagcatagtaaggtcagcacatactcatgtcataagaattggggatatgcgggtccacacgctttcttctggtagactgcatgaggctgatagaaaaaatttttgggccaaaagaagcatggtggtcagtaaaaacggtatgagagtgaatcgacgtgtctgatagcatagctaacttggtacccccggttcaatgagtggcatgcgtccatgagtgaagtatcctaagagtccacgaattcgtcgtggcggtatatgcaagagtgctaactcattcaagttctattatagtgagatctagattttggatctccttagttggggattatggaccacacggggtctctagtgcgtggcagagcccaaaatagaggcgatcacacgcgggaaggggggcacgccggagagacccatttgccgggtaagaccgcgacagaatcgcgggaaaaaacgtttgcacaacggtctcgaaaggcacccaaggccaaaa

SEQ ID NO: 575834 - DNA, 752 bp, Homo sapiens
gcgcggaagtcaggccagtttctacgcgcaggcttaaggaggcttcgggctcctgggatttctgtccgcgactcctggccctcgtccttcgcggccagagcaggttcgcgaactcctcagagccttctgctcccggccgccgcatttccgccgggggcgagagcacccaggttcaaatatgacgccgtgtttggaactaacctcaggttggtggaaccagtgggaccagctatgcttggcagtgcaagatacagactaatcgacaatcccagtgaaggatattgaagtaacatcatctcctgcatgatagcattaggtatgtctgtcttttagcccaccaaccttgccggggaactttcttgattgcaggatcatgggctcactgcatgttcgctgctgtggaagttcgaagaccagtggacagacctattccaaaagcccgagcagatgcacagctgggcctgtgcttgatgtctgctggagtgacgatgggagccaagtgttacgggatcgtgtgcataacagtgccacaaatgtgggatctcagcagtaaccaatgcgataacagatcgcacagcatgatgctcctgttaaaaccatccattggctcaaagctccaaactacagctgtgtgatgactgggagctggcgataagaccttcaacgtcaccgggatactcgatcgtcgagatcctcatgcatcggtgtgcaactccctgcacagtgttactagtgctgaccgtgatataccc

SEQ ID NO: 575835 - DNA, 364 bp, Homo sapiens
tccccctaccaggaccagctaccggctcctgctgcgtgtctgttgcctctcggccttctgaccctcctccaggccatcccgtgtgtcatcattgccattcgcctgtgttttggtgtttgaagttggaatcttcagttactttcaagaacagccacaaaaatgtgttactatctagatttttgagtgtctatcaatcaggagtcttctgtgacagtcgctgttttctctagaacagtatccatacccaggatgcatcccaaatgtgttctcatcaggtgattcttggttgttgcataagttcatgtgtaatgtgggtgagtttctgttttgaatgtggtcattatatgttatttgtgaaacttta

SEQ ID NO: 575836 - DNA, 511 bp, Homo sapiens
  misc_feature (142)..(142): n is a, c, g, or t
  misc_feature (456)..(456): n is a, c, g, or t
tttattatttatttttacacagtgaaaccatttactgaatatcattgttgggtacataaaacactctaacacacgagagggggaaatgtgtgttacaacattcataaatagtcatacacttcaccagcccactctggcgganatggtaacacatattgtggcgtttaccaggagaaaacacctataaaagcagaggaggccccggaacgaagcggtctgtcgaccgaccactgcgaacaaccgcgagcggaaggggggagcataccatagaccaagcgggctccgcgccccatcacgcgggaagtgacggcccaccggaggcatacgagtgttacactagcccgcacacaccggtggctctccgccacacaacacagctgtgttacacaatgatgcagaccaaccgactgtcgggcctcgaaagccccacactctatcatgtgtgtaggcgaaccnctcaccacacagccgcacacgagcaggactagccgaagacagcctcatcaacaac

SEQ ID NO: 575837 - DNA, 477 bp, Homo sapiens
tcgtttaaaacattatctcattccgatcacggctcactcttcagcacgtgggtttctccatgtgctgcagttcccaggccccgggggattttccattatctttccacagctgctctgtgctccattcccagctgtcagagctcctctctcaaccctgtggtgtggagtaggggccgggcagtggctgggtgcatttccacatagctgaccattaattaggtcagtcttgcttatgggttgttcaaatcttctttctctccagtgatttgttttaccagttatggggcgaggtgtcttgaaatctctagctgttccctggagtagtgtctgtttctcctccagttctctggattttgctgaagcggggcgtcatcagggtgtgagatttgaggtctggccggccacctcgctccggttagtgcaagcactggtgtcttttcttttgattattttggattaaacactttttttattaaa

SEQ ID NO: 575838 - DNA, 328 bp, Homo sapiens
  misc_feature (39)..(39): n is a, c, g, or t
  misc_feature (62)..(62): n is a, c, g, or t
ccaccgtggactaggcatgggacaaggcactgcaagaantagaagcttgtggccgggtgcantggctcatgcctgtaatccaagcagagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcg

SEQ ID NO: 575839 - DNA, 133 bp, Homo sapiens
cgtaatcgtaacagatctcagctgtgctcacgatcaggaggtggtatgcgaggtctgatgtaccagtcaaacgagaggtggctttgagggtagcattgaattcttcctagatgccaaagaacggggatgtcac

SEQ ID NO: 575840 - DNA, 137 bp, Homo sapiens
atcgcttaagcccaaacacgtcaggttgcagtgagtctgaaatcgcaccactgcactccagcctgggtgacaaagtgagaccctgtctcaaaaaaacaaaaagaagtgggctgggagaaagccctgtaccctttgag

SEQ ID NO: 575841 - DNA, 423 bp, Homo sapiens
ctaccgccaccagcatctaaggagagtcttctttctgtttgcagatctgtgataagacagatgactcacccagcgagatgtaggaggatgaccgatggcagctctctgagagcgggagttctgactctgcagcttttgtgtcccgtcccacccttagggatcaagcctggccattccagagcagctgagtttacacaagcatgctttcaagtattgacaattgctgttaccttagactgagataccccttcgtggttacttgaacttatacttggccttcaagccatgcagtacctactcttccaggaagccttcccaacctaccctctgagctttatattggagcactgatgatcctgtgtcagtaatgcctgagacacatttgtcttgcccatgagactgagccccatgtgcataggcttg

SEQ ID NO: 575842 - DNA, 950 bp, Homo sapiens
gctgagctgtatcgatggctcctttgccggaacgctccatcacaactggaggtacttcttcgaggatccaccgatgatggtcagtgtcccagagggcgtgatcagctgatgagcatgatggagaaatgagcctccgcatgattgctatgtagctcaattcaagtagcattagtctgttgcagggacagtccgtttactcacgagaccccgacgatcacaccatttttgaaatcctagaaatcgtcttctaggtgtggagacgtctcgaacgatcgccagatgctatgaagcatgtagcccaccaatggaatgatcttccgggtactagcacaaatagtctgttcccagattttgttgaaacggattggctttgccttcgcatgggtacacattggggttcctagcaaatgatcctcaattgaattgcgttcttggcaattgcgtatgagaagcaattggaggccaatacggcgctagtttttaacaaagcgatcgggcccttcatggtgccgaacatttatggagtaggtgcgtatacttttttcgaccccggtccgttttcgcttcccacgaagaatgatttccgcattggagctccaagcttttgctcggaattcgggatcggtggtggactttggctcgaatacgccatggaatacacacgtttagtgcctagcgggcgaccagggaaaattcttattccaaattggcattgagaagtaccggcgtggatctccattgggccctcctacgaatattcccaaacaccacaggggattactctggttgccaaacaattgcgcccgttggaggtttccaaaagcagtatggcacttttggcagaacatttacccattagcaaggcaaccggttcgttagacgataagcggaaaacaaacggcaccttgaaccccccccgttggggccgaacttggttgggaaacggcgtc

SEQ ID NO: 575843 - DNA, 189 bp, Homo sapiens
atccatacttggaatatctttctagaggagggtaacccacatttctgtgcccatttcaactaaatgggcacagaatttcaataccctttgtttccttctcctgcctaattgccctggccagaacttccaacactatttgtaataagtgtggtgagagagggcaaccctgtcttgtgccagtattcacag

SEQ ID NO: 575844 - DNA, 101 bp, Homo sapiens
cgcccgcggaggcctgtgggctgcgaggaggagcttgcctagcttgcaggcagcgcagggcagacggggcaggagaagcaagatgaatgcaggctcagatc

SEQ ID NO: 575845 - DNA, 3283 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3274)..(3274): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattcttatatatctattttaatacaacttaaacgcaactttatatgaatgggctacggtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575846 - DNA, 195 bp, Homo sapiens
acctgtgactaggatcttggtgtacagctcggcttttccacttatcctctaacccggaacaggcttctataatctctttgccttaaaataattctctgcatccctgtgtagacgcacatcttaagcagctctccttgtttcttccgggacacttgggacacttcttttctacacgtcgccccctcaaacggtact

SEQ ID NO: 575847 - DNA, 2608 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaaaagaagtgcagagaaagagcaagcttggttctgcgcacacgggccataacaaaaagttttgccaaacacacgtcccgttgaggagcacgcgggggccgccggggaggaaaagcgacgaccggcgcaaaggtggcctccagggaaatccggggcctgagactcggggtggggttctccccgaaaaaaaaggcccggggagaggcggcgtgtctgggacaaacccaaagggagtcaggggccaagggggctcaaggaaggagcagcagacctgatatgac

SEQ ID NO: 575848 - DNA, 3235 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3226)..(3226): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575849 - DNA, 3324 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3315)..(3315): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgtgattttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575850 - DNA, 317 bp, Homo sapiens
ctcaggtccaggcaaagtctacgcaatatatggtgtgtcccgataacctaggatgcattgatatcatagctcagaccatactatgtatcccaatggtctttttttcccgagtagtacgtacaatatgggagattattccgaaagcctggtaggataagaatataaacttcagggtgaccgaaaaatcagaataggtgttggtatcgaatgggggtctcctcctccggcggggtcgaagaaggtggggttgaggctgcgggtctgttagtagtatagtgatgccagcagctaggactgggagagataggagaagtagg

SEQ ID NO: 575851 - DNA, 346 bp, Homo sapiens
agccgagctatcataatatcgtatggttttaatacccataggatgtataatgatgtcgcttctctccttcctgatattcaagcacgacttactgcgttttacatggtataaatttctggcatctggcaggtgctaaataaatgtttcctggatcgaaatctacagtctcaaggagtcaaggctacaattcttaagttgcttcagatgactggttctatctatttatcaatacatccatcgatccactcatccactcatccatgcatcctcctacccttcctcttccccgtcaaacattcatccatccaattggtggcttggggaaagggacaatagtttatgctgt

SEQ ID NO: 575852 - DNA, 3267 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3258)..(3258): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagactaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575853 - DNA, 3116 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3107)..(3107): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575854 - DNA, 170 bp, Homo sapiens
  misc_feature (44)..(46): n is a, c, g, or t
  misc_feature (158)..(158): n is a, c, g, or t
  misc_feature (160)..(161): n is a, c, g, or t
ggccgatgctgaacagagagcttgggatacagagggctgtcacnnngagctgtttaacacttaagatgttggtggatggcgaaagctaaaagagggcgagctgtaacacatgacctctggggcgatccccgagtcatgagtaccccttctagacacancnngggggccac

SEQ ID NO: 575855 - DNA, 3176 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (3167)..(3167): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575856 - DNA, 304 bp, Homo sapiens
  misc_feature (33)..(33): n is a, c, g, or t
  misc_feature (137)..(137): n is a, c, g, or t
atgagtcattgctggaactccagtcataaaaanagacccagactaggcgtgggtgtcacgcctgtcatcctagcactttgggagactgaggctagaggatctcttgaggccaggagttccagaccaacctggtcaanaaagcacgaccccgtctctacaaaaaaattaaaaattagccaggcatggtgctgcatgcctatcatctcagctacttgggaggctgacatgggaggatcccttgagcccaggaggttgctgcagtgagctgtgattgcaccactccactccagcctggctgacagag

SEQ ID NO: 575857 - DNA, 2535 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (2526)..(2526): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575858 - DNA, 2276 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgcagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaa

SEQ ID NO: 575859 - DNA, 2201 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagataaagccctggcctcgttggcctcagcggtggagctctgcggctagacaacaaactctcaaataatatataatgaaaaatatgattctat

SEQ ID NO: 575860 - DNA, 125 bp, Homo sapiens
gaaaaagcttaaggaatctaaaatgcacaaacatactgaattctgataagtttagttagaagaaaaacaaaacaagggatctggcaagtaaatacgtaagaagatattaatctaattattatgga

SEQ ID NO: 575861 - DNA, 241 bp, Homo sapiens
caacgcttctcaacgaatctgtgcccttgttagtactggaaacttgataatgaagatctccaccctggatcagtaacagaggaaagacctaggtcagtcttattatattttaaattatttataatatgctttcatttatgattgatgactattttacaagtttgtctgttactcataaactatttaataccagtaattatcattgctctgccaaatttgtctccattgtctgctttctccc

SEQ ID NO: 575862 - DNA, 137 bp, Homo sapiens
gctgtttagaggatccctcatcttgctgtggtctccaagcctatcttatgtcccatctatactgcaggatgggctgctaacgctgaactgctacggttccctctaggcacacagtattcactaacattcaaaggtag

SEQ ID NO: 575863 - DNA, 202 bp, Homo sapiens
  misc_feature (64)..(64): n is a, c, g, or t
ggggggccccccccccctttttttttccccctttaaaaacccgggggcggtccccccccccggntttttacttgggggggggggggggtaacatttttccccgggaaaccctttttccctttgggcctttttgggggccccattaaaacaagtttttccaaaaaaacgggggggggccgggccgggtttcccggggttttca

SEQ ID NO: 575864 - DNA, 412 bp, Homo sapiens
  misc_feature (6)..(6): n is a, c, g, or t
cccccnaaatctgtttccccctcaaactgcaataaaggaggcgaataatagtttggaaataattgtcccccagcccaaatctccatgttgaaactgtaatcccccagtgctggaggtggggcccggtacgaggtgtttggatcatggggacgggtatttccatggcttggtgcctgttttccttgatggtgaattattgcaagatacggtcatttaaaattgtgtggcacctccccctgcccccttcttgctcctgctttcaccatgtgacatgtctgatcccccttcaccttttgccatggtcataagcttcctgaggcctccctggaagctgagcagatgccagcaccatgcttcctgtacatcctgcagaaccataagccaattaaacctttttaataataaaaaaaaa

SEQ ID NO: 575865 - DNA, 303 bp, Homo sapiens
tctagaggactcccagctgcagtttcgtgagcgacaggtacagagggacttcagccgtcagggcagtgtcctgggacctgtgccctgaagatctcacatgcaaggaacgctacttgtgaccatcgtgtgatgtgtgaatggggttctaagttgtggaaggtcgtgactgagcagagcctccagttttaactacccactttgtgcattgcccattgcccatccttcaatctcatactgattgtcacccatacccagcatgccctgtgtccacgcagcttcgtcatctctgcctgggggcgggcc

SEQ ID NO: 575866 - DNA, 977 bp, Homo sapiens
  misc_feature (80)..(80): n is a, c, g, or t
  misc_feature (212)..(212): n is a, c, g, or t
  misc_feature (268)..(268): n is a, c, g, or t
  misc_feature (277)..(277): n is a, c, g, or t
  misc_feature (292)..(292): n is a, c, g, or t
  misc_feature (342)..(342): n is a, c, g, or t
  misc_feature (377)..(377): n is a, c, g, or t
  misc_feature (389)..(389): n is a, c, g, or t
  misc_feature (391)..(391): n is a, c, g, or t
  misc_feature (474)..(474): n is a, c, g, or t
  misc_feature (498)..(498): n is a, c, g, or t
  misc_feature (522)..(522): n is a, c, g, or t
  misc_feature (557)..(557): n is a, c, g, or t
  misc_feature (588)..(588): n is a, c, g, or t
  misc_feature (597)..(597): n is a, c, g, or t
  misc_feature (600)..(600): n is a, c, g, or t
  misc_feature (638)..(638): n is a, c, g, or t
  misc_feature (697)..(697): n is a, c, g, or t
  misc_feature (700)..(700): n is a, c, g, or t
  misc_feature (703)..(703): n is a, c, g, or t
  misc_feature (762)..(762): n is a, c, g, or t
  misc_feature (792)..(792): n is a, c, g, or t
  misc_feature (795)..(795): n is a, c, g, or t
  misc_feature (801)..(801): n is a, c, g, or t
  misc_feature (813)..(813): n is a, c, g, or t
  misc_feature (824)..(824): n is a, c, g, or t
  misc_feature (828)..(829): n is a, c, g, or t
  misc_feature (839)..(839): n is a, c, g, or t
  misc_feature (842)..(842): n is a, c, g, or t
  misc_feature (848)..(848): n is a, c, g, or t
  misc_feature (851)..(851): n is a, c, g, or t
  misc_feature (853)..(854): n is a, c, g, or t
  misc_feature (857)..(857): n is a, c, g, or t
  misc_feature (860)..(860): n is a, c, g, or t
  misc_feature (862)..(862): n is a, c, g, or t
  misc_feature (869)..(869): n is a, c, g, or t
  misc_feature (947)..(947): n is a, c, g, or t
aggcaggggatcgggggaggtcagagcaagtagaatgggccatcattagaatgagcagaactccttgggaatcttgagtnatcagctggcgatggggagttaatgcttggtgtggatgacaggtgtggggatgcggatatcctggcctctctccagacgccgttcacaatcaatcaaatagtttactccatcgatgaccagttgcaccagcnccacctctgatttgcctagtcggtccaaattagaaatatcaaagacaccgcctgtngcagcagtntccactcctccagtnccacgtttttggagtcttaggttctccaggatctttgggaagcggctatntttgcttagcaggggcagtttgatgtgcactcctncccgaagtccantncccaggttagatggacaggtcaagatgtatcccaaacgctcatcccacatgaactcccagccacgttcttggataagtctctncacctctttgaggcctcggcagantctttcaaacactctcttcatgtnaccacccttctccatggagatcacccgtgtatgancctcctcattcacccagatcaggaagctctnctcattgtngtnccaaattccacgagcatctggccagtgtcgagccattnctgctgcagttagcaacggggacacaggcttatcaaacagaaagtggtcatcaataagntgntgntgttgagggtgtgtgatgtgagttatggtatattaaggtggagggaggtgagggttgangggagtgaatagatggaggagaagagtttngangtgtgntgtgtgttgtgnatttgaatgtntatnnaaaaaaattngtnaaattnttnannganttntnagtgtanatgagaatagataggtgtgatgaaaatatggagaagagattttagtgggatgtaaatgggtggtgttgttgattgtgnggggtgatatgattgtttgtgtgtttgata

SEQ ID NO: 575867 - DNA, 153 bp, Homo sapiens
tagaggatcgctagaagacgcagaagggcaaatctttgacttattggctgctcagaggattactggctcgagatgtatcctgcccgtgatgctttcccccagaggcccgccagtgcagtcggtggtacctgagatggaggagtcgggagcaca

SEQ ID NO: 575868 - DNA, 195 bp, Homo sapiens
tacctctctcccagaaaaggattagcaatgttagattaaaatgcactacacagaggccaggtgcagtggctcacactgtaattccagaacttttggagtcaggcagatcgactaaggtcaggagttcgagaccagcctggccaacatggtaaaaccctgtctctacctgtagattagctgcacctgtagtctcag

SEQ ID NO: 575869 - DNA, 109 bp, Homo sapiens
tccggagtcgcggacctagcatatcaccagttaccttccctctacacttatcatcttcacaattctaatgctactgactatgctagaaatcgctggtcgccttaatcca

SEQ ID NO: 575870 - DNA, 941 bp, Homo sapiens
  misc_feature (80)..(80): n is a, c, g, or t
  misc_feature (212)..(212): n is a, c, g, or t
  misc_feature (268)..(268): n is a, c, g, or t
  misc_feature (277)..(277): n is a, c, g, or t
  misc_feature (292)..(292): n is a, c, g, or t
  misc_feature (342)..(342): n is a, c, g, or t
  misc_feature (377)..(377): n is a, c, g, or t
  misc_feature (389)..(389): n is a, c, g, or t
  misc_feature (391)..(391): n is a, c, g, or t
  misc_feature (474)..(474): n is a, c, g, or t
  misc_feature (498)..(498): n is a, c, g, or t
  misc_feature (522)..(522): n is a, c, g, or t
  misc_feature (557)..(557): n is a, c, g, or t
  misc_feature (588)..(588): n is a, c, g, or t
  misc_feature (597)..(597): n is a, c, g, or t
  misc_feature (600)..(600): n is a, c, g, or t
  misc_feature (638)..(638): n is a, c, g, or t
  misc_feature (697)..(697): n is a, c, g, or t
  misc_feature (700)..(700): n is a, c, g, or t
  misc_feature (703)..(703): n is a, c, g, or t
  misc_feature (817)..(817): n is a, c, g, or t
  misc_feature (819)..(819): n is a, c, g, or t
  misc_feature (839)..(839): n is a, c, g, or t
  misc_feature (881)..(881): n is a, c, g, or t
  misc_feature (936)..(936): n is a, c, g, or t
aggcaggggatcgggggaggtcagagcaagtagaatgggccatcattagaatgagcagaactccttgggaatcttgagtnatcagctggcgatggggagttaatgcttggtgtggatgacaggtgtggggatgcggatatcctggcctctctccagacgccgttcacaatcaatcaaatagtttactccatcgatgaccagttgcaccagcnccacctctgatttgcctagtcggtccaaattagaaatatcaaagacaccgcctgtngcagcagtntccactcctccagtnccacgtttttggagtcttaggttctccaggatctttgggaagcggctatntttgcttagcaggggcagtttgatgtgcactcctncccgaagtccantncccaggttagatggacaggtcaagatgtatcccaaacgctcatcccacatgaactcccagccacgttcttggataagtctctncacctctttgaggcctcggcagantctttcaaacactctcttcatgtnaccacccttctccatggagatcacccgtgtatgancctcctcattcacccagatcaggaagctctnctcattgtngtnccaaattccacgagcatctggccagtgtcgagccattnctgctgcagttagcaacggggacacaggcttatcaaacagaaagtggtcatcaataagntgntgntgttcagcctctgtcatctcactgagcctatagtaacgtccagccaggtcacccttcaggccactcagtgcatccaccacaacacgttccacctctcgtcgctctgctcgagtncnagccggaggcagactgagtnctcggatgcttcggccagttctgactctagaggacaatacanacctctcatcaaagtagccagaacggattttactggcatctagatccgtggtgtncttca

SEQ ID NO: 575871 - DNA, 1261 bp, Homo sapiens
  misc_feature (480)..(480): n is a, c, g, or t
  misc_feature (738)..(738): n is a, c, g, or t
ggctagccgttgtggtaccttagtgatgccgcgtgtaaggcgaagcggtatcctcgctcggctagtggcctcccgtcggcggactcagtgctgggggtcctgcagactgagagctgctgccaggcctagcaccgagctcgcgtcaggcaggcatgcacgcggtgcacccccgtctgcatcttgtgtctcttctggctggcgtgcgccccggtaggccatgtctgattgggccagatggcattcactgctgctggggtggctgtgtgctctgctgtgggtgcacatacttgtggtaaccggccagtaacctggagggacttcagtaggaggaaaggtaattggctgacggcctgcgacggacctgatgaatcatgcattaacgcagcgaagccgtcagcggatactcgcagtccatggtaaacgtgacgtatgtgatgcgctttggctctttctacttgtagcaattcaatagtacgtttntcctgtgtacgcctgttgcccccatgcatatcctaggcggattgcaactagtaccacatgcctttctagttggtacgtgcggtttttgcgatgtagcacgtgctcgtcttggagagagcttcgatcgtcgcagaaccctttgtcatatgagcgtgaagttttgtgccctagattttgataagacacaggtttccaaaacttccttagggtattgaaagactttgtgataaaacttcaaatggcgttcttcaattaaancattaaacggtttaagagtttttatgtgatttaacacagagagttagcgagaatttcggacttacggttggaaggcggggttaacttaaaaaaaggggtagataaaggggcgaatttccaggggtttatgagaatcccttctcttcgccttagcttcaaattttccccttattggtgctgttaccaccattgtgggctttttccaacgagaacacctttggacccaaggtggtgcacaccacttgagaagggggggttgataccccccttaacacttccatgctaagggaacaaaatcctaggcggcacggtgttgggccacacacttgctttttgggtagtgagccctttcgcgcgcggtaaaataaaaaacttctaaggcttttggttttaatttggttttaactgggcaatttttttaatttcccttttttggcttggcaaggttttaaaccttttcacgcaacactttaaacaaagggtttcccacatttttttcctttttcccaaaagggggttaaac

SEQ ID NO: 575872 - DNA, 197 bp, Homo sapiens
gtaaagaacggtcgcggtcaatcctagcgcgcagcatgcagcagtagcagcagcagttagcagcagcagacagcagccgcatccgctgcgggagtcctgagccggaaccacacccaagtagctgccctttcctcttctgtcatctcaccgccccagcatagaccgcgttcccctgaggaaaccggccgcccacgccc

SEQ ID NO: 575873 - DNA, 806 bp, Homo sapiens
agcggaagaggctcacaggattctgacaatatctttgaccggagaagaggcaaagtacgctcaacagccgacagccacagtctcctcctgcctgcatttctttcctgacttgtcgaattccaagctgttaatataagatgttgcaacaagggcttgctacggtctgccggctgtcttgcttgcaggagtgcgaactagatatgaaacatcggctaggttacctgctgcaaaaatctgatacctgtgaacacaattcttcccacaacaagaaggacatagtggattatttgccatgagagtgagccaagcaggaagtcaagcaaatgggctgaatcacctggaaaaccctgattagctcatgaactgtgggctggacagcttacaaaggctttcttgaaagtctgaatatagtgaggcagaatattgacttctggtatcagctgtgaacgagtacagagagaaatcagaatcaccatctaaactaatgtcccaaggccatactaagcatctatcagatgaaattcattctcagttccaggcaaccaaagaggtgaacctggattcttgcaccagggaagagaccagccggagacatgctagaagcctacaataacctggctttgatgaggcccagaagaagattttcaatcctgatggagaaggattcctaacgggccgcttcctcaaagtctcgattctatcttgatgtggtcaacccgtccagctgttgggcagaaacagcagaaaggagccaggagttcagcagactgtgcttcctggtccctcagtgtgcctaattctcacct

SEQ ID NO: 575874 - DNA, 270 bp, Homo sapiens
tgcgtgtccagcgtgccggtttgctggttgttcgcccacggagatgacgaggcggatttccttgtaacatattgcgatagacaagaaagtgatcgacggtcgacttcgtctggtactggtgcgcccaattcggggattgctgtggtgaccgacgattatccaaaagagattctacaggccacgcttggagcggattaccgcgccctggcccagctcaaaggttaataagacccgatgactagttttgcattgccgacgagggggtccctc

SEQ ID NO: 575875 - DNA, 666 bp, Homo sapiens
ggttgttaccgcgattctgagaggggggcttttagtccctccagacctcggctttagtgctgtctccgcttttctttcaccttcacagagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgccggagaacaaaatcaaaactaccgatttgcatagacctttgcatgatgagatgcctggtaatagaccagatgttattggatccattgattcacaagttttacaggaagcacgttcttcattaatattcgccgaccatgagatatattgcaccaagtaaagatttataggacccatttaccaaccccctgaggaaaaagaaccgcattgagggagggatgagggacatgtcttaatggtttaattgccgagggggccaaagagggaaccgaattttactcttgaaaatcgagaatggcacggaatatttccgtttccaagaaattgagagcttgggagaaggttttggacacatggaagtctggcctttccg

SEQ ID NO: 575876 - DNA, 127 bp, Homo sapiens
atctagaggaccccacgcgcacggcggtagcaagaggaggagcacccaatgagaacttcatggcatctgtgaatctctttgtgcagtatcttccattgattaatcagagcttcctagatgtattgtc

SEQ ID NO: 575877 - DNA, 2152 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (2008)..(2008): n is a, c, g, or t
  misc_feature (2012)..(2013): n is a, c, g, or t
  misc_feature (2030)..(2030): n is a, c, g, or t
  misc_feature (2032)..(2032): n is a, c, g, or t
  misc_feature (2045)..(2045): n is a, c, g, or t
  misc_feature (2048)..(2049): n is a, c, g, or t
  misc_feature (2058)..(2058): n is a, c, g, or t
  misc_feature (2061)..(2062): n is a, c, g, or t
  misc_feature (2074)..(2074): n is a, c, g, or t
  misc_feature (2095)..(2095): n is a, c, g, or t
  misc_feature (2103)..(2103): n is a, c, g, or t
  misc_feature (2108)..(2108): n is a, c, g, or t
  misc_feature (2112)..(2112): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtattttnctgnngtccaggctttcctttnanctgtgtctgtgcncanngacttgtanttnnagacttccaatntttgtccatcacgtgtcttanagcgaaangttgnggtnctgaccaatgtgggaggttccaatgcctacccggaatttg

SEQ ID NO: 575878 - DNA, 1557 bp, Homo sapiens
  misc_feature (57)..(57): n is a, c, g, or t
  misc_feature (70)..(70): n is a, c, g, or t
  misc_feature (87)..(87): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatcccatgtcactcctcccacaaatacttctagtctgttcaactgcagtcaattctgtattggtttgcctgtgaattagacttctcaagtctttacacagagtaaaagaacccacgcgtccgcggacgcgtgg

SEQ ID NO: 575879 - DNA, 2215 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (2206)..(2206): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575880 - DNA, 1182 bp, Homo sapiens
caggagcagactattttaaaaacgcgtttgaagaacattttccttaaaaacaaagatgctgaagaatccagagaaggatcaaagaacttattgcacagggcgaatttgtacatgcacagagctacgaagcttcgtacttccttaggaaatacagagctatgaaacaacgctattacttcagataccaacaaaactaattgatcattactactttaactttacgctatcagtgccagctgtcttactgtactaccagactgtcgtaaaataattctaacttaaacatggcgaagcactatacactgtgctgaacaacaaatcccctgagctgccctactgaactaaaataggtcttcaacttctgcttcctacggagcaacgctcatcagcaaactttaatgcctccaatcttcgatacaaacactagccaatttagactatactaccgatcatacacttcactgagccaccccaattcggcactgaccacctactacataccacttctaatcctctagacttaactcagcgacttagccaaccacttcctacggtctactctcctccactctcagcttgaccaaagagaactgccatctcacccgaaccattctacataaagcaaacactaactttctttacaccaccttacttcctcttaactctctgaacaggaatccctctattccctctcaccccccaatttggggtactatttcaacaacgcaccattactccaagggcttcaccctaacgacagaccgaaacacgttcccctgggtaaattgcttctaaactggtcaacgctcataggaaaattcaactaaactattgtcttgggaggccatctaacttcctggaacccttgaaaatatagccggctttgggttgattcgggccatttcaccccttacaattaaaggtatgtcttatctcaccctcagcttcgtcccacttccacttcaatcggctcggctgcctggccaccttctggggcccttacacaccccaggttaccctcgttaggtcgtattacaatcaccctctctctcgactaaaaaggggacatgactcaagtactaggttattcgccacacacgaaagacaggaccagtacaagcaaggaccatctcttccagcgtgtcgcggactcgacgcagaacttacgccgaacccatcatc

SEQ ID NO: 575881 - DNA, 105 bp, Homo sapiens
tatctagccatctccttgagcaaactccaagtcctgctgtactcgctcacgccgtacctctgacagactccaagtcctatgatagtacgattatgggaggaaacc

SEQ ID NO: 575882 - DNA, 169 bp, Homo sapiens
  misc_feature (147)..(147): n is a, c, g, or t
  misc_feature (151)..(151): n is a, c, g, or t
gcaacattcgtggttcatcaagcgtgacaagaagctctgactgcaagtcaccagtctgcccagaagctcagaaggctaatgatatatccctaatactcacccactcttaatcagtgtgaagacgtctcagactgttgttcattgcanaatnaaactaaatgtgtacaca

SEQ ID NO: 575883 - DNA, 1117 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (977)..(977): n is a, c, g, or t
  misc_feature (1024)..(1024): n is a, c, g, or t
  misc_feature (1083)..(1083): n is a, c, g, or t
  misc_feature (1092)..(1092): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttccaccttggatggtttggnaagaccagaaagtgggtgggttcctggtagccccagttcccccaggncaggcttttttaggggaagtgggagggagggtggccttccaaggtgggcaccttggggncatttaaanatccccaccttgggggaaggggcca

SEQ ID NO: 575884 - DNA, 902 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (845)..(845): n is a, c, g, or t
  misc_feature (851)..(851): n is a, c, g, or t
  misc_feature (868)..(868): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgttttgcttnccattnattggagttccctcctnaggggaaattgcagggtggaggggcctgatttag

SEQ ID NO: 575885 - DNA, 1590 bp, Homo sapiens
  misc_feature (1581)..(1581): n is a, c, g, or t
ttgctggtcggttcgctactttgcctttcgctgctgctgggttgtgtctgtctgtctgcgttctgcgtgcggtttattcatatctcccccgccgttgttgttgttctttcctatctctttttctcgtttctcatttcttctcctcgcccctcgtgagtggtctcgttgggggtggcaccctcgctgcgctcgtctgcgtgttgtagttttcttcctctgcgggggtggcttggttctcctctgtgtgaggttggtgtgtctcctctgtggtgtttcctcccccctccccttgcttgatgtgggtttttgctctttccagagtattgttcctgtctaatcgcctgtattgtttgtgtctcaccagcacgttttgttttttatacaagcacgccggctcgttgttttcttttttgttatatatgtcactgccctttttaggggtggcgccccttttttgtcatacagaaacagttgtgtgttttgattcttatctgatggtggctccccccgcggtgagattttttggggcgccccccctttttttttttttttttgttttttttttttttttttttttttttttttttttttttttttttcgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575886 - DNA, 1341 bp, Homo sapiens
  misc_feature (57)..(57): n is a, c, g, or t
  misc_feature (70)..(70): n is a, c, g, or t
  misc_feature (87)..(87): n is a, c, g, or t
  misc_feature (1332)..(1332): n is a, c, g, or t
ctgtaagccttcctggtgtcctgggttatccctccttctgctgttctggaaaagaanacccagcccagtntatggagtataagaaanactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575887 - DNA, 233 bp, Homo sapiens
gatccctgtggcgcgtactgcttgggcgcgtacgatgaagatcagatcatcgcccgccggagcgcaaatactcggtgtggatcggcggctccatcctggcctcgcttgtccaacttccagcagatgtggatcaccaagcaggacgtacgacagaagccggcccattccatcagtccaccagcaaatagcttctatgacacactccagcctccagtagcggggtaccgacgctc

SEQ ID NO: 575888 - DNA, 424 bp, Homo sapiens
  misc_feature (169)..(169): n is a, c, g, or t
gacaattccaggcgctcctccccagttagacaaagtggtacttagttacggcgcgttggccctaatcggcgcagtctgagcggagtattggtcgtcaccaaccgaacagaatggatcgtgtcccgggaagtggtgtaactgaaccaaccgaagccgccctgcggaagangatggttggtcatcgtggtttttggctaacgttgagtttgcgaagacctaacgaacaccaggaaaaccacgatgaccaagtccactatcgcattgaccgagctggttgagaaaggggcagacgccgatctgctcaagcaaatgattcagttcgttgcccagcgcatgatggaactcgatgtcgaaggcctctgcgacgccggcttcgacgtcaaaagcccagaccgggtgaacagccgcaacgctaccgggatcg

SEQ ID NO: 575889 - DNA, 336 bp, Homo sapiens
aagtggccagcatgtgcctcatctgttcctcaaaaatcactggcctgtattgcaggttcatcatgagcattcatgacagctgcgtgttggctcgatccagctacaccgtgtcccaggttccgcatcatcaacataatgtcctctgtgatgatttctaacatttctcgatcctgtcttaggctggcactggcatgtatgcaaagtaggtcagtgtcttagtagctgtggtggtatgagcttgtgttagacatacagtggtgcatttagagcacgtagagatagagactagagaacatgccgttgccgggttcattatgccagaggcgtccacggtcg

SEQ ID NO: 575890 - DNA, 1122 bp, Homo sapiens
  misc_feature (86)..(87): n is a, c, g, or t
  misc_feature (146)..(146): n is a, c, g, or t
  misc_feature (186)..(186): n is a, c, g, or t
  misc_feature (1113)..(1113): n is a, c, g, or t
cccccccttttttaaaaattttaaaattttttcccccaaaaggtgttttttttgattcccatttttttgccccccccttttttttnnccccccccccccccgaaaagggggaggccccaaaaatttttccccccccccttgtgggngaaaattttttaaaaaaaaaaatggggttttccctttggnaacccaaccatctaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggaccagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctaaanaaaaaaaaa

SEQ ID NO: 575891 - DNA, 435 bp, Homo sapiens
  misc_feature (11)..(11): n is a, c, g, or t
  misc_feature (81)..(81): n is a, c, g, or t
  misc_feature (238)..(238): n is a, c, g, or t
  misc_feature (390)..(390): n is a, c, g, or t
actcagatatncctctcctccttaatccagacatggtctttcattcgtaagcagcaaataagccatgcctctccctgttanacctttttgtcctctgaacgtaactgtcttacaggcacagacgtgtttccagacaatccagatgatgcttctgctacagcgacatggcccagtcccaaggcgcaagggccacttgtgtcagcagtgtgcaccagacagcgtgcgccggcaagatagnagaagtcatgaaaagggccggccagaagacacctactctggctggaagacacgtacccctgaagatcaagaaagaagctatctgggaacaatgtagcagttacgtcagtaccaggacacttcctgtttacaggagactataaaacctttgtncctatcatcacttgatgtggaccccattttaggcctcagcccgcc

SEQ ID NO: 575892 - DNA, 267 bp, Homo sapiens
agttcgatggagagtctctcaccatatttaatgttggtgagagagtgatctatcctaatgatcattttactgtttaataaagtttcctagccatgaagtccatgtctactgatttagacaaggtattagtggtcattactttgtacccctagtccttccaagcacttctgtttcttcagttcgtttttactgatccaccaacacctaacgaggctatgctacagtctctagcttaatggaagacacattcatccttctccctctgac

SEQ ID NO: 575893 - DNA, 152 bp, Homo sapiens
ggggagggcccccggggggggggggaagggggcaattcggcccccccccctggcgggcccccccccctgggttcccttttttgggtccccccccctcctggacccccctttttggttgggcaggattttttttttaccaaactaaaaatgga

SEQ ID NO: 575894 - DNA, 365 bp, Homo sapiens
attagaggtatggagcagtgcaacttaaactcaagttgcacttacattttgaattttaaaatgatggttttatctgttgtgtgaagtggttcacccttgaggaccaggagcctccatatcgagactgaaaacctttttgtaagacttagagaaacagtgcttttggttccttgagttctcctgtatccagataccaaatgaccttgacttttaagccttgtgaattcgtagtccaatcagctgaaattaaatcacttgggagggacgcatagaaggagctctacctactcagtgccagtgcaccactctttccaggtggcatccatttccaacaatgtacataataaagtgtaagaaaaatctct

SEQ ID NO: 575895 - DNA, 377 bp, Homo sapiens
ggccccgcgggttttaaattgggtcccaaaaggttccgcaagggtttccggcagttccgctaccagaatggggggggtccccgggaggttttccggcagttgggggagttttccccccagtggttggggcttaacatccgccccaaggaccagtttgtgaaaatgttggtgcaaaagcagttgttccccttcttgcccaggggggttggggcccgggggttccccccccgcaggaatgtgggcttcattggttaaggggtggagttggggggggccagggccgggggttttttggggattggggccatgttggggcccgggggcttgagcttgggccccccccccgttttaataaaaaatgagttttggcagcccca

SEQ ID NO: 575896 - DNA, 259 bp, Homo sapiens
ggtggcattggaaatagcagagtgcttcgcggtaacagggacaaatgtactgaggctggagcctgtgtgaacagaacagaagaagcccttcactctagtagtgctcacaggccaaccacagggtggttgcttaaaacagcttacttagatcactactgctgggggggggttgatatattctctgtgttaaccttcaagaagggcacaggccggaaaacatgagccagccactgaagaaacgggcaaagacaagacacca

SEQ ID NO: 575897 - DNA, 477 bp, Homo sapiens
  misc_feature (334)..(334): n is a, c, g, or t
  misc_feature (351)..(351): n is a, c, g, or t
tcgagtcctgcagcagaaaacagcatccctctaaacccaaggcaccttgtaatgaaagaattaaagccagtgacgtgaattttatgttcgatcccaaaaccagagttgacttggcttgtctgggttgttcacccagggtagggctctcctccacaaggcccaagccctactggggctgcttgggcaccagccacgctgtggggagggtgttaatcgtgactgaatcgtgtattccatgtgggaaacagtcctgcagtcgggggacaggaggagccaggctggaatccaacacaaacagtccaggggcagagggaacattcccgggtacctgtgnccctgagtgacttgaanatgctgaacttatactgaattctgtttaatgattatttgcgggaggggaacaggcattcttaagagatcggtttaccttaggaaatcctgtactccccctgctttccggccttccggcctccttgt

SEQ ID NO: 575898 - DNA, 146 bp, Homo sapiens
ttcaagttagctctctgaacattgggcttgagagtggttgtcagaaaggtgcaggtgctccacaaacgggtggtaaaaaggcctcggagctcttggatgtagtatttcagatcaggggcaggcaccggatttgaggctgtgcgccc

SEQ ID NO: 575899 - DNA, 514 bp, Homo sapiens
gaaagtgctaaattgccacctaaaactgtaatcatatatttatacactggagaattgtcatgagatccttaaccatttctttttacttcttttcttatttccaaattctcgtctcaatatttctgctttcttacataggatgtatttttcattcatttcactgcatttgtctaaccttttagacacaaattctaaatctgaaactaatttcttaaaaaggacttggtcaaagttgaatttgttacatgtcctagcttatgttatcaaaaaaataatagcaatatatagaaccataatatttcctttttaatatatcaaaaatagatcattcactcctgtgataatgattcctttggtaatttcttttaacatgtgttgaaatgcactgtgttttggcagaaagctcatgaaactgagagtcatatgatttgaggtctagtcccaactcttaaaacaattagcatttttgacttcagtttactgaaccactctgaactcatgattttcatcttta

SEQ ID NO: 575900 - DNA, 323 bp, Homo sapiens
ctaaggatccttacgatctcacccacccctcattctctttagtaagttccttgatctctggaggcagtgaaattggacatatagagaaggcaggcagtataaatgcaggaacaccaacggaaactgttccttcctaactatgttgggaacatataagaaagtatagctctgagactttaggagccttggcaggacctggtctccagttggtatgtggctataaacctggatttggcagaactgtttcttggtcggtttcagaccttcttgttattgaacatggagcttccgagtacctcttaacgacgaagtacatagtacga

SEQ ID NO: 575901 - DNA, 291 bp, Homo sapiens
cacattccccaaacgaggaggaatgtttggagaactccacgtgaatctttgattgggaaaccgtcacataccccaagagacccacatgggcatgtggccctcaaggctggttgagagggctcccctgtgtgttgaactatgcaggagggtgatgcggacacatttcagttggactttccaaggattgatggatagctacctcagggaccagaacccgtgggaagggttggacttgttgttcccgttcccatttgacaggctctcttttgtagttatccatcagcccttcca

SEQ ID NO: 575902 - DNA, 396 bp, Homo sapiens
  misc_feature (111)..(111): n is a, c, g, or t
  misc_feature (139)..(139): n is a, c, g, or t
tgtaaaaaaaagggtttgctagcaaagtgcagaagaagttccctgaatagagacaatagtaaaccatcagaggatctattactgtcaataaaatgatctacacttatcacngatcaacacacatatcttagtcactagntggtagacaagtgcttgaaaggaatataacagctatttataaagaatatgacaaacttccagggtaagatagtgggtccaggcagaatccccaaattcttttaaaataaaaacaaagaattacaacttcgacttatttttcttaaataccagttagcaaaaaagagcaaaagacttcagaaatctatgatgtgttccaacttccaagcagtgtcacccacctaatcagaccgagagaaaaaaactagtggcaatgtc

SEQ ID NO: 575903 - DNA, 407 bp, Homo sapiens
  misc_feature (20)..(20): n is a, c, g, or t
  misc_feature (51)..(51): n is a, c, g, or t
  misc_feature (54)..(54): n is a, c, g, or t
  misc_feature (59)..(59): n is a, c, g, or t
  misc_feature (95)..(96): n is a, c, g, or t
  misc_feature (115)..(116): n is a, c, g, or t
  misc_feature (132)..(132): n is a, c, g, or t
  misc_feature (240)..(240): n is a, c, g, or t
  misc_feature (268)..(268): n is a, c, g, or t
  misc_feature (270)..(270): n is a, c, g, or t
  misc_feature (351)..(351): n is a, c, g, or t
  misc_feature (353)..(353): n is a, c, g, or t
  misc_feature (392)..(392): n is a, c, g, or t
ggacccccctgcgacagagntgtgcaggggccctggggcaaaggtagcagncangtgancttttgggaccaggtgaggggtccacttgtctccanntgaagggcgctgaggcagnnccccaaggcgccgtgnaggtggcgagaagtggtgagaagcctctggatttcagaggtcaggctgacagggtgcgtggtggagtgggcatacagtgagagaaaacacttaatgtgggacagtgangagccttcggaggttaaaaagagcttgncntctgaaaacagggagtggtgtggaggggaagcagcctccgtcacttcccagcctcgggagcctggggctgggcctcgcttngnctcctctattgaatgaggataatggagcccatttgtgtnagtttcctgtcaatg

SEQ ID NO: 575904 - DNA, 316 bp, Homo sapiens
ggttgcagtgagccgagatcgtgcccctgcactccagcctgggagacaaaagggagactttgtctcaaacgaaaacaaaaacaaaatccttgtatgcctttgacatgtttcctccaattgtgacattttctaaaacaccagtataatatcacaactagaatactgactgtatgtgaatactgatacattgatcattatgggcttgaaaaaaataagaggttacttttttacttttttttggagacagaatactcactctatcccccagacgggaggaactgaggcacgagaatccatgagaatactacttgaattc

SEQ ID NO: 575905 - DNA, 1509 bp, Homo sapiens
ttcaagttgagatttggtggggacacagccaaaccacatcaggcaacttgtgcaatttttttcttctgttgttacttaggatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttatggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttccaaccttttagcatatctccaaccttgcaatttgattggcataatcactccggtttgctttctaggtcctcaagtgctcgtgacacataatcattccatccaatgatcgcctttgctttaccactctttccttttatcttattaataaaaatgttggtctccaccactgactac

SEQ ID NO: 575906 - DNA, 369 bp, Homo sapiens
gtgggcgccccatctcttttgttttctccttcaattttaacgtcaactcccaataccgaattttgggggacattggggttgcaagctcggggaaaaactgtcaacccgttcttccttctgggaaattcaggccccggaacccagacccccaagaattccaccttcttttattctgggaccgcaagccgggggtggggttggagccttcctgcttcctcctaacttaatgcccaccccctcccctgcacttcttggggggggcttgaacccaaagaaaaaaaccccttgggttttttcctccggaattttttttccaaaagaagttttttttctccgttgtttttttactggaagggaaaaaacacaagc

SEQ ID NO: 575907 - DNA, 1453 bp, Homo sapiens
gcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttatggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttccaaccttttagcatatctccaaccttgcaatttgattggcataatcactccggtttgctttctaggtcctcaagtgctcgtgacacataatcattccatccaatgatcgcctttgctttaccactctttccttttatcttattaataaaaatgttggtctccaccactgactac

SEQ ID NO: 575908 - DNA, 985 bp, Homo sapiens
cgccgctagcgctcgagtgctactgatagttgtaggtatcatagctgacagtaggttagatctctagatctgtctacacatcacattatgtgcaggcgtgggcctttaacatattcgggaatatgttctcgcagtataatagtatatggtgcccttaaataacccgcccgtctgggggtgtccacgcatagccattggagggtggtggctatatatcggcttattgggaatattttagcacctcggtaccatggactttgtgggttgtataccgtatccagtggaaccgatgtggggtttaaccacaggggttgggtaatattacccgtgaaaagaggcctgtcaatattcaaagttccgcgcgcaattgttcgtcgctcgagtgggttgacccaccacataatgggggccccagccgcctattggaataacgccctaatatttgggttgaatttctaaaggagggaaacctttccaaaatgtttccccccagggatgtttgtacaacagcctgccgttacacgcttgttggtggacccgacgtgttaagtggttgtggacacccggtgatttaggcgcccagaaatttttttttggtaatccccacaacaatacgtgtgggaactccaatatgggagtaaacttaaagggggttaaatcaataccaagccgtgggtccataaagtgagtctcttttaataaatgtatacatattttgtaggggtaccaccgtcgtcaaagtggttgtggcggggtaatatggaacgcccatatgtggttcgccggttctcttttataaggacgctatatatttggtcccaaacctggccgcggtgtgttaccttcaccttgaggtgtggttgtaatcttcccttcctctgttgttataagaggatgtgataagattatcaaaatacctattttttttaaaagggaagggtaatttttcccaaaaaaaaaaaagggaaaaccctgcccaaaaaaa

SEQ ID NO: 575909 - DNA, 1848 bp, Homo sapiens
ttcaagttgagatttggtggggacacagccaaaccacatcaggcaacttgtgcaatttttttcttctgttgttacttaggatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttatggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttccaaccttttagcatatctccaaccttgcaatttgattggcataatcactccggtttgctttctaggtcctcaagtgctcgtgacacataatcattccatccaatgatcgcctttgctttaccactctttccttttatcttattaataaaaatgttggtctccaccactgactacaatgatttccccatggattcatttcagaggagttactaaggcatggtactatattaacctcttgcctccccttcatttatccatcccacttcttgaaaagttccgaagctgcaatgatcactattcatagccatatgccattgcgacgtcttgtgcacagaatgagtcatacttattccacgctctttaactttcgcgagatcgaggccacttgtagattctctgcatcccgtacttcttcctgtccatacaaaaggccatctcttctatccaatctgtgcacggttggccagcacacgattatcggtaaattctccaccacgacgtgtctcacgcact

SEQ ID NO: 575910 - DNA, 311 bp, Homo sapiens
tgattcctagggcccaaggttcaattcagtggatataactgaaccccctcctccctttgggcttttggttttttttatggggcttaaagtaaagagcccctcccttgccagtcatccctgttggtacttaggccttttatcttgggtccaattgttgaagaatgggggcttgtttcatgggttttggatttgggtttaatgcccgttttaacctgatagacgccatgccttggggagctagttttttgggaaagtccatcttttagggattgtttttccggtcttccataaattttttcttttaatttcca

SEQ ID NO: 575911 - DNA, 586 bp, Homo sapiens
ctcaacgctttatacttctatgaatcccaacaatatttgtgcctttttctttttgggcatttaacacattcaattttttattgtagctacttgtgcacatgatttctccctttcctcaacctccagtaggctgtaaagtgtttgagggaaagggatttgtttaatctttgtattccctacagggtctaagacacagtcttactcatagcattgctcaataaacatctgtttgtgtgtgtgtgtgtgtgtgtgtgtgtatgtaatctttttttttttttttttttggagagggagtctcactttgtcacccaggggggagtgcaggggggggatctcagctcacggcaagccccacttctcgggctcacgccattctcgggcctcagcctccggagaagcggggatcacgggcacacaccaccaggcccagctaatttccggtgttaagtagagacgggttcctccatgtggggcagccgggtctcgaactccctcacctcgggtgatccggccgcttggggctcccaaggtgcggggagtacgggtatgagccgtcgcacccagccaatcttttctctttctttcg

SEQ ID NO: 575912 - DNA, 296 bp, Homo sapiens
  misc_feature (6)..(6): n is a, c, g, or t
  misc_feature (257)..(257): n is a, c, g, or t
gtatgncgagctgaggaccaccttccttgagcctcagcctgtcacggcccacacccctgcagaatccacctgcagaaatagcggctacagcgagaggtcggaggtgacctgcatgtggggggcccgtggggacgccggacgggcactgcggcgcgcctgtgtcttgcgcgcgattgtagcggctggttccgcacgatctgtgactgatgtcttcaactggccccatcacggttggctctcatacaatgagtggctcnctccttggttgcctcttggtctcctttggttggcctctg

SEQ ID NO: 575913 - DNA, 395 bp, Homo sapiens
gctcttaccaatacctcctcagatagtgcaaactgatctgggcatcacacacaaaattcccttttttgtgctgtattaaacttggaccagttcactatacggtctcatatactgttctgctgacacaacgaaggtagtagcatgggttacccaacaacacatttgtcaaactacggcttaaataacacagccaagcaacgtctttgtttcataaaaggatgtactgactaaaagtcaggagtgcgttacataaccctgcttttctctctgctgtggaaaaacagcatttcatattgatcgttctagcctacaggttttacacagccacctacccccaccataagagctaccatcgcatggattaggctttaggttaagggaggaggttattggca

SEQ ID NO: 575914 - DNA, 536 bp, Homo sapiens
tgttgctggtggtcgatctagaggacccctggccaggctcttgaggaagccatgactgggtcggcggtatctggtgtcggcggtctcgcggggacatgaagtcaaggagggccgggaaggtcactacccccagggggtgggggtccacaaggctcatgatgcgggcaaattctgcttctcccggggggtcgtggccaatatcataacccaagctgatgaggcaggcttggaactcctcgggacccagggtgccggagtgatcccggtcaaaggggtggaaggaggcccggaactcattcatctgctccgggctgatgcccttggcatccggggtcaggatcgggttctctacctcatggatggtccgggcgatggtggtgagcagctgctcccagcccacagggatgtgctccagggtgtagtgggggtgctggtggtcgaagatgagcgcctccgggatgagcggggggtcgccctccagctgatcaatcttgggctggtagttgacgatgctcttctcatagtgccgcaggtag

SEQ ID NO: 575915 - DNA, 778 bp, Homo sapiens
  misc_feature (9)..(9): n is a, c, g, or t
  misc_feature (481)..(481): n is a, c, g, or t
atggggttnggggagaaaaaggagttaaatgtttgggtaaacaaccctcatgatacccagaaaggccgctgtttcaggctttatttcacactttgttctgttgcacttaaaagacccaaacggtccttcatcttttttttttttcccccaaagtattaaaaccgattttctcttttatctcaccggagtcatgctgattctctttggatgtctacagggaataaaatgcctctgcagcacctgggaagattgtaggacttccaagtgtctgcctctttgtccaagagaagaggaggaatagaaattgtaagagttaaaaatggaataattatctattatctaaaaatatcttctcttgctcttttctagctaactacttaggttcaacctagttgaagaaacaatgcctagaagaaataaatgcttacaaaagatacccatcagtgggtggtatgcagatagcccttgtcttcccttcagngctggacaccctgaccgccatggaggtggccacacagcatcccttcagggatgtggagtgtggagaccttcagatgcttcagagggaggatatgagtggagaagttctttgcatgtgtttctagagctagagttggtgtcctgtttttttgtggaaaggatagagtttaaaaattaatctgaactttttcttcccctttcttcagattattgttataaaaatactatggatgctcatttatttcagctgtcagtgagaggaatcagactaaaaccttgttgaagcaaaaaaaaaaaa

SEQ ID NO: 575916 - DNA, 844 bp, Homo sapiens
agcggctctctgcttcctcctgtacgacagtcagtggcatcttcttttgcgtcggcagccgagccacatcgctcagacaccatggggaaggtgaaggtcggagtcaacggatttggtcgtattgggcgcctggtcaccgagggctggttctctaactctggtaacacgtggatattgttgccatcgaatgacgccttcattgacctcaacttacatggtttacatgtgccaatatgattccacgccatggcaaattccatggcagcgtcaaaggctgagaacgggaagcttgtcatcacatggaaatcccatcaccatcttccaggagctgagatccctccaaaatcagagtggggcgatgctggctgctgagtacgtcgtgcgagtccatcctggtcgtcttacatcctacctatggaagaaggctgggtgctcatttgcatggggggagccaaaagggtcatcatctctgcccccttctgcttgatgcccccatgtacgtcatggtggtgtgaacctatgaaaagtatgacgacagcctcgagatcatcatcaatgcctcctgcaccagcaactgcttagcacccctggccagaggtcatcccagtgacaagctttggtgtcgtggaaggagtcttgatcacagtccatgccatcactgactcgccagaagactgtggatggccctccgggagactgtgtgcagtgatggccgcggggctctccagaacatcatccctgtctctactgtctgctgcagagctgtgggccaggtcatccctgagctgaacgggaagctcactggcatggcttccgtgtcccagctgcgacgtgtcagtggtgg

SEQ ID NO: 575917 - DNA, 550 bp, Homo sapiens
cggaagtaccagctgcgggaaggagctgcccactgtgcgtcttctcaacttgttgggacaaccttcctgcggaaaggagagacaaccttcctgcagaaaggagctacctgcttcaggtctactgagagctgttctgccactcaataaagctcttctccatcttgctaagcctccatttgtccgcaatacctcatctccctggacgcaggacaagaactcaggacccgcctggaggtgcccacagcagaatccacataccgtccatctggtccagcctcacgcagagccacaactgtgctggcgcctggagctgccagcctcactgcagcagccggactgacattcagacgtggagcaagttggactgcatagggacccaccagtgagatggacgctgtctgtaaacgatgcggaaattgaacaataggaagattcaacacaatgtagtcgggataagaatgaatgagaagaggcccagtccttaggaggaattgtaaccaagtttcatctgtagatctccagtgatcctccagccttgaatttgttttaa

SEQ ID NO: 575918 - DNA, 1055 bp, Homo sapiens
  misc_feature (27)..(27): n is a, c, g, or t
  misc_feature (203)..(203): n is a, c, g, or t
  misc_feature (1027)..(1027): n is a, c, g, or t
gctgaagggcaaagcaaaacaaaatgnataaaaaaataaaaagatttcttacacacgggaagtctaggctcactctataactacagtatgcatgtgatatgcctgcctccatataatctgtatcaaactctccacaaaactgaagtttcttgttctctaaatagctgactgaatgtgaatatgtggagtttaaccatacaggnaagataatgaaaatttgagtactgggacaatattcctcacagggcagtactttccttattcctcctctgtatctccaaccttaaactgctttgttggctgcagtcataaacctagtgagcctcccttttagagagtcccaggtaattcagctgattcagcccacatgcatgaagctttaatccaccactatgtgactatatatgaggacacagaatattctgtgttaagtcattgaattaaaaagtttcagagctggaagaaaccttagagataatctagtttaatcttctaatcaatgatgaaactcctccaaaaggtatgtttccctcctctctaaatgcctcacttcagtacttatttcttcctgtaagccttttttaatccctgaaagtccaggtcacaactggcatttcaaaaccaagttttctgtacatctttcattctccctgtgtgtggcctacagtccagctgaactacaagctctataagaaaaaacaaaacaaaacattatttagtgctgtatcattttagcatcctaaatgtttgtgattggtgaagatctgctgtattggtaggttttttcaacttaggaaatatacactacacccagtcaccataccttggaaagttgctcctctgactgaggttctgtaggcagaacagtccctccttgtgctttcatttcttctatgtatttattcaaagaagttaatttggccttcgcatgaagttttagttttttaattttgttatcagcagcttttctctcttcctgcccaaaaacaatgatggtaaatacataaatgtttattcccctcttatntagcacatactaaaagttggcggccgca

SEQ ID NO: 575919 - DNA, 112 bp, Homo sapiens
agctcgaccgtgacgatcggcgactttggtttggcattcggcgtgtgcacgtgaagatcggcgactatggactggatactcggcgtgtgcagtatggtcttcggcgtgtgcg

SEQ ID NO: 575920 - DNA, 227 bp, Homo sapiens
acctacaataaatgagtacgactgcgttgtggttttagaaatacggtctgactgtgtagccctggttaaattcaaactcctgggctcaaataatcctcctgcctcagtctcccaagtagctggggctccagggtcatgcaactgcacccacgctagtttacactttctttacaggtgcataagtgtaaaacgtgaagactcatagaagaacagccgtgtgtaacgac

SEQ ID NO: 575921 - DNA, 1339 bp, Homo sapiens
cgaacgggtgctccccacacctcgttcccgcttttttccggccgcgcgccgtgtgttttctccccgtgggggtggggcctccccggggggtcaccatacgacgttcaagagggtcccccccaaagagtttcggcagggaagatctttttttccggcccggcctcgcggccccctcccccttttttcccagagagtctttcgggggggaacccctggaccgaatgtcaaagctggacaaatacccactgtggccccagaacattctttttctttccccatgcagggggttgccagaaaagtggggccaccgggtaggtcccccgggtgataatattaagggaggaattgtcctcttggaagggggccttctccctctgtgttgggaaaagcccgaaatatttttgggggggggcaccaggaaattacttttggtaagtcccaccaattctgaggaccctgggtggtgccaaatcacaaaagaggtaaacacgcgcacccacagtgggccccccccaggaatataaaaggcgccccccccatgtgggtggagaaaacccccacaaagggtataatattttgagaaggagttttcttttggcaacatctcccccccctgtctccacagcctggaggtgttcaaccccgcacacagagaaagggggggcccacacacagaaagggggtgggcaacatactgtggttgttttcttggtgacacacctctccctccacacagctgccccccttcctctttctccacagcacagtctcccccacagtgtgtcgccccctcggagaggccccgcgggggggtgtccccccccactataagggagaacacacgagaaggggctcgaaagtgtggaaacaaccctccacggtgtcttctgtaaaccgagactttccggagatgtcccccccacacggtgagaacgctgtgttgggaatatattgaagagggggctatgtgaggagaaactctctctcccacgcgctataaggataactccacacactttcgacccacgcgcctcgagccccctcggagtttctggcctttcttcctgagcctctctgctgagtcctccctttcccttcttcctcgctgaggcctctccaccctctctgagccttctcacctgttcacatgccgcgagacctgtggattctcctgggaactccgagcaaaggcctgcaccgaagaagaggggctgaaaaggctgctggggctgccaccctcgctaattcccgcaataaagcacatctgcccccaaacccctttgagccttcaatttgatggacatttttatacagaaaaccatcaagatttccctttcca

SEQ ID NO: 575922 - DNA, 161 bp, Homo sapiens
cccgttatggcacagtggttaacgaatccaactaggaactatgaggttgcgggttcgatccctggccttgctcagatgggttaacgtatccagatgttacctgtgagctacgtgtgtagtgttgcagacacggtctcggatcccgctgttgctgtgtgctc

SEQ ID NO: 575923 - DNA, 116 bp, Homo sapiens
tgctgcagtgactgaactcacgcctgtttgttcatgtcactcagaagaagaggggcagtgagtggcactgcaaagggaggaagctcagatgtcgactgagaacccagtggtgtcta

SEQ ID NO: 575924 - DNA, 524 bp, Homo sapiens
tcgcaatgtgctggaattcgtgctttgaggcagaacgagacgatgggcaatgagcggctgagcggataagctcaaggcagaagcctaccagaaatacgtgggatgcagccaagatgtgccttgtgtgctagaggacctgccccagattgctgccaaaatcgctgccccacttaccaatggtcgatgagatagtaggtcctcagtggagacacacagtaaggtcacattagaagtgaacttgacttgctggactgagacttgcctgcctcttgtgcatagccactcacaggcgtggacctgtctaaagataccctgatcaagaaggccactggtgtgcaggtagtagaggctaccttgcatgcccactctctatccaacaggcacacccggccctacctcccagacaaccgtataaatcccccagaaaaaacgggaacgatactgcctctggtgacctaatctcgcaagggaccacaagtgctgtgtgtacccggccatactacttggctgtcttcctgtctcgt

SEQ ID NO: 575925 - DNA, 806 bp, Homo sapiens
ggggcattcctgaagctgacagcattcgggccgagatgtctcgtctccgtggccttagtctgtgctcgtcggcgtagtctctctttctggcctggaggctatccagcgtactccaaagattcaggtttactcacgtcatccagcagagaatggaacagtcaaatttccgtgacattgctactgtgtcgtgggtttcagtccagtccggacattgaagttgacgtgtactgaagcaatgggagagagcacatggaaaaagtggagcattcagacttggtctttcagcaaggactggtctttctatctctgtactacactggaattcgacccctcgactgaaacaagatgagtatgcctgccgtgtgaaccatgtgacttttgtcaacagcccaaggatagttaagtgggatcgagacatgtaagcagcatcatggaggttggaagatgccgcatttggatgggatgaattccaaattctggttgcttgcgttattaatcattgatatgcttatacacttacatctttgatgctagcaaaatgtagggttataataatgttaacatggacatgatctgctttatgattctacttgtgagtgcatgtctccatgtgtgatgtatctgagcaggtgctccacaggtgagctctaggagggctggcaacttagaggtggggagccgagaattctcttattcaaacatcgacatctggggtcagcattgaactcttgcactctcttgcactcaaaggttgttaagatagttgagcgtgcatagttaattccaatttacgtactctgttagaa

SEQ ID NO: 575926 - DNA, 414 bp, Homo sapiens
  misc_feature (216)..(216): n is a, c, g, or t
tgtaaactatttgtggctgtgctgcttgagtgacgtctctgtcgtgtgggtgccaagtgcttgtgtagaaactgtgttttgagcccccttttttggacaccaactgtgtcctgtgaatgtatcgctactgtgagccgttcccgcctaaccagggccatgttttaggtgcaactgtgccccgggtcaacttaaccccagtcccaaaaccaagctttnggtgtttcgggcccccatccgcccaccttggggtgaccccccctcctccatggacagtgtgagccccgggccgtgcatcctgctcagtgtggggtcagtgtcggggctgagcccccttagctgcttcagtgaatgtacagtgcccggcccgagctgaacctcatgtgttcccctcccaataaaaggttggcaggggca

SEQ ID NO: 575927 - DNA, 232 bp, Homo sapiens
  misc_feature (30)..(32): n is a, c, g, or t
  misc_feature (102)..(102): n is a, c, g, or t
  misc_feature (141)..(141): n is a, c, g, or t
  misc_feature (154)..(154): n is a, c, g, or t
  misc_feature (177)..(177): n is a, c, g, or t
  misc_feature (227)..(229): n is a, c, g, or t
  misc_feature (231)..(231): n is a, c, g, or t
ctcagcatcctgagtaaggactacaggacnnngcaagacagctgcagattcaaatgttcacaaacatttatgttctattttgatagatacataaactatgtntctcattcttatatacttatattagggcatgggattaangtcaaatagtggnaaattagtagaaataacatatcntatatccaattaagtctccaaaatcccaacatgcactcttctgtatacgnnntnc

SEQ ID NO: 575928 - DNA, 194 bp, Homo sapiens
ggaaagaaaacattagccagggtgataacgtgcccgtgtgttcccagctcactcgggaggctagaggcaggagaatcgcttgaacctgggaggcagaggctgccgtgaacagagatggcaccatggcacttcagcctgggcaacagaagcgagactgtctctaaatgcatgcatgcttgcttccatgcttgctt

SEQ ID NO: 575929 - DNA, 216 bp, Homo sapiens
cgagaaagcacataccaaggccagcaacctcaaagatcgaagatagataagcccacaaaaatgagaaagaatcaacgcaaaaatcttgaaaattcaaaaacccagagagccccttttcctccaaatgatcacaacacctctccagcaagggctcagaactaggctgagcccaagatgacagaagtaagcttcagaatgtggacaaaagccaatttt

SEQ ID NO: 575930 - DNA, 184 bp, Homo sapiens
tactagaggatccttacgactagcccgacagggtagaggccagtaacagcagtggaagagcaggcgccgtaggtgtggtgctccagcacaccctgggctagcgctgccaggaagagctgccagccctcgtgccagtgacagtggctgcctcctgcagctccctgccacatggaacagtgctgcc

SEQ ID NO: 575931 - DNA, 139 bp, Homo sapiens
cgcgctgtctgtccctcgtcactttcctctctctctcacaggtgtccattcactgtacctctcgccgatgtggccgtggctgctcagtgaggactcagtccccatcaaactgactgagggtcacacgacaccctgatgg

SEQ ID NO: 575932 - DNA, 216 bp, Homo sapiens
tcgaaagaggagggcggtcagtgaatgcagaagttcgggactccctgctctaggctcaggccaagacgctgtggtctgggccgaagcccctggcgttctacagagaagcctgtccagtgcacggcccctgtggcacttctcgtgggagcgtgtgagaccgcaggtaggggaagcacattcggtttaccttgtccgtgccgtacaaaatgtcttaga

SEQ ID NO: 575933 - DNA, 141 bp, Homo sapiens
cggccggtccgaaatgtattgagaaaatcataaggaagagaaaatattttactattcattaagcggaagtggatcatcatcaagggcttcagttttcatcaccgtcaggttgagcaggctgagcagagaggggcggagcag

SEQ ID NO: 575934 - DNA, 305 bp, Homo sapiens
cccgggaatttttcaaacccgtccttttccgttaaaagattttgccctttgaaattaaaaaccccggtttatttgattagttttatttttttatttttaccggcttaccagtctccctgttggcggtccttgtgccaaagtcaaataaccccccaagggcgccccccagtttgggtcccatattttttgcccttaagcttttccccaaaaattttgcatgtgttttccccccccttgttaaaatcgattaccaaaaaggcatggctaataattttggtggtgaaaataaataaataagttaccca

SEQ ID NO: 575935 - DNA, 167 bp, Homo sapiens
tccagagtatcccacgacggtggcgcagacatctgttgagacctgacccctagtcattggttaccagtgtgtcaggcaatctggactttccagtgatgccactgagatggcacctgtcaaaagagcagtggttccatttctagattgccagacacactggtaaccaa

SEQ ID NO: 575936 - DNA, 129 bp, Homo sapiens
tgttctttgcgtgaggtaaaggacctatgtatcatgccactgtactccagcctaggcgacagaggaaggttccgacttttcctttcttgtttgtctttttctgggagacagggtctcgctctattgcct

SEQ ID NO: 575937 - DNA, 443 bp, Homo sapiens
gttcttccccaggattccctgactccaaaccagccttttgttagggacaaactgcccaggaacccttattggtgctgtccacccatcccccaagcctctttacatttctaagccctcacctaggcaccacggtgaagccagcagactttgcttatcagaccttgctgcaatagccacacccccattacaaacccccccaccctgcacagggggaggtcatgggaaacataaacaaactttacctacaccctcctgtaataaacgtcacaaggtaatatgtagcaaaattaaccagcaaacaaccccaggatgcggccataggaaagaactccatcaaactcccctccccaatataaacccctcattctgtaagcttggggctacttcctctctgactgttaagggagcagccagcaggttaataaaaagttacctgcctaaaa

SEQ ID NO: 575938 - DNA, 552 bp, Homo sapiens
gatagagagaactcagtaattgatctctttaacatgtttggactttttcctatgcatcctttgaggataacttagtttcatccatgctaggcaaatgttctatcaatgtaccacattccctagccccaacccccaaaaagcaacttactctgaaaccaaaagacagtagaagatacaggcatatacatacatacatacatatgtataaatgttcatacatgcatgcatgtagggccgggaatgaaatatagtatagtgtctttcattgttaaaaagcacaacactccataagcagcctaagttgtagaatggttgtgattaaatcactattatcttatttttttaattgtccattccacactaaaagagaagggggaaaatgtcacttaaaattggtagatttggccaggcggtggtggcgcacacctttaatcccagcacttgggaggcagaggcaggtggatttctgagttcgaggccagcctggtctacagagtgagttctaggacagccagggctacacagagaagccctgtctcgaaaaaccaaaaa

SEQ ID NO: 575939 - DNA, 183 bp, Homo sapiens
gggcgcgaatggcgagccacacggctagggacctgccccaggtgggtgcttttcagcaattcttgagtcccctttcagctaaacacaggacctccttgggttctgtcctaggcttgaggcctctactttccttccaactcctagcctctgaaccctggtggctatcgcccatgccgcctcgcc

SEQ ID NO: 575940 - DNA, 316 bp, Homo sapiens
ctgttacacaacctagggtcagttctgcaggttatagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 575941 - DNA, 199 bp, Homo sapiens
tcccttttaaaaatcagggaaaaaataatttgttttccccttcccttaatgttccaaatgttaagtaagaaaaataggtttagccaacctcccattattttttttaaaaggtaaattttaaattattgtgtcaccccaatattattggcccataaaggtaaaaactcccaaataaaattggattttggggcccccccca

SEQ ID NO: 575942 - DNA, 772 bp, Homo sapiens
gctgatggattccaaaccaggacactagcctgagatctgcacagtcagacggacggcaggagtgtcctggctgtgaatgccaaagccattcatccccacgtcttagggcagtgccatggactttccactgcttcgttatggtggattggctgggcttcagtcttggatatttgtacttgtctgttcttaagctgttcaatcacattagccaacttctcccaaagggaccacaccccatggaggcctgacatcaacccagggagccaccgcacagacaggatgagaaggcatcacaagaacgataggtgcatgaccacaggggcactcatacgggagcctcatagatcatccagccacatccaacaacgggaccaacaggtgcatgagccacacacacagggtcgcacagggctcacaggggaatccacggacggaagccagagaccgagcagagtgcacacaggcctatatcactacaaaaaggagcccgagacaagagcacggacgggtggagggtggccgcatatcacgcccgtcccattaacagaggccggtagaaagtccccgcggggcggagcaaaagacaccatctgtgcgcccgggcccagtatacaccaacagggggacgccaacgcaccaccgccaggcaacaacgagggcgaaacaaacggcaggggggatgcacacaagagaagacccccaagagtctcaccacgggtggaagaacaagggcacccgaaaagaaaaaacattgggaaacccacaagctgcc

SEQ ID NO: 575943 - DNA, 587 bp, Homo sapiens
ggtgtccagtatcatggaccggagtgtaactaggccgtcgtattgcagagatagatgctgatgactgcggaggctgcgcggctcagaagcaaaaagtctcattacttgaaaataatcttgaacagctcactaaagtgcacaaggagttggtacgtgcactaatgccgatctccgctgtgaacttcctacagtggaaccagcgacttcgagctccacgctgagagacgtgacaagctttggaatcagcactgaaacgaagctaccagacaaatgcaatctcatgatcgcaaacgctatcagcaagacgtagatcgcataacggacagcagtcaggtcaaagaatatggacagaagagggcattccgcacagattgctaaacctattcgtcccgggcaacatccagcagcttctccaactcacccaagtgcaattcgtggaggaggtgcatttgtacagaacagccagacagtggcagtgcgaggtggaggaggcaaacaagtgtaatcgtttatacatacccacaggtgtatacaagtactcgaagtacgacgaggacatggtatcaagcagtcattcaatgaatata

SEQ ID NO: 575944 - DNA, 1049 bp, Homo sapiens
gatggcacttgcggggacgccgggtcgtacagagagacgtagtgtccgcctgttgagtgaccaggaggagcataagcagctagtactcgatcggggccctgctgtaatacagagccgctcgatacttgttatcacatccaccctagtaggtctcggcaccttgtcactctgatgcaatatccatgtaccaataggaactgtaatgagttaatagtcatgcgacacttcttcgggagaacatatggacaacacgtacgtagaggcatattcgggacggggcctattgtgcctagtatgtgcatcagctccctgcaacatgtgctgggtagtctattaaactcacacgaggagggctatcggtcgcctttccgaaagatcccccgtcatgcggcctagcctgctggtccgtagagctaaagtggtaacgaacgagctaatgtgggggtgccatgtttacaagtgcgctaccagtacgtatactgcgcgcgaaaaataacgcatagtaagcaaagtgcggtggctcgcagcactccccttctagggtgggtccgatacgcgcccttcggagaaatgctcgatcggaggacggcaagttcctgctcattctcgttcgacattatctaccgacgaacggggaacgccatgactctggagccagagtaagggtctctttctaggagtatcggtggccgggagatgcttcggtcgatcggggaagcgaccagtcaccagaacgggcgatacctaactaggactgcgtcagtcgatctaggccgcaatgcaaggtatagaaccgacagcgtgctagaagaggtggcgccaggaaccttcgtcctttgccggatttgcctagaaaaacccagttagccgggaaagctaaggtggggattaacgctggttaaggtgtccaacctggtgcctgacagtgacaagttggccccaggtggaagggaaagcgcgcgtgaccacgatggctaaagcccgacaacacaatggtgcggggtaccgagaaaaacaacggcgcgaggttgacacaagacgcgggcagg

SEQ ID NO: 575945 - DNA, 904 bp, Homo sapiens
gcggcggctctggcacccagtgtcctggcctgcgccttcccgccaggcctggacactggttcaacacctgtgacttcatgtgtgcgcgccgtgcacacctgcagtcacagctgtagccccctctgccaagagatccataccgaggcagcgtcggtggctacaagccctcagtccacacctgtggacacctgtgacacactggccacattgacctgtggccgcggacctggcgtctgctgcgaccaggagcccttacctcaccctgattataacacctgaccgccacctaactgcccctgacagaaggagcaatggccttggatcctgagagtggcagaacccacgcgtgctgttcggagaagtggctccttggagagatcagacagcggctgctatgagtgggctgcagtggcgtggacgaggcccgaacctgttatccgcgtgccctggaagacacttcgcgcgcaaggacctgagcgaggacgacgcgcgcatcttcaaggcctgggcatgtggcccgactggcaggtggccgactagcagcaggggaggtgggcccgaccacccgagggctgagactgcggagacgcgccgggttggaaaaccaacattccgctgcgcactgggacagacacagacgtcagatatcgtgatgctgcgagataaactcggggtgacccggccagaaccccggcagcaaaggttggaacgggcgcggtcacgaccggggaaacatgttgcttgggacgaagggacccagggacacgggcacaagaactagaaggcacgacaggcccccgaaaagcagggccacaacaaccaaagaggggggaaaccacggggcaaaacacggtgacaaaacaggagtgtaggcactccagaccccagggaccgctcgagtgaa

SEQ ID NO: 575946 - DNA, 258 bp, Homo sapiens
tacaacctataatatcgggcgaccatctagtgatctcttgatccaactatcgaggtcgtcgaccctatttttcatatggactctagaacaggattgtgctgttgtccctatggtaacttgttccgttgagctccaattattggatcaagtatcatctatagtagttcagctttgacttggtggttctctttgctatgtcagtctcggacgttggtttctgttccgatctcgtcaccgacctcaatttcttatgcatgt

SEQ ID NO: 575947 - DNA, 311 bp, Homo sapiens
  misc_feature (13)..(13): n is a, c, g, or t
  misc_feature (66)..(66): n is a, c, g, or t
  misc_feature (156)..(156): n is a, c, g, or t
atgtttatatggncaatatgtacatgggtgtatgttaagagcatgagccatccacaagattttagnaaagtccatttggaaagctcaatgctttgggcttccacttgctttgctgcctctgtcctcagaaggaggcttcatccttccacgtaaccngcaaatcctttatgcagagatgtacacaacacactcctctccttggctatgacaccttgaaatggtcctcttggtggcccctggtgctcatttcagagtagttcaaattaaggtgatcagctttcatgccaataactctacccccggaagttcca

SEQ ID NO: 575948 - DNA, 369 bp, Homo sapiens
cttgaccattcaacttcgaaactttaacatcaatggatccagcacacactggtgtacggtctgctatgcatgcagcctgtgctaggcaacagaagtatcagaccaggaactgacagcctcactgccacaggaagagaggcttcacacaataagcgtttcattcaacccaggctggaccctgtgcttatttgagttgaaccatcacttgggcacaaagatgcaagcccagacacccataaagagctgtaagggctgatcacagatgtctttctaccctcgaggagctctaaagtgtgggtcaggacgagaacacacatgcatgcaacccaaggggggtacccgaggctcgcaattccgtacatcattggt

SEQ ID NO: 575949 - DNA, 429 bp, Homo sapiens
  misc_feature (60)..(60): n is a, c, g, or t
  misc_feature (81)..(81): n is a, c, g, or t
  misc_feature (88)..(88): n is a, c, g, or t
  misc_feature (207)..(207): n is a, c, g, or t
  misc_feature (300)..(300): n is a, c, g, or t
  misc_feature (377)..(377): n is a, c, g, or t
  misc_feature (387)..(387): n is a, c, g, or t
agagagagagagagagagagagagagagagagagagagagagagagagagagagagaganagagagagagagagagaccanatttganggccttcaaacagatcctgcccagccaacatttctaagtcctttcctttgccctctgcttccttagaacttgccccagaccccaaatcagggaggaagatttgaacctgcctcctgtcntccttgcctggctggtcttgcaataaagtctttcttttctcaaaggcagtaccatggtattgcttccgtgtacattgagcagtgagcctgagnaggaaaatagggtcaggaggcagggaacataaggccaattcacacttcggctgtaacaggaaatatccactccatanggccgtatcntgtaagtgacctttgtaacctttacttcatcctctgcattta

SEQ ID NO: 575950 - DNA, 1701 bp, Homo sapiens
  misc_feature (786)..(786): n is a, c, g, or t
  misc_feature (1113)..(1113): n is a, c, g, or t
  misc_feature (1324)..(1324): n is a, c, g, or t
tcccgggctacctgcagaggggtccatacggggttgtcctgggatccccgtcgtaatcttaaagggaaatctttcacaatgctccggagcccttgagtgtccgtgcaaattgaaggaggaggagtgtcctataagtttccttgcagcaggaacccactttagggtggcaccaattcttgacttccagaagtggaacagtacattctataaaaggaaaaggtgagtggccactctatattattcaataaatctcctcaacgaaggacctggggaaaaagcttttcgtggcgtggcagcctccggtgcaagtgggtgtgccatgtgtgaaaaccctgtcgtgatgtgtctcaggtgtttattattcctctccgaggaattcacgtggcccaagagagggcgtgggtgcgtgaaagttgtggcggtgcgtgcccaactgtggggacgcccaacctcccaaatgtggcgtgggccgggttctcacatctcctgtggaaaaccttttcaacttaaacccgagaatcccgagggcaagcctttccgggggaggcccacgcggtgttcctgtggtggggtttatctggggccccccagggggtgctggacacaacacaggactcttcttacaagcggagggggcatctctttatctgtgttaaaccctcttaactcttaacacatgtgggggggcctggtgggtaacccacacagggtatttttctccctcttcctgtgggcgccatatgttgcgtgcgacccatttgtgccaattcccccattgtggcgaanccaaaccaaagggtggaagggcctccacactccaggggggggggtcacaacaaggggggggggggagaaatcgccgtggcctccgggagaaagatcccctgggggggccatttggggggtggggcaccccattttttccccgggggaaaacaccccccagtgtggggaggggtccgaggggcgctagaaatacgtgggtaacctcccctacaccagggaagaaattctcctggaaagcaacgtatttggccacaacacgacgaaacgaagcccaggcggctcgtctgcgctctgacaaaaacggcggctgctgtgcacccccacggnggggaggcgaactctccccggcgggggcacgaattgggaactgtggtccccccgggcgccctgagaggtgtcccccgcgggtaacacccaaacgcccggtggggtgcgttgtccaacaacggtgtgtccttagacaaggcggtggtcacacgaggtggtccccccctgtgtgtgcgcatatatataaggaaaaagttcccctaactgaggnaagaaaggggggggagcgccaacacaccgtgcacggcgaaaaactcggttctctgggcacccccccgtgtttccgacgccgctgtggtgtggttgtgtgtgcacacccccactcggggtggttgtttgacaccatgcttgtcagtgataagtgtcctcaaccacgcagcggaagagctgtgtgtgctggggaagcacacacactctttctcgacaacaaacaacgggcctcttctttgtcgtgggcaggagagaacggaagctgctgttgttcacaccatctaaggaagaggccctgattagacgtgatacttgtcttctgctcgacatcatgtgaatcacgaatgcagactactagtatcagtcgtaatctaatca

SEQ ID NO: 575951 - DNA, 448 bp, Homo sapiens
tatgctggactgacaatggatgagaagtgccccaggatataccccctacagaactacattttggggagaaatgtgttccacacaaaagtggacgaataggacgaatgccgcaaagttgttgccggaataccgcatggagacagggggccatgattgcaccttcctggttcgggagagctgagagcttccccaatgagtacgccctgtgcttctggcggtcaggccgggtccagtacttgcccggagtcggtccaccatgaagggctgggatccttgaaatacgtacttgtatttgacgtcctctactttctgcaggggtctcagtccctcattctaggatagcgccgagacgcgcctgagccgggccgagttcgagctggggctcgcgtgacctttgggcaaggccaagccccacgagtcccagccggtgtcctattagagcctgggc

SEQ ID NO: 575952 - DNA, 375 bp, Homo sapiens
gaagagctattcgcagagaaacagctcgcacaaaaagccaccgccccgaaacccggggaaatctgtttcctgtgaaaggcctggctccgggcatggcggtttccctgatcctctctcccaaattttccggcaggggattgactcgagggcgaccatctaggactgcggtgggccagggagtgtgcggttctcgtcccaaggttacaggtgaggacgtccacggccaaggccgttaccccaagatcgcgccgcccttgttagcttgcacggagggcgcccgggaattcgaaaccaacggctgtggccccaaactcctaagccctgcggaaggttcttgttgggaaacccggctcatttgcaccaactcttttgggt

SEQ ID NO: 575953 - DNA, 1000 bp, Homo sapiens
caatgaattgagaagccgcgactaagggaagatggagacaatactggagcagcagcgggctatcatgaggagaaggaacggctcatggcacgtcatggctaaagagatgctcaccaagaagtccacgctccgggaccagatcaattctgatcaccggactcgggccatgcaaagataggtgatatggaggtcagtgggaacctgagggatcagtatgatgataaggatggattcacgaacggaggagctcaatgcacattgtcaggacccgaaatgagttgctgtaatactataatagaatcatgcgatgtacaggaataccgccggaagggacccaaatgaggatctgtgtgccctaatgtcaggtggagtctacgaggaactgccctgaaggctcgcatgagaatccaagtgtacaagaggcacgaaacttggggacgttcacagatgaagagggacatggtcgttatctcgatctcgatggatgtctcctcgaagtacggtaatcggaaggcttctgagacagctggcatgatatgacataccttgtggcattcttgaacagtttattccgacgttcctcacggaaaggaagaatgcagagtataggagatagctacaagatgctgcttgacgtgtcatcaggatcacaccgatagagtgaagcctctccaagatcagactgcgactttgggggaagaatccgggaatgagacggggaacgacaggggacgaactggcgaacctcaccaggaagaagcggagggaaaacagccaggaccccgcaagcatgagcaagccccccacaggacgcccagaatacgcactaccaagagaggcgcgacccagccgaggcagcatgcaaccggccaccaacgtaggagaacgcggcggacccacaacacacgccgatcacaccagaaacagacaccaaaccgtgaccaagaacctgggacgcacgtggcagcgcacaccaccgaaagcaggaacacccacacaa

SEQ ID NO: 575954 - DNA, 100 bp, Homo sapiens
catcgagctcgacctattcacttcaccatttagtataagaacaagcactacctcatgagaattcacgtgtggggtggtatagagtggtatggtggtatag

SEQ ID NO: 575955 - DNA, 210 bp, Homo sapiens
ggatgctgcagacactgaaccgaggagccagttgacaccagagccggaggtggacccgcccagttgcccccgagcttcaagcaagggccttgattgagcttttaacaagcaacttttgagcttcaagttgcaacaggcggaccactttattcaagtctttcgctctccgggtgtgtgtccaactacaaaagccgtgattccaaccttggg

SEQ ID NO: 575956 - DNA, 751 bp, Homo sapiens
  misc_feature (736)..(736): n is a, c, g, or t
gggagttccttggcagaaacggtacggtatgccagatcctagcctgccttgttggttttgaaggatttccatcttgttacaagatgagaagttacaggtcatctcccctgttcagatgaaacccttgtttgtcgcaaattggttacagtttcgtttttgcctcccatggttcacttggctctgaacctacagtctcaaagattgagaaaagattttgcagttaattaggatttgcattttaagtagttaggaatctgcccaggtttttttttgttgttgttaagcattgatttggatagatgcacggaaagttatcttacagcaaactgtagtttgcctccaagacaccattgtctcccgtgttaatcttctcttttgtatacatttgttacccatggtgttctgtgttccttttcataagctaataccactgtagggattttgttttgaacgcatgattcgacaggcacgcatgtagcttagtagctcggttcccagtttgccatacaatgtaggttctgcttaatgtgacttattttttcgccttgaagcagtttgcatgactattagtggttcaaagtcaatttttacaaatgcacaagttataaatacagaagaaagagctaacccaccaaacctgacaaggacctcgcggacactttcatagctaagactataagtagatatcacgttgtgcgtgtattgtaagttgatacaacatctggatatacacganggcactgttgcaatt

SEQ ID NO: 575957 - DNA, 326 bp, Homo sapiens
tgacgccgtgattatgcataataatattccctccactgcgtctttacatggtttgacgggaagcctggatttctggatatgagctgtagcagacatctcctcgtttgcgtggaataagcttttttaatcagtttatctaaagcatagttgatgtagacatttagattttaatgttgattccaagcaagagtcaacatttgcttggaatagcttttttaatctctttactctcagtctctgtgtgtggttaagtctcatgtgagtgtctcgttagtggcgccatatcgtttactattttttggttcttttttttttaatctaattgg

SEQ ID NO: 575958 - DNA, 251 bp, Homo sapiens
tttacacaaaccggtgtcagttattgtcattatcagtattacatactgtacataactgaatgtgctgtacttttatacaactggcagtgtagtaggtttgtttacaccagcatctccacagacacgtgagtaatgcactaggctatgacattaaaacggctaaaacatcatgaggcaatagattttctgctccattataattttatgggaccactattgtatatgtcattatgcagtacataacgtcgacg

SEQ ID NO: 575959 - DNA, 133 bp, Homo sapiens
  misc_feature (83)..(83): n is a, c, g, or t
gctagaatgcgcgaacacggacatactgtcacccgggtgacagcccgaaagccctggactgggaaaacccatgaagccctggncgtttttttaaacaccaaacctttccaaccggaatcgcctcagttgatag

SEQ ID NO: 575960 - DNA, 476 bp, Homo sapiens
ctgtcaaccggggcgtatgtgaagcagcaaggtcatggcaggcagcaataacagttaaggctatgtccagtccaaatctcccaaggtacctaggcagtgaaatgtccatgataaagagacccctcaagacagtttggtggcccctgtccagccgccttctcagacatttccacctccctccctcccctcaaaaagtgttgcaatgcagcagaagcccacggttaatgtccggcccatggatggtcgagatcgggcccctagtgaactccctgaactgaaaccagtgccggagcagtatcgacagcagacctttgaaaaaacagagttgaaagtgcctgccatagccaagttcaccaaagtgaagatgccttctcagtcagttgaggcagacctactccaatgaatgtccattgtgtcgcagagattctgaaggaaatgacccattcatgatcgcctcctttgacagcgatagcata

SEQ ID NO: 575961 - DNA, 390 bp, Homo sapiens
attagatccttaaggcgacgcgggtatgcacgggtaacgcgctcggtctacgggaagcacagaccccctgcagaagagccagctccacatctggagctgcaggaagagaactttcttgggtgctctgtgcaaagggcttgtgattgtttcgcccgtaaagcaagccctgggaagaggtagagttccgcacgagaccacgggctcactgcttctgctgtgggagccaggataggaagtcccagaacaatgcctctgggggctcttgcagccaggccagctgtccctagagcaggggaacctccccctctaacaaggtggtctttcccattcccacttagactgtgggcagcctccctggaacattccccagggatgtccaacagtctccca

SEQ ID NO: 575962 - DNA, 765 bp, Homo sapiens
  misc_feature (92)..(92): n is a, c, g, or t
tctggaccttaggaatttcctttttatgggaaccttgctcttgggggggtttcccatatccctcggattccagtaaacccggggatcttttnatgcctctcccagcttctgcccggccttgttgcatgaggattcgcccgtcccttcccgattggagagttttctggagcccatttggacccaattccatccactccggtggtatgcgtaaaccatccccaaagaaaggcccagcaccctggaagaatttgaatgggccacacccgttcaatcgtgcagttcaaatgaatgggaaattccccccttggtgtccacatgtgggtgttcccggcgcctgtgaaggagaaggcggaggcccaagcacggggcccccctgaaggctgtccgcccagggcaactgtaagcccacggagcccgtttacccaggagaccacccaccccgtcgcccttctccgtatgctgcctgcgccaccgaagagctttgtctgggccctggctttccctgccctctgccttcacctctgtcagcacggtggccttgcctggggagccccacatgtgtggcccacccccacccacggccacatccccactaccttctggtttgaaggcgctgacactggcagagaggtaaaagggtggggccttgagaatggaggctccccgggtccctgcccccttctgttttcctaatgtttttttctataaagggtcaggcccgtcagcatcactgatggggattaaagtattaatgctttgtgacca

SEQ ID NO: 575963 - DNA, 249 bp, Homo sapiens
caggtgccggtccgtatcataaggacgagcaacactgttgctgcccggttccactctgaggagcccgtcagtcttcgaaatttgcaagttcatgagaagagccgaaaatatgcgccgtacgggtttcatgatggctgcgatcggggggggtgtctgcctcggcgcccaggcacagtcaagcggcgagacagctgccgatcgctccagactcacggtgggcgtcggcgctgcgaccctgccggactatga

SEQ ID NO: 575964 - DNA, 472 bp, Homo sapiens
  misc_feature (49)..(49): n is a, c, g, or t
  misc_feature (62)..(62): n is a, c, g, or t
  misc_feature (80)..(80): n is a, c, g, or t
  misc_feature (178)..(178): n is a, c, g, or t
  misc_feature (238)..(238): n is a, c, g, or t
aacaaaagctggaacctggcccgccctcgaagggtcgggcccttatggnccggctccctatncacattcatatccctganctgactttctggattgggcgaactagttaaagaatttgtagatctgaaatatgactaagcgccttcatgtacaagaacactgccaagaatttccctcngcccttgggtgtcatatttttgatgacccaggaagcggaacgatctctaaagcccaatanactatttatgtacgccagaaacacacatacaccaacatatgtctggaaactcttttctgacactcttcccctccccttgagtgttggctggacttagtgagtgatgctgtacactttctaagacaaggtcataacaggcactatggctttttctgacttcctgacccatgtcccgagtgcgatctcccggccatgatcttttttttttttttttttgcgatggagacctgctct

SEQ ID NO: 575965 - DNA, 472 bp, Homo sapiens
accactcctatagatcagtatctagagaatccatttatgaatgacagaagaagcaactctaatacaaattgagttgggttttaggatgtggatatataggtagatgtaggtataaactgccatttgcaaagctctttacagtataccaggcactttaacatacattctataactaaacagggaagaaatgtgttaaattacctccaatttatagatgaggaaactaagatttagagaacctaggtacttccctaagattgcatagctagtcagtagttgagccaagacttagattttctgtgtattctttccacggttccccattgtttttattccctttagtgatgaaagagaatataagtgctgtacagaagaatacatagttcagaaagtagaagcgtcaagaagacatctggggccttctgtagagaaacggaagtagccgtctgtacactgatctataggagtggtg

SEQ ID NO: 575966 - DNA, 108 bp, Homo sapiens
gtagaaactgagctgatgaggcgtattataccatatccgcctagctttaaacgagtactgcggctaagttactattgacccagcagatggggcgcttcgatcatggcg

SEQ ID NO: 575967 - DNA, 165 bp, Homo sapiens
  misc_feature (1)..(1): n is a, c, g, or t
  misc_feature (129)..(129): n is a, c, g, or t
ngtactctacagatcttataaaggcgagtcgggtatgaggaggaggagctgtggccccagcactgtggcaccaggtggctggaggaggaggcgctctgcagtggcctccaccggtcactggagccccanggtcaggtggctgagcaggaggaggctgctgccctg

SEQ ID NO: 575968 - DNA, 288 bp, Homo sapiens
cccccagcctggtagggggggacaagcccaagtcatttttgatcccccccttttccccccccagatcccaggggtttttcctggggttttggaacccccctcattcctttcaaacccaaagggggaattattggttcatttggctttattcaaatctagttatggatgggcccaaattatttgggccaaatttgaaatgtttttttttttaaaattaaaaaaagcccaaagtccgggggtttttaaaaattgttaaaattaaggaaaaaaaaaggtgaattgggtcca

SEQ ID NO: 575969 - DNA, 224 bp, Homo sapiens
  misc_feature (10)..(10): n is a, c, g, or t
  misc_feature (18)..(18): n is a, c, g, or t
  misc_feature (33)..(33): n is a, c, g, or t
  misc_feature (54)..(54): n is a, c, g, or t
gcttgcgggnctaacctnaagcatatgaggagnctttgcccggttcctagtggnataagatcttgtaaaccaccaaagctttcctaatgaagaaacgatgtggacaaaattaagctagatcaagagaccttgagagcagagaacaaatcccagtgttgctgatatatggcttctgcttctcttgtgtgtgcctcagctctgaagaagttccctgaaatgggtta

SEQ ID NO: 575970 - DNA, 1158 bp, Homo sapiens
gacagagcccgggccgaatggcatccttcctctgccaagcatcttcctgcattcctcatcacagccggccgagacaccgcgccttgccatgagtcctccaatggcgcgcgactgcaatgcatacttcaatccagttctagccccccctagctagataccgcctgtgactacctgtcagaagtggcaacattgttttgcttacactagctacctggatagcccgactggccgggcgcgacagtaaggaggcgtcgcgtgagcactacatgaactgcgctgcctagtgacttgacagaccctgtgtgggaattcaacccaagaacatccaaagtgtgaacgtgaaagtccccccgtgacctccaaatgatgcaccaaaatccagaagtcaatagacacaaaactcaagaattgggcggaaagcttggcctcaatcctgcataaccccatagttaacgaaacatcatcgacaaacgatgctgaacagtgactagatccaactgaccaggaagggaggaggaagctcactggtggctgttcctgacaggaggcccttgcccttgatacgcacacagaacgaggcacagcagagacgacaagctgacagagggccaccttggatttgtgcctaatggtgtaacgagcatcggcttaggaagaaggtccttcataatacactaattgcacttcattagtgctgacgattctactcggtctcacgtaatctctacaggctgcttaccaagacgttcaagcgcggattgaattgaaactctaaaccgttccgcacgtggtccacacttgataatgccatacaactcgggagactggtgcgagaccacacgaggttaggatgcgacacccggggaattccacattacaagcctatcgccacgggtcgcaattggttctccacagtgtgcgaccaaagaccatcgaagctgaaaagaactcccaggacgagagactggcaaacatgtgccaacaccacgcggggaaaagcacgcacgggaggcatccacagccaacacggggcacaagcagacacaaccgcagacaaagccacgggcgaccaggacgacacaccagccacgacaacggaaggagacgaaaagagcagggagcgagcacgcacagacgaacaggacaacaaagaggcga

SEQ ID NO: 575971 - DNA, 200 bp, Homo sapiens
gtctgaaattgaagatatgcttaaagtccttcagaagatgactataagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtacggttgca

SEQ ID NO: 575972 - DNA, 722 bp, Homo sapiens
  misc_feature (317)..(317): n is a, c, g, or t
  misc_feature (324)..(325): n is a, c, g, or t
  misc_feature (415)..(415): n is a, c, g, or t
  misc_feature (430)..(430): n is a, c, g, or t
ggaagtaggaaaaggttatcacaggttcttacagctgtggttggtgcctatctttctatgatatgtaaatatacgaaaacccgtaccgactcctagccgtccagtgggtgcagtgtgcaacatccaagtcaacaatccagtgcactaggaaggaaagggctgggtcaaccaaagactgccatcctggcttccctcagtctactatctggacatgcaagatcaaactcgcagagaatctcaatgtggaagcatgaacagaaagaagaggaattctcactcgtcgcagtgggcctagtagagcggagccatctagcggnctcctanntaactctctccacgagtgagcctctcgagaagggtaagtgacgacgcaggggctagggtgttctgtgcactcctagcgtatggacaagcnggttacacgagcagngttcttccggaggggacccccacgtcaccttgcggcgcaacacaccacttgcacccgcaaaggccccctcaccgagtgcctacgtcattcctcgaaagacaccatttcatcaacagacacactcttaggacatggcgtggttggtgggcgctgagggcttgcttagtggaccctcgattgcaattccctccacggtcatcaacttccatcgcggaaagggccttggggacgtgcccatgggcacgaaagggcacgcgactgggggacgcgtttctgcgcccaccggttggca

SEQ ID NO: 575973 - DNA, 180 bp, Homo sapiens
atagtggcgcgggtcgggcggactgttaggacaggacgtcattcattccgacatgccacaggggcaggctgatggggttgagctgacactcagcaatcaggcgcccgtattcctgcccaggggggaggtagaaatgttagcatcagctgggccctgagacaagcattcatgtgcccgtcg

SEQ ID NO: 575974 - DNA, 550 bp, Homo sapiens
  misc_feature (173)..(174): n is a, c, g, or t
  misc_feature (177)..(178): n is a, c, g, or t
  misc_feature (181)..(181): n is a, c, g, or t
  misc_feature (195)..(195): n is a, c, g, or t
  misc_feature (201)..(201): n is a, c, g, or t
  misc_feature (203)..(204): n is a, c, g, or t
  misc_feature (221)..(221): n is a, c, g, or t
  misc_feature (238)..(238): n is a, c, g, or t
  misc_feature (240)..(240): n is a, c, g, or t
  misc_feature (244)..(244): n is a, c, g, or t
  misc_feature (260)..(260): n is a, c, g, or t
  misc_feature (264)..(266): n is a, c, g, or t
  misc_feature (269)..(269): n is a, c, g, or t
  misc_feature (271)..(271): n is a, c, g, or t
  misc_feature (273)..(273): n is a, c, g, or t
  misc_feature (275)..(275): n is a, c, g, or t
  misc_feature (277)..(277): n is a, c, g, or t
  misc_feature (322)..(322): n is a, c, g, or t
  misc_feature (335)..(335): n is a, c, g, or t
  misc_feature (370)..(370): n is a, c, g, or t
  misc_feature (389)..(389): n is a, c, g, or t
  misc_feature (391)..(392): n is a, c, g, or t
  misc_feature (396)..(396): n is a, c, g, or t
  misc_feature (398)..(398): n is a, c, g, or t
  misc_feature (404)..(404): n is a, c, g, or t
  misc_feature (408)..(408): n is a, c, g, or t
  misc_feature (419)..(420): n is a, c, g, or t
  misc_feature (423)..(424): n is a, c, g, or t
  misc_feature (427)..(428): n is a, c, g, or t
  misc_feature (430)..(430): n is a, c, g, or t
  misc_feature (432)..(433): n is a, c, g, or t
  misc_feature (436)..(436): n is a, c, g, or t
  misc_feature (439)..(440): n is a, c, g, or t
  misc_feature (443)..(446): n is a, c, g, or t
  misc_feature (449)..(449): n is a, c, g, or t
  misc_feature (451)..(451): n is a, c, g, or t
  misc_feature (467)..(468): n is a, c, g, or t
  misc_feature (477)..(477): n is a, c, g, or t
  misc_feature (484)..(484): n is a, c, g, or t
  misc_feature (509)..(509): n is a, c, g, or t
tccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaannaannatnaataagttttattnaaaatntnntaactttatttaaaatnatttttaacattatgananactnctcagattctaagttnttgnnnttntntntntntttttttttaagttctcatcattattacatagactgtgatgtatntttactggaaatnagcccaagcacacatgcatggcatttgttccacangagggcatccctggggatntnnctgncncatganccanctctgtcccannatnntannancnnatnatnnaannnncantnaagtgtttaggtgaannaaaagtagntaagcangcacgcacttcagcgcaccacagcntaagcctgcaaacagcctctccaagcgcgcttttcacctta

SEQ ID NO: 575975 - DNA, 177 bp, Homo sapiens
gtttagcttccgggcccctcgcttgtttggcctcctggggggatgggtagttgctgggttgtgggggggggaagcccgcttggggtttgggggccaatctttgttagcctttctttttaattcccccggggggtcttagggggatctggttctccccgtctcttgttaaaaaaaaaa

SEQ ID NO: 575976 - DNA, 139 bp, Homo sapiens
gtatcccagactactcagtgttactagaggcaggagacattacgtgtgggcgtgaaccctatgagaggctggagcttgcatgtgagcagagctgattccagtgcactccagcctgggcgacagagcaagactccatctc

SEQ ID NO: 575977 - DNA, 620 bp, Homo sapiens
agtattatggtagggatcttgaagaaatctggccgggcacggtggctcacgcctgtaatcccagcacttgggaggccaaggcagacggatcacagggtcaggagattgagaccatcctggctaacatggtgaaacccagtctctactaaaaatacagaaaaattacctgtaatcccagcacttgggaggctgaggcgggcggatcacagggtcaggagatcgagaccatcctggctaacgtggcgaaaccctgtctctactaaaaatacaaaaaaaaaagagaaccccaaaaaaaaaagaaaaaaagaaaaaaaaaatagttgtgtggggccggccgccgagaccgcagagaaaggttgaagagaccactgtgcgtgggagcgggagcgccacccaaagtgacgtaacgagcaacagcggggcgacatcagagtggtccccaaaagaaaaactcggcggagcagaaggaaaaggcggcgggaggtacgcccccccagaaagaaaacccgccggggggaaaccacaggctttcagacacacctccaaggaggacatcaaggagacaaaaggggactcaccacggggaggcaacaaggaccagataaaaatacgccgacggg

SEQ ID NO: 575978 - DNA, 466 bp, Homo sapiens
  misc_feature (6)..(6): n is a, c, g, or t
  misc_feature (47)..(47): n is a, c, g, or t
  misc_feature (62)..(62): n is a, c, g, or t
  misc_feature (94)..(94): n is a, c, g, or t
  misc_feature (190)..(190): n is a, c, g, or t
  misc_feature (457)..(457): n is a, c, g, or t
aaaaancaacggtgacaccttcaaaaccccaccgaggtttaaaatcnccctcactgcccganaaaaggcggccctgtgtacctttttaagaaanaggagtgcctgtttcctatacctaacccagtcaggacctagtacaagatgcctgcctggaccgaataaatgaaaaagcttctggccgggtgccagntgtcacgccctgtaatccccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacagaatttgnctccatctc

SEQ ID NO: 575979 - DNA, 290 bp, Homo sapiens
gcccccggggaggggcctttccaccgaggcctcaaaaaaatccctgaaatcgggggatggttgttgaaattgttttccttgtgcttgggggattgaggcccaaccccccccccttttttttccccaggggttggggttttttccccaggccggccccccagctttcccggggggggggggggggggggggggggggccctttttgttccctccccccttctttctttccccttgggggcccccctcccccgcccgattggggatttaatttccggggccgggggggggga

SEQ ID NO: 575980 - DNA, 1315 bp, Homo sapiens
  misc_feature (1315)..(1315): n is a, c, g, or t
gctgaccagcagcatgggcggttggcaagaacaagcgccttacgaaaggcggcaagaaagggagccaagaacgaaagctggttgatccattgtctaaggataagattggtatgatgtgataagcgcctgctatgttcagagtataagaaatattggaaatgacgctcgatcaccaggacccagaggaatccaaagattgcttctgatggtactcaaggtgtctggttgtgtattgagaagtcgaggtcttgactagactttgcatgagatagatgaagttgcagttttaggaagagagttcaagtctcgattactggaaagatggttgcaggggtataataactgcgcatggagctcaacttcgcatcgtgctatgggatctttacgccgtggacaacacatggtgtctccagtggtcaacaaaatgggcagaccaatgattgagagctcacgtggatgtcaagactgaccgagtgggtatacgttggctctcgtcctgtctcgtgtgatcggggtcttgacttgaacaaagcgcatctcagaatcagtatacggcaatgaaccgtcttgagtggctcagccagcgcgaagagggtccgaccaacatcgcggaagaagatgatggacaatcatgatgccgagaggtgcagacgaatatcgacgttgaaaagaaagtggtcaattaaacttgagttccagagcaggcatgtggacaagacgtagcaaagaggcttgccaatgctattatatgcctactcccgatgatgtcttcagtttagagccagttccaggatgctgcaaggaaagcccaaggtttggaattggggaaagctcatggagcttgcatggttggacgggcaggaattctcggagcagccactgggggaccagacagggcgaaagttgaacgagcagggatggcaatttgagcgcaccaagtcaaggagccgggtgcaaagagatcaaaactacaaatctggcgagataaaaacaacgaaccacgcgaggcgtcaacaacgcaacaaccaacggaaagaccccggggccacaattaacgacgggcgcaacacaacacgatacagaaagggcagagcggagacacactcccgaagaccacactgtggggcaagtggagagcacagcaccggacacctcacgtgcagccaacacagaacgcgggacgacacacaacacaaaaaaggagcaacgagagcaagccagaaaacagccaacaccaaccagccgacgtcagcgaccgccacaccaccagacgccccaccacaaccaccatcgaacagcagatcagacacaccan

SEQ ID NO: 575981 - DNA, 814 bp, Homo sapiens
taaaccaatgtttatttattcatttttcccctctcttataaaacccccccccacaccgaggaaatttattgggaggggtgccccaacctagggcctggactctgaaacccttaactctccccacttctccctcattttggtgtgacttatagggtgggggcaggtggtttcagctccaaaacgtggtgtgctcctccctattgtggactcggtgcagaaggaggcacctaggcacacacatttgggtggtggccccccccaggagggtttgaatgtggcaggcgtgggaaagaaccaaaagagtctctctcccacatataagagggccacctttatcccccctctaagagagagcggggtgtggggcagtctgtggactcgctgcgtggagacacagtgtgtgtgttgctgtctgaggggggtgagggcgaagagcagttataatctctccacagtgcgggagggagagcctataatgtgtcgccaaaatgtgtggcagagagaaacaacatgtgcgaggggaacgttctcgcccatatcaccggcggggccacctcttggcggggtctcacggttgggggcgcgtgtcctgaatatgtttctcttggtgggcgtgtcgcgaaaagcgtgcgggacacagggtttgcacccattagcgccctctcatatggcgccacaagagtaggccccgcgttttacgcgaagtgtagcgccccccgtatacccccctttggaccacaatttgggcggaagggggttccccctcttcttccacaccggggtgccacccctgtgggggggttcctcccgggtt

SEQ ID NO: 575982 - DNA, 448 bp, Homo sapiens
  misc_feature (296)..(296): n is a, c, g, or t
actctcgacttccgtgctcacgttctttcatgcttagtatccccagatgttctttggcgggcttcttctttccattgattctgtcatgacggtagacttctgttgtcaccttcatcttacggattttagctcgaaccttggattccacctgtctccataaagtaaagatgtcttccaggacaattttaattccttcctgtctacggcggttggacctcctggctctctgctgtacatccgtggatccatcatgtccattttgagacgggaagatagtcttcaggaaagacacacanaggtaagttgtgcagagggagatggcacatttataacttctcagaaacacagtaatgataagtaaccaaggacttccaccagagtcagtcccacgatgacgatggtcagccagagtattgataacccaaaggtaagttgtgcagagggagat

SEQ ID NO: 575983 - DNA, 313 bp, Homo sapiens
ccccctttttttttccccgggggccaaagggttccggccctgtttgggggggggggtttcccccttccccctttttaaaaggggcaggcctttttgggtggtccctttccccttggggggggggcccccgggggtttttcccccccccctggttttttttttttttccgccccccctttgggtttacccccgggaaagttgggggggtcggcccgggatttggggtttggtttttttttcttttccccccaaagcccccccctttgcccgtttttttttcccaccccggggattaggggcttcttttttttta

SEQ ID NO: 575984 - DNA, 296 bp, Homo sapiens
  misc_feature (70)..(70): n is a, c, g, or t
  misc_feature (91)..(91): n is a, c, g, or t
  misc_feature (176)..(176): n is a, c, g, or t
  misc_feature (202)..(202): n is a, c, g, or t
  misc_feature (242)..(242): n is a, c, g, or t
  misc_feature (249)..(249): n is a, c, g, or t
gtaggagaaccaggatttgggcaaggttctcacttggcaccagctgtcattcatgctttgggtttactgnatatacattagacattcctgntctttttggagttagtctacatcccctgaagaaacatgtgcccaggtgattcgtgaagctaagagaacagcaccaagtatagtgnatggtcctcatatcccgtgtggtggntagttggcccgacctttaaggcacattaccacattattcngaatatncttcattgctcaagtttactacttgcacttctgacccccttcccttg

SEQ ID NO: 575985 - DNA, 1694 bp, Homo sapiens
cattgcaccggaaaaaatggggttgcttccaaaaacccttcaccacgccaatttccagagcatagtaaagtaaagacccttgagaagatgagaggatggaatttagtatataagttaagcagctggatttagataggcatgtggatagttaatagatgataacagatagcatgcatatgctggtagatggggggttatagtgggagtctgatattctcatgtcatcaattctgttgtctcaaagtagaaaacaaggtgctaagctaacggaatacaagaaaaatattgtgaggttaaggaacaaggagaaagtacaaaatactctctgagatataggtggaaaaaatagactaagattgtaataagtaattttgtggcataattaaaaatcaccctgagatttgtggtagtttttataaattgaaagtgaggccagggaaatttgttagtttgttttctagccattttcagctgcctgggtataagcagagctggcataaagtgggatttagctagatttttattttcctaagttataggaagtagtcctttaataagtaataaaggcttgatagcctgagattaaaaataaattaggaaatagtcaaggaactgtttacagcattagcaaaaaaaaaaaaagtataaaaattggtctctaacgaatcatttttggtacaattgtgaaatgtttactcttgttcttttaactgaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaaaagaaaaaaaaaaagggcagaatctcctagagaagaaatgtgaa

SEQ ID NO: 575986 - DNA, 323 bp, Homo sapiens
cgcaacgtcaaagccgcagtggtcgatgttggctggcgcgtccggatggtggtgggcggccgccaggtggtccggtgctgggcccacaccgctgtgcaggcggaaggccggtccaacgaaggacggcgccaacgctaacggcgccaacagatggtgtgcgcacatgcgccgttgtggtcgaatggaccaagaacatgcacgtaacgtgcattgttatcgcgtcgggatggcgtctgcattcctttgataggctgtgctttcaatcacatatggcagggaatcaagctttaaagaggtatagtcggcgcatgcataaacggcct

SEQ ID NO: 575987 - DNA, 1112 bp, Homo sapiens
ctgagccccccgctgaggagaaagaggacttgctgaagaacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaaaagaaaaaaaaaaagggcagaatctcctagagaagaaatgtgaa

SEQ ID NO: 575988 - DNA, 197 bp, Homo sapiens
tgtgctctagacgctgcttatttatcccacccggaaaatctgcgcgtattgtatgcctgctgggaaatcaggtgtgtatgggcggggaggtgctgatgttaggtgaagtgtgagggcgccaaccaataagcaccaggcacaggggcagattcaccaggtgaacacagctgcccagccacgacacgcacagtggctac

SEQ ID NO: 575989 - DNA, 1091 bp, Homo sapiens
ttcctgtttccttctttgatgacaacttgtgttaaccctcgcacatctctgggccaattttgcttaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaaaagaaaaaaaaaaagggcagaatctcctagagaagaaatgtgaa

SEQ ID NO: 575990 - DNA, 723 bp, Homo sapiens
gctgagcccaggaagaagaagtggacactgagcctgaagaacctgcggccggaggacagcggcaaatacacctgccgcgtgtcgaaccgtgcgggcgccattcaacgccaccgtacaaggtggatgtgatccagtcggacccgttggcaatgcccgtgctcacaggcacgcaccccgtgaatcacgacaggtggacttcgaggtgtggaccacgctccttccagttgctaagggtgcgcagcgagctgtgaatgccggtgatccagtggctgaagcgcgtggagtacggtccgccgagggcctgccacgaagtccaccatcgatgtgggcggccagaagatttgtgagtgcgtgccgcacggtgtgacggtggtggtcgcgtgcccgtagcggtctccatagcctcacataagctgtctcgatctaccctgtgcccgcctagggatcgatgcggtgcagtgtacatctgccttggcgccaacgaccatggttgctacgagcttccgcaagcgccttcctcaccgtgctgccagacccaaaaccgccagggtcacctgtggcctcctcgtcctcgggcactagcctgccgtggcccgtggtcactcggcgattccagccggcgctgtcttcatcctggtgcaccctgctcctgtgggtttgccaggccagaagaagcgtgcaccccgggctggcccttccctgctgggcaccgccgcggggacg

SEQ ID NO: 575991 - DNA, 1636 bp, Homo sapiens
cattgcaccggaaaaaatggggttgcttccaaaaacccttcaccacgccaatttccagagcatagtaaagtaaagacccttgagaagatgagaggatggaatttagtatataagttaagcagctggatttagataggcatgtggatagttaatagatgataacagatagcatgcatatgctggtagatggggggttatagtgggagtctgatattctcatgtcatcaattctgttgtctcaaagtagaaaacaaggtgctaagctaacggaatacaagaaaaatattgtgaggttaaggaacaaggagaaagtacaaaatactctctgagatataggtggaaaaaatagactaagattgtaataagtaattttgtggcataattaaaaatcaccctgagatttgtggtagtttttataaattgaaagtgaggccagggaaatttgttagtttgttttctagccattttcagctgcctgggtataagcagagctggcataaagtgggatttagctagatttttattttcctaagttataggaagtagtcctttaataagtaataaaggcttgatagcctgagattaaaaataaattaggaaatagtcaaggaactgtttacagcattagcaaaaaaaaaaaaagtataaaaattggtctctaacgaatcatttttggtacaattgtgaaatgtttactcttgttcttttaactgaaggcattgacaagactccatcaactgaaacttttaggtcatactttagtcgttgaatttgcaaaagagcaagatcgagttcactccccatgtcccacttcaggttctgaaaaaaaaaaaaggtctgatgaccctgtcgaagatgataaaggacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaaaagaaaaaaaaaaagggcagaatctcctagagaagaaatgtgaa

SEQ ID NO: 575992 - DNA, 603 bp, Homo sapiens
aggtgctggactcaatgaagagagacaagaacctgaatggggcagcagccatcagaaggcagttggcgtcgattcttactgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaaaagaaaaaaaaaaagggcagaatctcctagagaagaaatgtgaa

SEQ ID NO: 575993 - DNA, 433 bp, Homo sapiens
  misc_feature (425)..(425): n is a, c, g, or t
cgaacacgacaaccaatcgcgtgcctgttttgcccaaagtcatttgtaaagtaaaattcccaatagaaaggaaattttttttctccagttcccatttgaagtttgcttatatttctatgagagaagaatcctgttaatcattttctgttgcatttaagttattgaatacaatggaacggacaataaaagccggggcgggataaaagcgcccgcgggtgaggaagggcgctgcaatgagaacgaaaaatatgaggtaacaaagaagccactaatgtccatcgaaaccaattccttctaaatattcccccgaacagtacagttcttctcattgaaatatcgacaatgaataggcacgtattaagccaaaaaaaaaaaatctccgttctactcgaataatcttctcctcccatactcaggagggagantagtggat

SEQ ID NO: 575994 - DNA, 130 bp, Homo sapiens
catatcataagagctgaggtagcgaggatcactataacccaggagttcagggttccagtgaactatgattatgtcactagcactccagcctgtgcgagagagggagaccttgcctcatgctgctactcct

SEQ ID NO: 575995 - DNA, 345 bp, Homo sapiens
aatcacactttgaatagatcatttaagagagaacaatgacaggaacagaaaagtgacaggatataactaaaggaaccgagaggaaaaggaggcagcccgctcatctgggatcagctgggagtccagagatgcttcccaatgggaggaagttgtgagagacccccagtgttccacattcccactgtggactcctgcagtcctagccacagaagagctcctagactcacaggcacaggcactgacactaacataggaaaccacctaaagatgatgcaaaggtattgccccagagagggaggtcacactgggtcccacatacctcccaagtcctgagaagctacagca

SEQ ID NO: 575996 - DNA, 162 bp, Homo sapiens
  misc_feature (5)..(5): n is a, c, g, or t
  misc_feature (9)..(9): n is a, c, g, or t
  misc_feature (24)..(24): n is a, c, g, or t
  misc_feature (49)..(49): n is a, c, g, or t
  misc_feature (52)..(52): n is a, c, g, or t
  misc_feature (62)..(63): n is a, c, g, or t
  misc_feature (106)..(106): n is a, c, g, or t
  misc_feature (143)..(143): n is a, c, g, or t
  misc_feature (149)..(149): n is a, c, g, or t
  misc_feature (157)..(158): n is a, c, g, or t
ggatnccgnccttttttaacactngaaaacattccaaaactttaaggtnttnggtgtatttnnccagctttatttgctgtactttatttgtatttgccattcagtnctagcttttaagtatatttttttctttttctcatttntcaatncacattanntttt

SEQ ID NO: 575997 - DNA, 742 bp, Homo sapiens
tacaatttccattggactgagaactacactccgtattccccacaacagccaaagcaagccctgcccaaggaagaggctgagctcagagctcagacaggcttatccctgccccgacctgatggtctgcctctacccaccctggtagccgaatactaaggtcataatcttttgcgagatctatggccccacccaccacctgagaatcctgaatacttaaccagttgtccctagggcaagtttaccttcccccataggacctcagctgatgcactcttgaaagcatcacctcctggctggaggccaaccaacacaaaaccagcacactaaatgaaaacacaaccagagaccctcacagagtccacctcactcccctactacctccactggagcaggtgctggtatccacatctgcaagacctgaagacggatcacatcacaggactctgtgcagatactccccagtaccagcctggagcccagtagctctgctggatggctaggcccagaagaacaaaaacaattactacagttttactcttaagaagccccattcctaggggaggagagagaacaccacaccaagggagcactctgtggaacaaaagaatctgaacagcaacccagatcttccgtctgacataatctaccaaatgaaaagaaccgaaaaatattctggtatatggcaaaccagttcttacaccccatattgtacagtcccagcatattcaggcagagaacctta

SEQ ID NO: 575998 - DNA, 172 bp, Homo sapiens
  misc_feature (84)..(84): n is a, c, g, or t
gactcaacacccatttactggcacaattgggtggagagaagggaatgggtatgattgtcctgtactgctcaaggattgcagganggttcagaaggggaagagaggaaacggccaggctggagagctgtgctgattagcacttccctcgccacatgttcagacggactcactc

SEQ ID NO: 575999 - DNA, 673 bp, Homo sapiens
agcggagtgctcggcgtcagacatggcggaggcgatggatttgggcaaagaccccaacgggcccacccattcctcgactctgttcgtgagggacgacggcagctccatgtccttctacgtgcggtccagcccggccaagcgtcggctgtcggacagctcatcctgcacggcggcggtaccgtgtgccgagtgcaggagcccggggccgtgctgcatggctccagccctggggaggcgctggcctgaggcctcgggtgatttcatctccacgcaggtacatcctggactgcgtgtgagcagtcgaacgagaggtctggagctggaggcactatcaggcgtgggccccgtcctcggtcgggggacaccgtgctcggaagctaaagtcccgagtggtcgccttggctcagaggtgcgccgaaggagccggagccgatagacgagaacgaccaggtgcggatcagcgcattcgacggaatgacggacagacgtagcgcatccattacgctacagtgaaggacaaatgccacgctcgcctcagctccggtcaccaggtaacgccttgtgtgacagcgatggacgaagagctcgctcacgcagtactcgtggctagtccctgaaggaccgctagctcaagcacctgcggggccaggagcataagtacctgctgggggac

SEQ ID NO: 576000 - DNA, 284 bp, Homo sapiens
catcgtagcgggcgtatacgggctgtgacctacgtatgttgacggtcctgtaagtaggacgagtgactcttcgatcaggagaacgtggttactacgcacagagacgttctcccacgtcggttaatacgtggggggtaacggcgaggttacgcgaggcttgctagacagtcatcaacacacagctcttagctgggacgttacgacgttggacaggggatacccgagactcgacacttcgtaagtcctggttcatacgcgtgtttcctgagttgtaacacacgcga

SEQ ID NO: 576001 - DNA, 1086 bp, Homo sapiens
ctaggctaggtagcgagcgggtgttaatcggcgaggggagagcagaatgtggttgcatactcctaatgcctatgattgaatctggggtcaggatggatctggatgcatcccagctcctcagacaaatgaggctctggacccacccatgaggctggcgcgaaggaccctgagagcctttgaatcagatgtttgccacaatagaactaccaaccgaaatggaacattacaggccaggtttcaatttcggaataatctgtcgaagaacaaggagaggcaggaaaggactagaggcccaacagaccccccgaaagagggtggtgaagagagtgcaaagtttggactttcatggttggccctaatgtctgtcaaatgaaggcctagagcctccagtgtggcgagatgcagtgacttccttggagggtctgtatgtggaggccggaccagatctcatggcggtcccaggtctctcagtgacatagagggtgcgagctgacggagatcggtgttgccttgtgaatctgtgaggagctctaccgagaggaagctgttgatcgaccatcagagaagctgtaacccttcacgtgccttaccttcgctcaaatactggcagctcttcccccagaggggtggaggaacctgatgtcatcttccagaacttcttgcaaaggctgaagtaaccagttagactctttgatggggctgagcaattcacaccctgtggaggaagagcgtcatatcccatgtgaattccgtggggtacagctggaagaggaggtgtggtcgatcacaaggaccagtgtggcatgccaggcaatgaacaaccgttaagcgggggaggaccctcgatggattcccgtctagaaactacaaaagtgcagaggggtgtcacaaccggacatcgttctggtacgggggaataacaaaaaagataggggcccatgggttggcacacgcaaaaaaaagagaggcaaacagatgaagaaagccaaagatgaaagcctctttgagagacacaacgacgagagaaacatcagcaaggcgatgcacacaagtccgagaaagagagagcagcagcgaaagtggtag

SEQ ID NO: 576002 - DNA, 370 bp, Homo sapiens
ctactactactactactactaaattcgcggccctcgacgggggagtcgcttgaacctgggaggcgggggttgcagtgagccaagagcgtgccactgcactccagcctggtgacagagcaagactccgtctccccagcctccagagtggctgggactacacatgtgcactgacacgcacggctaatttttgtatttttagtagagacagggtttcaccatgttggccaggctggtctccaactcctggcctcaagtcatcctcccgccttagcctcccaaagtgctggaattacaggcatgagcaccacgcccgaccatcttcttgccggcaactcttagaccaggaagcctcggatgtcgacgcggccgc

SEQ ID NO: 576003 - DNA, 244 bp, Homo sapiens
ttcaaagcaaagttttttattaaattttataaatttttaaaccccaataggtccccaattggtttttgggggaatgacccccagcaaaaccgggaaagggccagttttctttttttttttttttggttaggtaaacaaaagttttaactactttttggggtttatgaaaatcatttagttgccaaggggcctatgccattgttaaattttttttaagtaatttaacaccagatttgctaattta

SEQ ID NO: 576004 - DNA, 1940 bp, Homo sapiens
atcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcggagtacagaaacggagtatgatgactggacttctctgttctctttcaggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576005 - DNA, 614 bp, Homo sapiens
ttttttttttctcctctgtgtcctcgaatgaccacaatcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtaagtacagtcgggtgcgatctgtcttcactatcacttcagagactttattttattttttataatttgcccccattttttttttccttgcccataactgcatgcctttccaaactaaggacctgtttttaaatatatatcacccatctctgaagtcacagatgacactgatgtgcacttttgaaaaggccaactgacaagcctgcgtgtgttttaagcaggtgggactgccttttagcctatttactgtggccccaatgtgcacaaacacagacatcaggcagatattggacatttaagaataaaaataatgtcttgggggcaccagttgactgagagaaattaagcaggcttcaatgaagcgat

SEQ ID NO: 576006 - DNA, 1805 bp, Homo sapiens
tcgtgccgtatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576007 - DNA, 2061 bp, Homo sapiens
atcacggggagtctagggaaagggggaaagtcttccagcctgtgaactttaaccagattcctacttgtgcaagaagcagaagcacaatttgaagttaatagaagctttctcatggagaactttattccgtccctgagctcttctagcaagttgttttggagttgactacgcagtgacgacggagattacccagtcaactatttttgaacgctgaaagggaaaatcacctttaaattgaaaagataattttcagaagagatttgactgtattttgtgctcctcagcattcatgcaaaggtgttcgcggagtacagaaacggagtatgatgactggacttctctgttctctttcaggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576008 - DNA, 2024 bp, Homo sapiens
ttttttttttctcctctgtgtcctcgaatgaccacaatcaggttttcttcttgatccttcagtgagccaaggagcagcatatagtccagagggtcagcccatggggagctttgtgttggatggtcagcaacacatggggatccggcctgcaggttggctcatcccgcctctgggcttccctgggaagtgccacctgctccaccagcctctccatccactctactatcccactgtcatggtgggtttaacatttgcctgctgcctgctctgcctgctttctttacattgggtgggggaaaaaaattcctctttgaaaaagtaaagattttaccacagtaccattatactctgccccatacacatcctttttcttttttctttttaaaccaaggcaataagtgaaaaggaatctgagtttccttctattttttcaccatcaattattgctgattttccggcctcttcttggattttatctcctttctaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576009 - DNA, 242 bp, Homo sapiens
attgaagcagtcagtcagtggaggtctattgaagcagtcagccagtcagtggaggtctattgaagcagtcagccagccagtggaggtctattgaagcagtcagccagcccatcagtggaggtttattgaagcagtcagccagccagtggaggtctattgaagcagtcagccagccagtggaggtctattgaagcggtcagccagccagtggaggtctattgaagcggtcagccagtcgacgc

SEQ ID NO: 576010 - DNA, 1523 bp, Homo sapiens
ttttttcttttcatctttgatgggtaaagtataaaaatgtttaggaatttgacccgctttctttttccctctctattttcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576011 - DNA, 286 bp, Homo sapiens
  misc_feature (44)..(44): n is a, c, g, or t
gatccccggagggtttctttggcccagaagttggagggtgcagngagctatgattgcaccacttaactccagcctgggtgacagagcaagatatcatctcttttttaaaaaaaaaaaaaaaggaggaggaggaggaggaaggaaggaaattaaaaggtctcaccaagagggtgttccctggggcccaataattaataaggcccagggttaaaattaaaattttttcctaaagaggacccactccctgaaggcctccttgatttccaattggggtcccgggctcgaa

SEQ ID NO: 576012 - DNA, 747 bp, Homo sapiens
  misc_feature (2)..(2): n is a, c, g, or t
  misc_feature (153)..(153): n is a, c, g, or t
  misc_feature (165)..(165): n is a, c, g, or t
  misc_feature (229)..(229): n is a, c, g, or t
  misc_feature (234)..(234): n is a, c, g, or t
  misc_feature (256)..(256): n is a, c, g, or t
  misc_feature (261)..(262): n is a, c, g, or t
  misc_feature (265)..(265): n is a, c, g, or t
  misc_feature (269)..(269): n is a, c, g, or t
  misc_feature (285)..(285): n is a, c, g, or t
  misc_feature (290)..(290): n is a, c, g, or t
  misc_feature (296)..(296): n is a, c, g, or t
  misc_feature (302)..(302): n is a, c, g, or t
  misc_feature (322)..(322): n is a, c, g, or t
  misc_feature (333)..(334): n is a, c, g, or t
  misc_feature (348)..(348): n is a, c, g, or t
  misc_feature (367)..(367): n is a, c, g, or t
  misc_feature (373)..(373): n is a, c, g, or t
  misc_feature (376)..(376): n is a, c, g, or t
  misc_feature (384)..(384): n is a, c, g, or t
  misc_feature (389)..(390): n is a, c, g, or t
  misc_feature (405)..(405): n is a, c, g, or t
  misc_feature (409)..(409): n is a, c, g, or t
  misc_feature (415)..(415): n is a, c, g, or t
  misc_feature (420)..(420): n is a, c, g, or t
  misc_feature (424)..(424): n is a, c, g, or t
  misc_feature (452)..(452): n is a, c, g, or t
  misc_feature (460)..(460): n is a, c, g, or t
  misc_feature (464)..(464): n is a, c, g, or t
  misc_feature (467)..(467): n is a, c, g, or t
  misc_feature (480)..(480): n is a, c, g, or t
  misc_feature (501)..(501): n is a, c, g, or t
  misc_feature (510)..(510): n is a, c, g, or t
  misc_feature (527)..(527): n is a, c, g, or t
  misc_feature (551)..(551): n is a, c, g, or t
  misc_feature (579)..(579): n is a, c, g, or t
  misc_feature (626)..(626): n is a, c, g, or t
  misc_feature (655)..(655): n is a, c, g, or t
  misc_feature (714)..(714): n is a, c, g, or t
antgtgaggtgtatttgtttgcaagaaacaaggtggaaactagatggaccagctgagcaggggggccaaggtcatttccatctatccctaatggtgttcagtatagccctctccttcctgagacctaagaacagaagatacgcttccacaacngagatttttgantttttaatggcggcgctctcataactacattcacggaccaaccaaagccatctccaagcctagnaaggntacatactacacgcagcgaaantgccnnccnctgntccagaattttcaagntggcncctttncccagncttctatgccattcattagncataggctgcnncctgctagcctgtnggccaaattccccctctangtcttnttngcttaggngcctnngcctctttgggggtntggnttggtnggggntggnctgggggggttgggatgggtgtgtgggngtggggcntctntgnggtggtgagaaantccattcccacatggcaacanccagctggngctaacagctgttaganagcatgctgctccccgctactgcnttatacccagccagcttcatgtgtgcangttatctgcctgctattcacatcggttctccttgctcagcaaatgtnccacctcaacctcacattcaatacccttntacaggttccctaatcagagttcagtagggcaccacactatagctgggcaatccctggntgctgtgatatttgttaaccattatgttctttc

SEQ ID NO: 576013 - DNA, 1771 bp, Homo sapiens
  misc_feature (1682)..(1684): n is a, c, g, or t
  misc_feature (1697)..(1698): n is a, c, g, or t
  misc_feature (1700)..(1701): n is a, c, g, or t
  misc_feature (1719)..(1719): n is a, c, g, or t
tcgtgccgtatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatacataaacannntttttttgttatnntnntctattcctatttttgtntcactattgtacatgttttgtacataaaaagcagtcttgtacccccccaaaa

SEQ ID NO: 576014 - DNA, 341 bp, Homo sapiens
  misc_feature (103)..(103): n is a, c, g, or t
  misc_feature (115)..(117): n is a, c, g, or t
  misc_feature (201)..(202): n is a, c, g, or t
  misc_feature (209)..(209): n is a, c, g, or t
  misc_feature (217)..(217): n is a, c, g, or t
  misc_feature (223)..(223): n is a, c, g, or t
  misc_feature (248)..(248): n is a, c, g, or t
  misc_feature (259)..(259): n is a, c, g, or t
  misc_feature (266)..(266): n is a, c, g, or t
  misc_feature (309)..(309): n is a, c, g, or t
  misc_feature (312)..(312): n is a, c, g, or t
  misc_feature (338)..(339): n is a, c, g, or t
attattgtgcatattttacaacagtatacttccttttaccctcctccttttgtactactgtgtcatatatttcatttcaatgtatgctgtaaactccattagntaatattatttnnncaagtcagttgtctgtaaaatacaaggttgggtgcggtggctctgcctggaatcccaacactttgggaggccaaggtgggtggnncacctgnggttgggngttcangactagcctgcctaacatggggaanccccatctctnctaaaanatacaaatttagccaggcgtggtggcgcatccttaaatcccanctnctcagggggctgaggcaggagaatcnntt

SEQ ID NO: 576015 - DNA, 320 bp, Homo sapiens
cgatctgaggatcccctcaagctttatacttctcaagcttatacttcctcaaggctttatacttctcaaggctttatacttcctcaaggccttatacttctcaaggctttatacttcctcaacgctttatacttctcaacgctttatacttcctcaacgctttatacttctcaacgctttatacttcctcaacgctttatacttcctcaacgctttatacttcctcaaggctttatacttctagaaggtctggctgtgctgtaagtttttggtggggtgtgagaagtataaagcgtggaggaagtatagagcgtagaggg

SEQ ID NO: 576016 - DNA, 1200 bp, Homo sapiens
aaaaatcaaaaatgaaatatttattaccgctttttgtgacttaacacctttttttttttaacataacgtcacagtcctcatacaagtattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576017 - DNA, 668 bp, Homo sapiens
gacaccgtcatgcattagacgcatttcccttggcagggattcgacgaagtgaccttactcccctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgatttttaaaaaaaaa

SEQ ID NO: 576018 - DNA, 748 bp, Homo sapiens
aatacaaagaatatatttttttgttaaaaaccagttgatttaaatatctggtctctctctttggtttttttatttggcggggggcgtggggggggttctttttttctccgtttggttcttatgtatgggggagacggggggtattggtttggatctcttatattgtcgtacattgctggtagactcatgcctttttcttaacggggaaaaacaagtctcatctatactctcactattctcttaattggctatctttcaagacctttaacacattctatgttcaacaagtaagaaagaaagaataatattcagaactgattcctgacaataaatgcaagcttataatgtatccgcgatacactatggtcgcatgtctctcgggcaagcattctttacactcatagttgcaactcgtggtggagccgttctccccagttattaaccccgtggacgtgcatcagggaaaattggtacttccgggccgttgcaacaacacgtgtacccacatctccaacacagcaagtccgtaattcttaatacctataacagtgtgggcgtggaacgccccacagccttatggctcctgtgcccaggaccttggtagcacacagtttgtgccgccctatggtaatccctccctgagtaagaccccgggggttatagcacaccaacagaaacctagcgcgcatgcatcaccctccttttatacccattgctctaatgtgtatccctagacaacatgaaggcc

SEQ ID NO: 576019 - DNA, 949 bp, Homo sapiens
ttttttttttctcctctgtgtcctcgaatgaccacaatcaggttttcttcttgatccttcagtgagccaaggagcagcatatagtccagagggtcagcccatggggagctttgtgttggatggtcagcaacacatggggatccggcctgcaggttggctcatcccgcctctgggcttccctgggaagtgccacctgctccaccagcctctccatccactctactatcccactgtcatggtgggtttaacatttgcctgctgcctgctctgcctgctttctttacattgggtgggggaaaaaaattcctctttgaaaaagtaaagattttaccacagtaccattatactctgccccatacacatcctttttcttttttctttttaaaccaaggcaataagtgaaaaggaatctgagtttccttctattttttcaccatcaattattgctgattttccggcctcttcttggattttatctcctttctaggacctatgagtggaatgggcatgaatatgggcatggatgggcaatggcactacatgtaaccttcatcatgtaaagcaatcgcaaagcaagggggaagtaagtacagtcgggtgcgatctgtcttcactatcacttcagagactttattttattttttataatttgcccccattttttttttccttgcccataactgcatgcctttccaaactaaggacctgtttttaaatatatatcacccatctctgaagtcacagatgacactgatgtgcacttttgaaaaggccaactgacaagcctgcgtgtgttttaagcaggtgggactgccttttagcctatttactgtggccccaatgtgcacaaacacagacatcaggcagatattggacatttaagaataaaaataatgtcttgggggcaccagttgactgagagaaattaagcaggcttcaatgaagcgat

SEQ ID NO: 576020 - DNA, 425 bp, Homo sapiens
agcggggggtggggcaggaggcgcccgacgaccctgggcgaggtcgcggcggccgcagggggctccggctccggagggcgccctcccgcagtcgcacccgctttccctcacacacaccggccgcccggccacaagccaagaagctgcctgcttggcccacaagccaagaagtcggcgaagctgagggcggtgggggagggggcaccggccggccaagcccggcggacgggcgtgtggcgttacctgtgtcagagagagctgggccgccgcagccatggtgtttccatcatgcaagggaggggaaggaagacgggctgactggggctcggggcggggaggaggcggagggagcggcgcaggcgaggccggggcgggcgggcgggcgtctcccctaacttccacaaatttccctccagccgccggcc

SEQ ID NO: 576021 - DNA, 117 bp, Homo sapiens
gctgtcgcgtcgacgccgctttcttattctttttgttgttttttttctgtcttttagggactttctaaatcatgggcacaggtatatatgcgtttttaaaactctatgagagtgaaa

SEQ ID NO: 576022 - DNA, 1282 bp, Homo sapiens
gctcaggctatctggctgggaactggatcgaggctctgataaagatcgtacgtccaacttcagtcccagatgttaccctaagctctcggaactctaacaaggagaacgcgctgcgatcagctacagtcacccagacatggtgccccctgacatggcctgggagcagcgggcgggctctgatggtcatcacgccggggtggccctcggctgggcggacgggtcagtctgtcagttgcctttgtgacctagcgtggatgctctcggcctgcttgtagccagcgtcttccccgacgaagcgtggcccgcggcctcctagctcgcgcacttcctgagccgtcctggccaagcacggaggatgctggagtcgggatcctggacccagtgctccgaggagcgtgagctaggtggtttgatggctcacaggagcagtactgaaccctagaggtgcctagcgtgcgctgaggggtgccagcgccaggtggcctgaggttgcccacccctggacttgatggaacgcgagctagagatagccgagcttaggtagatgcgcagaatcgggagacattacagatggccaggtagctgcgacgcacatgcttgagccacttgaggggccagcacattagagccggcgttggctacttacaagttgtcccctagcgtcaaacccatcagtgccctgctgtgaagcaacgttgacccgcacatgggagcaccccgcaaacagatgagaccgaggtcgacctaagtggcacccttaggaagtacaccgggaataggtcaacaaagaggattaactattcaggagtgccccccaggggctatgtggaagagcagttggggcaggagtactgacccccaaagtggcgtgtgggaaggaggaattcccatacaggggaacggatttgccaaccttgtgaagaaaatcccacgcaacatggaagcagtgcacattcgggacttagacagattgcaccccacgaggggaagggcgcgttacaaagtttcctccacaacccaaagggggaacgttgcacattttgtttgcagaggcaagcaccacagagaccttgcgcgacgttggacgaccattaggggagagatccttcttgcgagcatgagccatagtaaagcaccgattgaacatagcgcaccgttgaagacaactaaaagagggtggggaaataaccacagtctggaagggctgaagaggcaagagtgggcttggcccactttttgtccacaatcaatgggagagaacagtgaaaggtcgaagcttccc

SEQ ID NO: 576023 - DNA, 452 bp, Homo sapiens
gtgactctaaggatcctggggatggggtctgtacgggggtcgcatgatctggtttatcctcatcagaacgggcggcagacgcgctaggcaagtggtacatggcgtttgatgatgatgagaaacagaagctgatcgaggaggtggttggcgtggtcaccgtccgagacgccaaacacaccaactttgtggagttccggaactttaagatcatttaccggcggtatggtgggctctacttctgcatctggtgtggattgtccatgacaacaacctggcttacctggagggcattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgc

SEQ ID NO: 576024 - DNA, 298 bp, Homo sapiens
actgaatatataaacactccacagtgtttatattgggaagaagtttggaagagctgggattattggcaaaaacttgctagaggggtgaatctttagagctaatcactgcagaatcagagttgcagcaatatgattgcaagcaagtctgaatgcatagttttactttaattcaggcttgaaaactttgacataggtaaccccactcggggactggactgatttccgttatgcattgtgtcaaatcaatgggcaggtgtgcattctctagcaagtagttttcaggctgtgatggatggga

SEQ ID NO: 576025 - DNA, 488 bp, Homo sapiens
ggagatataaccagaaagcacttataattagagcatgtctaaactgctcacatgtgaaatgatgagcctccaggacttatttcctatcaccaatcccactgaagaccaaagctgaagagagaagcttccatacaactgaaagatagatgcaaaagcctggtctcacacattaggtttctggcatgaatggtaaactctgactccttttcttcaccactatcctactgtagcttaactgaaaacgttaagcacagtggggacaagttgacaggactaaggcagaggtaaacaagctctaaggttactgggagaatggtgtacacacctccctactggggaattactcctcaccatgttatcttttgaaaaacctctactatctctgctaggcagggtggctcacacctgtaatcttagcactttgggaggctgagatgtgtggatcgcctgagctcaggagtttgagaccaggaggtcgaggctgtagt

SEQ ID NO: 576026 - DNA, 299 bp, Homo sapiens
  misc_feature (6)..(6): n is a, c, g, or t
ctaccnggcggcattttgagacttaaagttattgaccccttgggtcaccaccctttacaacctaaagttatcagtcatactcctgaacaaacagaggcagtccatagactcctggtgaggaaattttctctatcttatcatcaacttctattcctgaagataatctgtgtataatctcttcgtcgtcacctaaggaaccacatggagaatctgtaccttgcttctgatagatttaatgatgctttccttcttgtagatgtaaaaacaacaatagtaataaaagctaacacttctgtaaa

SEQ ID NO: 576027 - DNA, 133 bp, Homo sapiens
tattgtgagaagcgttctcagcagaatcacaagtagtaaagagctcccagggcgtgatcattcaatctgccatagccatgctgatcagccgcctcttttctcctgagtagcttggggctcctgagtagcttgg

SEQ ID NO: 576028 - DNA, 139 bp, Homo sapiens
atgataactagtaggaattccactctcagagcccatcagtgtggaggagaataaatcaaagaagagaagaggaattgctagatcatatgctaattctatttttattttatatttttgacatggagtcgcccgttgtcgt

SEQ ID NO: 576029 - DNA, 797 bp, Homo sapiens
  misc_feature (437)..(437): n is a, c, g, or t
  misc_feature (472)..(472): n is a, c, g, or t
  misc_feature (499)..(499): n is a, c, g, or t
  misc_feature (521)..(521): n is a, c, g, or t
  misc_feature (533)..(533): n is a, c, g, or t
  misc_feature (548)..(548): n is a, c, g, or t
  misc_feature (550)..(550): n is a, c, g, or t
  misc_feature (583)..(583): n is a, c, g, or t
  misc_feature (605)..(605): n is a, c, g, or t
gatggcttgctcatcatagaggaggccttgtactgaaagcgtggagccacaagatagaatgctgcctggatccctgagtcaccacatgtcatcacgtggaaggcagaagccctggagagtgatggagtctccctctgtgcgccctatggcccaggctgcagtgtagtgacacagtctcagctctctgtaacttctgcctctcgggttcaagcgattctcctgcctcagcctcctgagtagctgggattacaggctggagtgcaatggtgcaatctccgctgactgcaacctccgcctcccgggctcaagcaatcctctcacctcagcctcccaagtagctgggaccccaagtgtgcgccatcacgcctggctaattttgtccttttcttttttttctgagacagaatctcactctgtcacccaggctggagtgcaanggcaagatctcggctcactgcaacctccatctccngggttcaagcaattcttctgcctcagnctccctagtagctaggattacntgtgcatgcaancatgcctggctaatntnggtgttttagtagagacaggatttggccaggtngtccaggtagtctcgaagtccngacctcaagtggatctgccggcctgcggcctcccaaggtggccggtattacgggcttgagccacctggcctagccaattttgtgtactttttgtagagatgaagtttcaccatgtgtggcaggctggtctccagctctgtgactcaagagatctacccagtttgcttcccaagggctgggtataggcattgg

SEQ ID NO: 576030 - DNA, 176 bp, Homo sapiens
cagagatgacggagaccatatgtcaggagccgtccgtatggtgctagaaatggatgaagacctatacccagtctccccagagtccgtgcctttccctgtgtgaataaagtatctagcctaaagtttccctaggcttacttgtctcagcaactttcccatctcgtctcttctcttgt

SEQ ID NO: 576031 - DNA, 884 bp, Homo sapiens
  misc_feature (468)..(468): n is a, c, g, or t
ggggcaaacgggttcgagtccaggattggggcaacggagggttccagagacaacaaggcagccggagtccagaatcggtggctacaggaccggagctccgggcgggtcctacagagacagttacgacagttacgctacacacaagcgggtgaaagcccgttccggctcaagatcgtccgttccaatggctggtgtgtttaaagaattgtgggagcttcgcgtgaacgttaatgggtagtaaaggcacctgcctggtattcccacttgtaagtagtcattgtcggttcgatctgtgtcaaacccagcctgaccgcttctgacgccgggatggcctcgtgtactagacttgtgtctgttttaagggaagtcgctgttattttgaggtttcaaacatttgaagcattacttttgaccacgagccatgagttttcaaaaaaatcgggggttgtgtgggtttttggtttttgntttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttcctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatga

SEQ ID NO: 576032 - DNA, 998 bp, Homo sapiens
  misc_feature (468)..(468): n is a, c, g, or t
  misc_feature (886)..(891): n is a, c, g, or t
ggggcaaacgggttcgagtccaggattggggcaacggagggttccagagacaacaaggcagccggagtccagaatcggtggctacaggaccggagctccgggcgggtcctacagagacagttacgacagttacgctacacacaagcgggtgaaagcccgttccggctcaagatcgtccgttccaatggctggtgtgtttaaagaattgtgggagcttcgcgtgaacgttaatgggtagtaaaggcacctgcctggtattcccacttgtaagtagtcattgtcggttcgatctgtgtcaaacccagcctgaccgcttctgacgccgggatggcctcgtgtactagacttgtgtctgttttaagggaagtcgctgttattttgaggtttcaaacatttgaagcattacttttgaccacgagccatgagttttcaaaaaaatcgggggttgtgtgggtttttggtttttgntttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttcctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaannnnnnccggaaaattcccttgattggaaccaaaaaccccttgttgggggctcctgaagcaagacctgggcagaaagagaaggtggggaggagcgggtctgcaagccttccta

SEQ ID NO: 576033 - DNA, 81 bp, Homo sapiens
gtcgaggacacggccgtatattattgtgcgagagagtgccctatgtgagtatttccgtcttttgactactggggccaggga

SEQ ID NO: 576034 - DNA, 1316 bp, Homo sapiens
  misc_feature (468)..(468): n is a, c, g, or t
ggggcaaacgggttcgagtccaggattggggcaacggagggttccagagacaacaaggcagccggagtccagaatcggtggctacaggaccggagctccgggcgggtcctacagagacagttacgacagttacgctacacacaagcgggtgaaagcccgttccggctcaagatcgtccgttccaatggctggtgtgtttaaagaattgtgggagcttcgcgtgaacgttaatgggtagtaaaggcacctgcctggtattcccacttgtaagtagtcattgtcggttcgatctgtgtcaaacccagcctgaccgcttctgacgccgggatggcctcgtgtactagacttgtgtctgttttaagggaagtcgctgttattttgaggtttcaaacatttgaagcattacttttgaccacgagccatgagttttcaaaaaaatcgggggttgtgtgggtttttggtttttgntttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttcctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacagctagcggcgaatactcgcgagtcggattagtaggtcacttcagcatgtgggctgcaggaattccttggttcgcacgatttctcgttgcggcttttcatgaagccggttaaaaagagccgtgtgcacattgatgtgttgttgctgatgaagtcccgcttgccgattgggaccagcacgacttcctatgggtgagggctcctgcgagggcagacctgagcagagagagaaggtggagaaggcaggggtctgaaagccttccctggggcctgacagagctaagaaagggaggcccagcagaactggcgctggtcaggggtaggggagccaggcgggggaccgggagcgggccagttcaggccctcagggcagccctgggaggcttcttggcaggtggttgggccaagagggctggaattggtgcgggcaagcttaacagggacagtggacggtgcaacctgacgctgaccttggacttgcctcagctaaagcagggcatagagcaaggccgtggatcccagggggaccttcaaa

SEQ ID NO: 576035 - DNA, 908 bp, Homo sapiens
gggctttgctcttacccaggctgagtgcagtggcagaatcatagctcagtgcagactcagactcctgggctcaagccatccttccacgtcagcctcccaggtagctgggactacaggcacacaccacaacacctggctaattttttaaattttttgtagagatgaggtctcactgtgtgcccacggtgatctcgaactcctagcctcaagcgatcctcctgcttcggtctcccaaagatgttgggattacaggcatgagccaccactcctggccaggagtctatatgtatactgtggatactagatcctcatgtgattgcaaaaactttatttatttatttattcattttgaaatggaactcttgctctgtcgccaggctggagtgcaatggcgtgatctcggctcactgcaactaccacctcctgggttcaagcgattcgcctgcgtcagccgtcctgagtagctgggactaccaggcgcgcacaacacgcccagcataattttgtattccagtaagagacgggatttcactatgtatggctgggatggtcttgatctcttgacctcgtgatccaccacttcgggctcccatagtgctgggattacacggtgtgagcaacccgcactccaggctgactttgccaaacacctttctttccaatactgttggtgcacctactcgtggcataggtgtcctctgaaggcacaacccgtgaatctggcatgacgtacaggcacagttcatctgacatcgcctttggtccgcttatgcattatggcgggcacattttccaaaagccatacttacttccagatcccagagaattacaccaggttctaatacggcatcgtaacattccgcgcatggccttccacctggaccagcgacacacaatggtctgcagca

SEQ ID NO: 576036 - DNA, 102 bp, Homo sapiens
tgctagatccagtctctcacaaacagtgtatgccagtggaatgtggttagtattgagccccattgtgttgtgtgtaaactttaattagtgtacggacagctg

SEQ ID NO: 576037 - DNA, 380 bp, Homo sapiens
tacatgggatactctggaagagatgttaacaccaaggaagagaatcctgatagaactgtagtgaaagtctagagggattacaccactgaagatgccattgttatggaaaaagctgtggaagccatcaggcctgaaacaataaattcctggtggagaaaactctgtccagatgtgcgtgacttcataggatttatgacagagctggttaaggaaatcatgaaagagattgtggatatggcaaaaaaggtgaagggtgaagagttttaaggtacagatcttggagaaattcaagagctaatagacaccacacctgaggaattaatagaagatcacttgaggccaggagttcgagaccaacctgggcaaaatggtgaaacctc

SEQ ID NO: 576038 - DNA, 928 bp, Homo sapiens
  misc_feature (928)..(928): n is a, c, g, or t
gaggccgtctgcactctccccggcgccgctctccgtgcctcgccctgtcctgccgccaccgccgccgccgcagagtcgccatgcagatcccgcgcgccgctcttctcccgctgctgctgctgctgctggctggtgccctgcctcggcgcagctgtccctggtgacctgagactgctctgagactgccttttgacctgcctgggtgcccataacctgcaggatgctgactgcatgtgcatgagctctagtagtgtgcagccagacagatgatactcagttgtgactgagaatgagactacacaataacctatagacaaaaactgttgaccagattgtgcgcccgacataaacagctgtaccgaaaaattgattgacacctgagacagagcagggatccaataccgaacccgttgcaagacagtcgttaacgacacttcgatgtgcacaacacgtggtcaactgaaaattgaattccccacaaaagagtttatggctagacaaataaaacaattagttacttgtatacattccggcgggaacagttgtgttggccacaaaaagaataactgaaagcgctaggaccgtgggaaaattacaacatatataccagaaccattagcggtgacagacaccacaagcaatatcaccaaggataaaaaccaatcaaaaaacggaaatgacacagatgctaagcccgagttgctaccgacatacgaatcggtggaatcattggcgcccgatatacacagaaagagatagatacaggcaacaaccacaatgtgcaacactatggagaatccaagatcgaaaaaaaccatgtaagcacacataaatggattgggactcacatccagaatcgaacaatataacacaccaggaagtacaaaacacagtatatgaaacacattatgaaaataagacactggtn

SEQ ID NO: 576039 - DNA, 536 bp, Homo sapiens
ggatgaagagtatgaagtaagccgagattgcgccgatgcactccagcctgggtgacagagggagactccgtctcaaaaaaaaaaaaaaaaaaaaaaaaaaaaacaggccaaaaaatgcaataaacaaaagaggaaatacaaatggaaataaatacttaaaaagatatacagcctcataaggaatggaactacagattaaaacaagatggagatattttccaatagatcagagtggcaaagggtaaaaagatgggcagaatccagcaaagatggagggaaacagacacaactcatgcacgtgtaatgggagtgcaaattcatacaattgattgggaaggcaggtaagcaatatgtaccaaaatcatacttgctcggggtgtatcaggattggaccacaagtcgggctaacacatgaaatttataggccaccagtggtggctcacgcctgtaatctcagcactttggaaggctgaggtgagaggactgcttaagcccaggagttcagaccatctggggaacacagtgagaccctgtct

SEQ ID NO: 576040 - DNA, 838 bp, Homo sapiens
  misc_feature (127)..(127): n is a, c, g, or t
  misc_feature (189)..(189): n is a, c, g, or t
  misc_feature (202)..(202): n is a, c, g, or t
  misc_feature (206)..(206): n is a, c, g, or t
  misc_feature (218)..(218): n is a, c, g, or t
  misc_feature (226)..(226): n is a, c, g, or t
  misc_feature (235)..(235): n is a, c, g, or t
  misc_feature (268)..(268): n is a, c, g, or t
  misc_feature (272)..(272): n is a, c, g, or t
  misc_feature (274)..(275): n is a, c, g, or t
  misc_feature (277)..(277): n is a, c, g, or t
  misc_feature (289)..(289): n is a, c, g, or t
  misc_feature (307)..(307): n is a, c, g, or t
  misc_feature (337)..(337): n is a, c, g, or t
  misc_feature (371)..(371): n is a, c, g, or t
  misc_feature (379)..(379): n is a, c, g, or t
  misc_feature (391)..(391): n is a, c, g, or t
  misc_feature (398)..(398): n is a, c, g, or t
  misc_feature (400)..(400): n is a, c, g, or t
  misc_feature (410)..(410): n is a, c, g, or t
  misc_feature (417)..(417): n is a, c, g, or t
  misc_feature (427)..(427): n is a, c, g, or t
  misc_feature (458)..(459): n is a, c, g, or t
  misc_feature (487)..(487): n is a, c, g, or t
  misc_feature (513)..(513): n is a, c, g, or t
  misc_feature (544)..(544): n is a, c, g, or t
  misc_feature (553)..(553): n is a, c, g, or t
  misc_feature (576)..(576): n is a, c, g, or t
  misc_feature (612)..(613): n is a, c, g, or t
  misc_feature (619)..(619): n is a, c, g, or t
  misc_feature (621)..(621): n is a, c, g, or t
  misc_feature (625)..(625): n is a, c, g, or t
  misc_feature (632)..(632): n is a, c, g, or t
  misc_feature (649)..(649): n is a, c, g, or t
  misc_feature (656)..(656): n is a, c, g, or t
  misc_feature (674)..(674): n is a, c, g, or t
  misc_feature (677)..(677): n is a, c, g, or t
  misc_feature (680)..(680): n is a, c, g, or t
  misc_feature (762)..(762): n is a, c, g, or t
  misc_feature (792)..(792): n is a, c, g, or t
tggcgctttgtgcggctccaggcctccgtgtggcctcccgacagcctgacaagctatcatggcagcggggcccaagctccactatcccaacggaagaggccggatggcgtccgtgagaggggttttngctgccgccggagtcgagtttgatgaagaatttctggaaacaaaagaacagttgtacaagtngcaggatggtaancacntgctgttccaanaagtgccnatggttganattgacgggatgaagttggtacagacccgaagnattntnnantacatagcaganaagcacaatctctttggnaagaacctcaaggagagaaccctgattganatgtacgtggaggggacactggatctgctggaantgcttatnatgcatcctttnttaaaancngatgatcagnaaaaggnagtggttaanatggcccagaaggctataattagatactttnntgtgtttgaaaagattttaaggggtcanggacaaagctttcttgttggtaatcngctgagccttgcagatgtgattttactccanaccattttngctctagaagagaaaattcctantatcctgtctgcatttcctttcctccaggaatactnngtgaantnagtnatatcantacaattaagagattanttgaaantggaagaaagaagaagantanaantgatgaaatttatgtgagaaaagtataaaaaatatttaggaaataaaaaaaaaaataaatgtgtgagtgaaagtgtgttaanagagatggtattgtataaagtaatgtattnatggttaaagatatgtaatggtgatatatatgtattaagttgggta

SEQ ID NO: 576041 - DNA, 1206 bp, Homo sapiens
atctctcgattcatctttggttggctttagttattttactctattggtagtgttcttgaatcctcgtggctagaattttttggactatttggtccgtacgtccttttttcggaatgtccttcctaattatcgtggcttatcttaccatccattccatggtttggttacaccctatcgcggtgtttacttccgtggctccctcccgtgatgtgttatcttattcttggacggtcttacgggatgtgtactcggttgtattggtgtttggatcaattgtggcgtctggtttgtgtcttgattgaccatagtctggactttattctttcttaaagtggttttcccttttgtttgacccagggaggacttttctactgatcctttgtatcccagtcgtataactaaagtaattatttttgaatacctgtttgggtctactatctctatatctcgtatggatatctagttggccctggtactatgttggttagtctttccgctagtatttattgttgtactatttgtatagatgttttcctctggatattaccctttgctatctacagtcgttcatgttgcatgcaggtatgatcgatcttacttatgtatctcatgtagcatatggctttattcttgattttctatgccagtgtgtctctgtaattttactggcctactactaggttatcttgatatatatgtatagttatgttgctagtttaattctggtcctaggtgcctatactaccttggtattgtcatgtcttgctctaagtactctataactgttccatgtggataaccttaataggtagctatatctaatatcctagtctttgtgcatataaatataggtaataagatacagaggctgttagatacaaggtaggattgctcctaagaaactaattttttataagagaatcactggtctaacattttacttactgagggataatagccaaaataggcaaataatggtataatatattagtaaacattatagtataatgtctgtagatagtgtagtttgtaatatattctacatcatgtataaatatgtaaaactatgggttatttttattaaatgtattttaaaataaaaatttaattctggtttttctgattagagtgcaaatagtgagaaaagttaaatactcggggaaatgtcagaattgaaaatgttaaccgggagcctataattcatgg

SEQ ID NO: 576042 - DNA, 897 bp, Homo sapiens
gccgccgcccggcccgcaaaccttcgtgcccggcccgtcctcgcccccgcctcgccaccgcctcggcccgcaaggttgccccctccccaccgcaacatgtccgagtccaagagcggccccgagtatgcttcgttacgcgctacatgggcgccacggaccgacaatggtaccgtatcagcagacacctgggcagctgacctatggacacagccaagagcaggtaaccgtgcattgcgagtcatgtactgatcatgacggaacggagcagatcatgaagtccatacatcccagaagagatcataggactaggcatcatcagccatcaacggccatgaaatgagatggcaggatcccatcagatcgccacactcaccatgaagtgagccgacaatcagaccatcataacaaagcagcatatccacacaagatgagacagcaccagagcccaatgaagccagatgagccatgaagcaggcccagagcaagccaggcaaacagcccaatcagaaaaatcgaagggagaagaacagcatgagagtagcgaggtaggacacacaggcaccaagggaaaggccaccagagatactatcccgatgagagcagttgagtcacatcgaagttctgtatccagtcctttgctgaccagagagggttaggacagggccatacataacggggtactacagatacggatcaggccgcatccagtcctcatccacaacaaggatagacccctatctccagagcccgagcaaaaggcacagacaataattaatgtagaagacaacaccgatcatccatacaagaaacgaacgagacaagaaaaactacgccacagaggacggaagcccaccaggaagtgggcataggacataacacatggcccaaatagccaat

SEQ ID NO: 576043 - DNA, 135 bp, Homo sapiens
cacacgcgttcgggaggcttggaaacatcactctagctgcgtcccagggcacggttcaacagtttgcatcctcaactgcagctcctcccagccaaaaccacagaatttgatcctaagtttctaactactttaaaa

SEQ ID NO: 576044 - DNA, 171 bp, Homo sapiens
  misc_feature (23)..(23): n is a, c, g, or t
  misc_feature (50)..(50): n is a, c, g, or t
  misc_feature (52)..(52): n is a, c, g, or t
  misc_feature (135)..(135): n is a, c, g, or t
ttaggctgtgtgtaatggctgcncgcgtttccttaaaagtcgggaggccncnaattaggttaccaatctgttcatttcaaaccggagcagtcatcactatagaagtgggagatggatttttgcctcgaatatccnagacccaataacgtaatcttaggtcgttcacggcct

SEQ ID NO: 576045 - DNA, 401 bp, Homo sapiens
  misc_feature (34)..(34): n is a, c, g, or t
  misc_feature (42)..(42): n is a, c, g, or t
  misc_feature (183)..(183): n is a, c, g, or t
  misc_feature (185)..(185): n is a, c, g, or t
  misc_feature (188)..(188): n is a, c, g, or t
  misc_feature (325)..(325): n is a, c, g, or t
  misc_feature (374)..(374): n is a, c, g, or t
aaaattgaaaacccctggtcgaatcagggccctnctggaacnccggcgcctaacatgaaccgaccccacgcgttacaagtaccgtttgacgcaagatgggcatcgacctgtttccgctgctggtcgtgctgttcgactggggaagcaagtacctcgtcaacgacggggtcgcggttcagcagnantgncgcgagagcggtcgggtgcttgaatccgtggtcgtcgacaggactgactgcggccgattaccgtggatcgcgtcttgctcaaggcagggccggtcgcgtcggccgccgtgcatgaacgtgtcgagcaggtgcgtgantgcgcgaaagtgcctcgggcagctgaccgctctcgtaccgttggaacanagcggaatcgtcccgagtaccggccat

SEQ ID NO: 576046 - DNA, 418 bp, Homo sapiens
agctctacaaaaaataaaataaaataaaataattaaccaggtgtgatgcacattttaacttgcatattagtctaagactctgggaaattttctcctcctgtatcttcttgtgtcctaaacaaactgtttgagtcctgtctattcttcctcacatatggatttccaaacacttctctccatttccacgaccacaaaaccattgaggcaggtacattactgggcaggggaggggcagccaggggccagctttcacctgtgtgagctgtagtgtggtggcacactagagccagctgtagtaccagctacttagaaggctgaagtaggagaactgcttgagcccagaggcttgaggctgcagtgaactatgatggtgccactgcagcaaagcctgggtaacagagcaagaccctgtctctta

SEQ ID NO: 576047 - DNA, 101 bp, Homo sapiens
gtatgtggaagggctcctacgtccgcgaaggccagccgctggtgcagataacgacgtgttgctgcgcgcccagtgtgcagcagcagcaggcgggcgtgcag

SEQ ID NO: 576048 - DNA, 985 bp, Homo sapiens
gtatttacaaacagcattcagagcatctagtgcattaaatgccaaaaaaaaaaatacattatcagtgattgaaacgttacatgtacccaaaaaccataatcatctctgggcagaaaatgctgagatcaatgaatattctgtgtgcctatattgacgtagtgagtactagagagtctgtattaataatcggactataataattagtattaattagcttggcaaactgatggccatcaaggtaaatatattatttggccaaagtgctgggacttccaaaacgtcacccccttatttaaatgtgtgctcatgacccactcatgacacagcatctgcaatattatctaaaaaaatgccctgcaggtgtcacggggcgaggtattttaaggccatgacaaatcaactgagtacaaaagccccctacttggggggtttggggaagtcctctttaaatggaaaacaatttacaggacccttgcggctataacagacaacttctcgtaactgggattgaaattccaatcacgaaacgttcaatagtacttcagcgcccaaaatttcatatgaatatatcagaatacatctggacgatttgccactacaccaatctctttaaccaccccaaggcacagcttagacgtgtgttgacgtacaacaagctgaccagccccttaatatcagttggaccccacattatgagggaatgccattacgactaccatttcagccagacaacattataactcactaatggacgaggatagtaagtcacaactatggactagtggaccataggcatatacacacacctatatttgcctctcaccaccacacacatcactaaaggtggtatatgacaccggtactcagggcctacgccagagcggaggaatgagcgccacagagccagacacgtacagtatgtgacagatccggacagaagtcgagaaggaagaaacgacatagtcaaagaatggaagcacattac

SEQ ID NO: 576049 - DNA, 335 bp, Homo sapiens
ccccccaggagacaaccttaggctcatgagaacacaggttttgccgcgagacaaccttgaggggtctattaaagggcacctttatagtaccagaaaggtggcgccttgtgagagtataggacgagtgcttgcacagagatcctaagaggcggaaaccaacttaatggtctaccaaccaaccccgtggaaggcagcctcagactcgaggaaacgattacaaagtgccatgacagagggtgctgtgttcctacggaaacctaagagaatctatgaataaaggaaggctttattgggtcagaacatgtaaatataaatcggccagccacttcagccat

SEQ ID NO: 576050 - DNA, 726 bp, Homo sapiens
ccagctctgggggatgccaaggctggtggattatgaggtcaggagttcgagaccagcctggctaggatgacgaagccccgtctctactaaaaatacaaaaattagccgggcgtgatggtgggcacctgtagtcccagttaattgggaggctggggcaggagaatcacttgaacccgggaggcagaggttgcggtgagccggtatcacaccactgcactccagcctgggcaacagagcgagactccgtctcaaaaaaaaaaaaaaaaagaaaaacaacggggctatgatagcgcattgtcttgtaattcccaaccacctctggaggctgaggcaggagaatctcctgtgagccccgggatgtggaggttgcagtgagccgagaatcaggtccctgaactccagccggggcaacagcagtgagcactctgtctcaaaaacaaaacaaaaaaaaaaaagtgcgggccagcgggggcctcaccattgtgttaaatccacagcacttgtgggggaggccacggtgggacatggtattccacagagggtcagggagcatccggagacccatcctcgggtctaaaccacgggtaaaaaacccggcgcctacaactaaaagaatacccagaaaaaattaaacccgggcagttgggtggccaaggcctcctggggggtcccccaggtaatctaggaaaggaggagcgcaggaaaagggtctggaccccggggagc

SEQ ID NO: 576051 - DNA, 127 bp, Homo sapiens
  misc_feature (127)..(127): n is a, c, g, or t
tagtctttctccgttgtcctctttcctgatccttttagctctctctctttctcctgcccttctttcttctctgcatccgggggggccatcttggtcgttgatgagtgttgtgcagggcgaccacggn

SEQ ID NO: 576052 - DNA, 132 bp, Homo sapiens
gccgaccatctcaacatctcccgcactccctcctttgccttgtgctgagcactctaggagtggagtgcgggaggtgtttgagatggccactcgggctggcctccaggtccgcaagaacaagcgtcggatggg

SEQ ID NO: 576053 - DNA, 259 bp, Homo sapiens
gtagggtgacgctcactccatccatcagattcatccagtcttctccgtgtatgcttcctgcacctgtgttgtcggagtggttgatcctctgccgcaggctcttcaggtcatcgttcttcttctccagctgatcccgtaggcatgcacacctggctcttgtgctgccgggaggagacgcggttagtgtgcatgtgtctcggagttagcttgccgtgccctcgtgtatctgccgtccggatgacctccgttgatggacatt

SEQ ID NO: 576054 - DNA, 536 bp, Homo sapiens
ctaacaaaaatgtatcttttcttataatcaccctccaaaaattatacaacaccgaccaaaaaaaaatattgccagtattgaaaactccacaaaaaaaacccccgtcacaataacaaaaaaaaataaatctttccctctaaaaaaaaaaaaaaaaatcccccagaaaatttcaatgggaaaacaagcataaaaatcatactcgtggaaacaaacaactcccccaaacaaaacgaacgttttttcttctccctcgccacgaaaacaaaaacacctctgaaattttctaaggaaaacaacaaagaactcctaacccggggccatgctaaaaaatacctcacaaaattattccgtaaaacccccccctctaaaaaaacaaaacaaaacctaaaaatttcacagccaaaaaaaaagatcaccaaaaaaatccatacactccccccccaaaaaaagttgccacctcaattcccaaaaaattaacgacagacaacaaactttaacctgctcgtcccataaggggcccctccccatcacaaccg

SEQ ID NO: 576055 - DNA, 299 bp, Homo sapiens
tctctttgtcaggatcgtgcacttgctctgtacaacgcaggcggtgagaagatattagaaggaagcacctgctactagtgctactccagcagtatttgaacacatggaacagtgtgcggtgaaaacttgccacaatggtgggttctgtgagtgctgggactgtggaatacctgtacagccgggatggcagcttctactttctggaattgaatcctcggctgcaggtcgaagcacccttgtacagagatggtggctgatgtcaatctccctgctgcacacgctccagattgcggtgtttg

SEQ ID NO: 576056 - DNA, 1388 bp, Homo sapiens
gagagactctttgaaagtaaagaaggtcatcagcatggagaaattttgacccagcgttccaggatgacatgctgaagaacaacaggactacgtggatgtcccatcactgcgaaacgcagatgtgctatggagaagtaggcagatgctcattccatcctcgttaactacggccacagtcagcagaatgacactggcacacacaggcatatgacgtatcaagcaatatggcacgagtaataccagtactcaaactcgtcaactacatgtcccagaaaccttctcaacttgtctcctcctctgtacagacacatgaacagggctcatagtggcacggaaactcctatgttctgtgcagagcaactgcggaagaaaacatttattgtacccgattcaagaccttcacaagactacgaggcaatcaatgctaccgctggcacgatggcaccgtctataagctgctacccactccctgctgcggtacagcccttgatgttctcgtccagcctcccgtatcgttcatcccactagaaactgaaactcgactacaatgcgcgagagaagaccccaatatcacacttgttgaacccagtggtcggctagagagccccttgtaggctccattgcgtaggtacgaccctttcggcaaatcaaccattcgcaacctagcacactttccacaccattgcgcggagacgcacaggccctgtaacttagagacctcgctacacttgacactcgctcgcgggaaccaccgccagtgtcacaatagggtatcgcaagcaatagcgctttgcaatgcctccaatacaccattgacaccttcaaccatccatagcggggaccgtacccgccccacctccttcgaacctcgttaacccccacggtcgtagcgcggccaaacgccccttgtccaaggcgcatccgctctcgcccgactctccgcgtttgccaccccacttccccagctgcaccccagacacacctaccacccacggggcggcgcccacctagagcgcccccgtcgttgccaccctgctccccggggtaccactgccggcggcccaacacaagcccacctttacccattagcccctgcatttccggcgccacgggtaagcctgcgctgaccgctcacgacacacaaactcgcaagcaacaagcaaacacccaaccagcagatcgctacgcgacaccccaacgacccccgctagcggcagaccgcgcacgaccccgcgaccgcgatcgccgacaaccacgcgcctatcacaccactccacagacacaccaacccaaagcacactacacaaaccgccccaccggccgggtaaccaccgataccacgccgcggccccccacgaccaccccacgccgacacaccaccccggccc

SEQ ID NO: 576057 - DNA, 711 bp, Homo sapiens
gaggacggtgaatcaattcagcaccgaggatgggatattccatggtcagaaacactgcccggacgtggagggcatgttccgtggcctcgcccacgcaggacggaaccctcatcacatgtgtaggatactggtgatatctcagagatctggctatgacaaaggacatagacacatcctctgaatccagtcctgaggacatctgagagtggtgcccattgccgcagtgttatagcgaatggcgccaagacccatggacaaccccatgtggtagctcacgaggtggcaaagagaatgcttcgaagatatggcgacctgacagcgtctcgtagatgcgtaaccctgtgcttctagtgcccaatcaatcggtgcgaatatgactagtgactgtggaccgtgggcggagttaccaatcctggtagacacagaccataccacgtttctctcgcaagggaattcaacatagaaaggcctacggtcatgacgatggccagtacgggggttaacacactcaagcggatccccggtggttccatttgacatcccataggatagagccgctcatgcagaccctaagtcctaattaatcgcgttagcaagtacacgaatcccttcatgcgaaggaggtaactccaatctaaatcagtgccaatgcaccccctgcacttccaggggaaggtaaacatccaagtcgacttgtgggggaacaggatc

SEQ ID NO: 576058 - DNA, 580 bp, Homo sapiens
tagcccgaatgtatatgccgatgcgtatagggacaggaggtacggctcgtgcagatgcccagcaaaatcggtcgatgagtgaccgtccccttcttagccagattgatcgctttcttagcatcagaggctgagatcaggcggacaatctcagattttcgcttctcgccgtgggggctgacgaatcggttgctcgtcagctgttgcagctgcctacccaaagtttcgtacatggtgcggacgtagtaggtattggccttctcttccagccgtaccctggaatggttttgcctgtagtagagactcatcgctctggcgacgtgctttagctgaaactgcaatgaagcgtcgctgaccagcccggatgcctgcatattcactgcgccggttcgtcggagttgatgccaggccaacggccagattttgccgaccgcaaactcgtcggtcagcgtcggcgtcaccaaccgagccaattcgaaatcttccggcgtaatgcgcaattgctcacggtcgaacagcttgtcgaaccactgaagcacatggcatagctcggaatcgatggccgaatcgtgcggttgatctt

SEQ ID NO: 576059 - DNA, 1110 bp, Homo sapiens
  misc_feature (371)..(371): n is a, c, g, or t
  misc_feature (397)..(397): n is a, c, g, or t
atagctaattaaacctcatggtccacctgccttggcctcccaaagtgctgctattaaagtgatatagccagctgccgttggagagatatagttttgataataacagctttccatcctatagaactatagattaggcatgagccactgtgcctggccccattcatgagttttaaattgcttacccttttgagtagtgtgatgaaatctcctgctgacctactccttctagccagggaaatgaattatccctttatccagcctatccacactgtagatgctacgtgcctattcgtcacttagtagctggttgtcttggttatcagattgactgttgtggtacctcagtgcttgtgttcaactaaccttgattntacttaataacatccccaaagtgcangagtattgtggctaatttataaattaagcttcattgtaggtatgtatatataggaaaagcaatagtatatatagaggtccatactatctatggtttcataaatccactggatgttctagaccatattcccacaccttaggacacttctgcataaagatggtttccgttctaacatctgagactctagggtcatacctggattgggcagttactctgtggccgattggaattttaaacctaatcttacataagcgattttcatagggagggttacaaaaccgtgtggaattagggccccccggagcatttcttaaccaacagggaaccccttttgggcccttgacaaggttacccgggggaaacctttacggttaaattccgcggaattggacggaacccctttctctaaccctcctggttttcccaggtttccttgtctggaattccttaatataggtcaagagtcttcacccgtgcaaacgccttgcctcggcactttccttcaaccctttgcccctctctggaaccagggcccctctatccaggtcttttccacctagcgcggagttcttcgccttcggccgcccccttttcagatccccgcctccgctcccctggccacacctctcggcgcttgtcactcttctgcgccgccccttctcgcgcatcttcactcgccccttctctccactaggccgtttctacccaccccg

SEQ ID NO: 576060 - DNA, 388 bp, Homo sapiens
agagggaaaaactcctgcttctgatacccagagaccatcactaaaccactaagactatagactcacacatgctccctgatgcaaaacgcaaatagaagctcctatcagagtctacctcactccaaagaagtgcccccgtgatgagtcagactggcatcatcaaacacaccccaacaccaaaaccttaagccatcgataaggcagtggggctcaccaaactcctgaaacagcaaatccccacagtcttcctgggtccttggccaaactgccttggtgagtgggaaggacacaggtaattctctccactttacagatctaactactcaaccaatgcacagaggggaagcacaaaggccaggagtctaggagaggtcccgtggtcccagat

SEQ ID NO: 576061 - DNA, 359 bp, Homo sapiens
cccagatcacacaacccagccggggaaaggcattcactggtcctgaccaacagctgtagaatgagagtggctgacaatctatgtcgtctggagtcaataacagctctacaatcttgctgtcctaatcctaccataaggagccaatgctaacgtacacatactgaccatataagcaggtcctcaaaatgaaaagggaataaacactgagtacatggggacacttataaggaagacaagagaaatacataagtatgctgcttacaacatgcatcaatgtacctgctttatccacactaattcgaatacttacccacaaactgtgtatcatatatcactttcaaaaattcccatgtcccatg

SEQ ID NO: 576062 - DNA, 198 bp, Homo sapiens
  misc_feature (122)..(122): n is a, c, g, or t
  misc_feature (167)..(167): n is a, c, g, or t
ttcactgccaccagtgatctttcaaaaatacaaatgagaccaaatatagtggctcacacctgtaatcgcagcaccttgggaggctgaggcccaaggatcgcttgaacccaggtaggtgaggntgcagcaagccatggtgccccccctgccctccaaacatgggcaancagagtgaggccccatctcaaaaaaaaaaaa

SEQ ID NO: 576063 - DNA, 347 bp, Homo sapiens
tgactcccagcacatccaagaatgcagttaactgataagatactgtggcgagctatatccgcagttcccaggaattcgtctgattgataacgcccaaagcctcgtgtctatcatcttgtaatagtcttaaagcccctgcacctggaactgtttactttcctgtaaccatttatccttttaacttttttgcctactttacttctgtaaaattgttttaactagaccccccctcccctttttaaaccaaagtataaaaggaaatcttgccccttcttcggggccaagggaaatttgggcctttgccattttcttggccccgggtaaaataaccgaattcttaatccttc

SEQ ID NO: 576064 - DNA, 120 bp, Homo sapiens
ccaggagtaggaacgaagggctaggaggcccctacagtaagtagtaaacctagagtaccgatacacacgcaatagataaacctatactagtaatactagcgggtcctagcagtatacaat

SEQ ID NO: 576065 - DNA, 521 bp, Homo sapiens
acatgcctggctccgagagtgtggctgttggcatgtataagataggctcagagcgaaggctcacggtataagttggtgggagagagtaatatctgggcagctccataggctggctggatcgctcgatgggatgcgacaatagaatagtcattcaaggaaggctggctagagactaagggcacacctgagtcgagagaatagagctcttagtccaagtaacagaaactgaacttttcagttctatacatatattttacatagttaatgctatcccagtattgaaagcaatcagtaaacacgggtcggtaacatcaaatataaaatgccatgtgatcagcatcaaatgcagatccacttgtacttagtgcggggcccttgtatcagtgaggtgttacctttggttggcttagctaagtatacgtttactttcttcgtccttgaaacaagctagaaatgtagaacagagttataacgagctcagattcatttcattgcacactgatttggactgcactgacggg

SEQ ID NO: 576066 - DNA, 994 bp, Homo sapiens
gcctcagcctcccaaggagctggtactgcaggcacacgccaccacgtctggctaatttgtgtagttgattgagtagaaatggggtttcaccagtgttggccaggcatggatctcgaattcctgtcctcatggtccaccgtacctcaggcctcccaagagatgctgggacttataaggcgtgagccaccggcacccagaccatttcttattcttgttctttttttgggtcaaatgtgtgcttggtgcaaaattagcctccttgtgtttccctagaatgcacggtattaagaacgggttcgaagctgggaagtttccacactgtgacgatgaattcgggagtgcctcaatttgtcacctcttcagctcgacaacgccaggcttatagactacgcgcgatggttcatccaaaacacgtcctgggagaaaccggcagagggagtcaagcaaacctgtcctgggcgctgttataggggagaataatagctgggacatttggaaacttatgtgcgggtggaacagtgtagaaatgttaccttgacatgtattttgcggtgaaatctcgtgcagttgaattgccttggtgcatacgcgaacacgtgctaatgtgggcactccctatacatgtctcccgagggtctctggacgtttcgggacacttggcttttcaagacaggtccacacacaaattcagctgaacgcccagaatgctccttatacacaattatggcggacatcacccgttaatttcaacaggagcctcctaagaggttctttacacaagaccagatcacaagacgaacaaccaaacacaccaagacaaagaacagacgagcgccacaacaacgggggtgcgcggcccgcagcgcatccattaagagaggaattctcccccgcaactgagaaggggggggcccccccaaacgagatatccaagcccagggtcgtaaccaccgcagagaaaatatccctctcgtgggtactaccccacagaggg

SEQ ID NO: 576067 - DNA, 201 bp, Homo sapiens
cccgtgattattaaacaagtacctatttttttctctattctctgctatttgtttaaatgaataaagtccaaagtcagatcttggtctagtttacctagtaagtatttttagtactcttagtaaatacttgtgatttttataatacaaaagggtcttgactcttaatgcagttttatagaattgtttttgaatttaaattaa

SEQ ID NO: 576068 - DNA, 165 bp, Homo sapiens
  misc_feature (140)..(140): n is a, c, g, or t
caacgctgctcgagcagcagcctctgaggtgtcctggccagtgtccttccacctgtccacaggcatggggacacatcttcgccaacctcttacaggggcccttttttggcaaaaaggaaattgcgcatcctcatggtggncctggatgctgcagggaagaccacg

SEQ ID NO: 576069 - DNA, 820 bp, Homo sapiens
  misc_feature (19)..(19): n is a, c, g, or t
  misc_feature (27)..(29): n is a, c, g, or t
tttttatattaaatgtganttttaaannntttaaatcaggacacattgaggcagttctaggctatgactttgatgtgcgtacaaggaagacactaaatttattatttcacctccgtgggatttcagggcatgcgaagtccaaaatcacactgcagaagaaacggggcttacgccattggaaacctcaaggaaaactccttattccagaccttccttggaagaaacctttgagatggaaatgaatgaaagtgacatgatgttagagacatctatgacagaccacagcacgtgacttcttttctttggtcctggctccactgtaccatggtagggtagaattccttcacatcctctgcatgacttaagactgacccacttcataacgtgactccaaactgcttctatacatttatgaacagagacccgccttaagagactggactgcacaccatatgctacaaatgagttctgaatatatgaacctacacattttttatacataagtgacatatttatggtataccatcaaaaaaaaataattatgccttatgtggactccacagagtagctattctagtctttgtcccttttctgtatggttaattcatgatccttgaatcactgactaattaagctacggtccgatggttgatatatactgcattatgctaattaaatggtgctattcaggatatacacaaaaaatggggacaacgctctaacgatgctgtcttcttaatgttctcattgggctgaacactttatagtcccctcttagtggattaatcctaagtctcgaacctctatttatactgtttat

SEQ ID NO: 576070 - DNA, 227 bp, Homo sapiens
atgaagacgtctagggtgccgttgatccacacaccaggcttctgcgatttgtgtcaacgcccggttgatgtagccgcgcaacgtgtcgtaggtgaactgcagctgggcgtagaccagattgtgtaccgagtccatattagataaatgagttacattggtgccatctgtacttcttctggttctactatgagtaagattccgactggaacagttggccaaacgttcca

SEQ ID NO: 576071 - DNA, 146 bp, Homo sapiens
cactgcattagccaggatggtctcgctctcctgacctcatgatctgcctgcctcggcctcccaaagtgctgggattacaggtgtgagccactgagcccggccaaatattccaatttttaaacatcaactcaggatgcttcttgacc

SEQ ID NO: 576072 - DNA, 139 bp, Homo sapiens
atggatacgctactgtaatgttcctataaatactaaaggggaacaaaacttgaaaaagccctgttcttcaaaaggtgagtggtttgagggaggcagtattatgaagtgactgctgtgttatttaaactaccagaatttt

SEQ ID NO: 576073 - DNA, 148 bp, Homo sapiens
  misc_feature (39)..(39): n is a, c, g, or t
  misc_feature (108)..(108): n is a, c, g, or t
cctctcacggaattatacctcaagtagggaaagtttccncccgaaagaccctgacttcccacctcagcctcctgagtagctgggactacaaatgctgcaccaccacanccaaggtaatacttttttatgtatgtttttgtagacggtc

SEQ ID NO: 576074 - DNA, 527 bp, Homo sapiens
tgtggatcgcccaggatctcgtgtgtacacatagaaagtgcatacacacgcacataaaggaacccagagacgtgttcggaagccagtgtggacaccctgtgatctgtgcgtacacatttgacacctgcgtacacactcacagacagaaacacagagatgtgtctggaagccagcgtggatgccctgtgatctctgcatacacgtgacacatgcatgcacaggcccatacaggagcagagagacacattcggaagccgatgtacgccctgtgatctgtgcgtacacgtgacacatgcgtacacacccactgacaagaacacagagacgtgtttggaagccagtgtggacgccctgtaatctgtgtgtacacaacgtgacacatgcgtgcacacccactgacaagaacagagacccattcggaagccagtgtgggtgccctgtgatctgatctgtgtgtacaccatgtgacacgtgcatccacacccactgacaagcacacaagagacacatttgaaagccagcgtgga

SEQ ID NO: 576075 - DNA, 949 bp, Homo sapiens
gcaagaagccagtgtcggccattggaagtgcgtcaaactaggtactacagctgatcgaaggtggcaggcaaaggccagtttttagtttcttgaacaacagttcctctagttcaagtacaccagaccacttctgctggtggtggcatatatggtagttccaccgtctatccatccaagtccacctgtggctaccttcgtgtttggacagtccagcaatcctgtgagcagctctgcctttggtaacactggctgaatccaggcagcctctcaggtcgtttggcgtatgtttctcaagataggaaactagcaaccacatccagcacaggtacagctgtcaccccatttgtcttaggtccaggagccaggcagtaataatactaccacctctggtttcggcttcggagccacaagcacatctagctctgcaggatcctcctttgcatttggaactggaccctcagcagcatctgccagtccagcatccggatgctaaccagaacccaacatgtggacaaagtcaaggatgacagaccagaccaatcacccaggcttcggatctatatcatcttccacagcatatttaccactggttctcagactgcacacctactttagggacagtgtcaagccagagcagaccctgtgttggacagcaacctaagtagcctggataaggctccggaacagatcctaaatccaagtcgagacaccaagaggcaggcgcaactcacaaagttcaacaccagaaaccacaggcccacaggaagggcccaacctccggcgccaacatctagacacaccaggtgacactacaccaagaatctcgaccagggggacatcacacgatacacaaacgcaacacatacccgagaggcaatggggacacagagatgcgaaccggagaaaacggcacagaggacgaggatacgagcaacaaacacgcggacac

SEQ ID NO: 576076 - DNA, 217 bp, Homo sapiens
  misc_feature (44)..(44): n is a, c, g, or t
  misc_feature (207)..(207): n is a, c, g, or t
cgatacaagtaccttaatgcacaccaatgctcaaatgactctantggcacggcggggactgctatcaccatccctcactcctgcagggaaggggctgccctactaaaaccccagcgggcccagtgctgtgtccagaacaggtccttatattactgcagcccacaatggaactactgagtaggagccaaaacaggagggggggggaanacgtggcatt

SEQ ID NO: 576077 - DNA, 173 bp, Homo sapiens
ccaatggctgttgatggtgggtttggggacactggagactgggaaggtcgctggacccatgtaaagagttcctcgagcgatctggacctacacacaccctgatttcgacccgagcactgatctctccagttcttgtagaacatgtaagtctagtcattgacctgcgcttagat

SEQ ID NO: 576078 - DNA, 445 bp, Homo sapiens
gattacaggacatcttcaggaagccaggattgcgtagctaaactgaaaagcaccatccatggactctccaaagcaaacgtgtatcttctcagcactagaatctgtccagcagatgtttcctgtggccacattccaacaggattggcacttcatgcatgtttcccccagtttccatcattcacagcatcaccttgatagcatccaaattttgcatcccttggttcaggtgtcaacccaagtcattctcccactccttgcagtttccaggcatgcgccagcacatttccaggtcctctgcgagttttctcagctgtgcggttttatactgcagaacccatccagggcactcaatcgaggcgtttcatcattatttgtcccattcaaccaggcactctgcagttgacagtccatcaatcctccatctggttgtctgcattctttgaca

SEQ ID NO: 576079 - DNA, 852 bp, Homo sapiens
  misc_feature (22)..(22): n is a, c, g, or t
  misc_feature (169)..(169): n is a, c, g, or t
  misc_feature (196)..(197): n is a, c, g, or t
  misc_feature (199)..(201): n is a, c, g, or t
  misc_feature (210)..(212): n is a, c, g, or t
  misc_feature (214)..(214): n is a, c, g, or t
  misc_feature (228)..(228): n is a, c, g, or t
  misc_feature (246)..(246): n is a, c, g, or t
  misc_feature (250)..(250): n is a, c, g, or t
  misc_feature (269)..(269): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (310)..(310): n is a, c, g, or t
  misc_feature (328)..(328): n is a, c, g, or t
  misc_feature (335)..(335): n is a, c, g, or t
  misc_feature (378)..(378): n is a, c, g, or t
  misc_feature (418)..(419): n is a, c, g, or t
  misc_feature (544)..(544): n is a, c, g, or t
  misc_feature (547)..(547): n is a, c, g, or t
  misc_feature (556)..(556): n is a, c, g, or t
  misc_feature (560)..(560): n is a, c, g, or t
  misc_feature (576)..(576): n is a, c, g, or t
  misc_feature (578)..(578): n is a, c, g, or t
  misc_feature (581)..(581): n is a, c, g, or t
  misc_feature (584)..(584): n is a, c, g, or t
  misc_feature (590)..(590): n is a, c, g, or t
  misc_feature (607)..(607): n is a, c, g, or t
  misc_feature (618)..(618): n is a, c, g, or t
  misc_feature (621)..(621): n is a, c, g, or t
  misc_feature (623)..(624): n is a, c, g, or t
  misc_feature (629)..(629): n is a, c, g, or t
  misc_feature (635)..(635): n is a, c, g, or t
  misc_feature (643)..(644): n is a, c, g, or t
  misc_feature (650)..(650): n is a, c, g, or t
  misc_feature (652)..(653): n is a, c, g, or t
  misc_feature (658)..(659): n is a, c, g, or t
  misc_feature (683)..(683): n is a, c, g, or t
  misc_feature (685)..(685): n is a, c, g, or t
  misc_feature (710)..(710): n is a, c, g, or t
  misc_feature (719)..(719): n is a, c, g, or t
  misc_feature (768)..(768): n is a, c, g, or t
  misc_feature (849)..(849): n is a, c, g, or t
gagttaaagggttaagtacatnggtctttatttaaacactgattttttttttaaatatatacacacaaaacttagttcagcaaggcttcatgatatacaccaattccaaaataaaacaatcaaatggtccaggtgtagaatgccagattccttttatcatctgcgaggnaaagagaagccggatgcggaagagtgnngnnnggcgggggnnngntctgcccagaaganctgccgcctcctggcacngcangcgctccaggcgcctgggnccctgttcatatctggngtnggnggggggctcccatcggcngctttgggactgaaaggnccaaggntgtcaccagctcccggatggggggggggctgtcttgtttttgntgtgggagggggtttgggtggagaaaagattcaggcacannaccacaggggaccagagtggagagaagacagagagttctgccgaggccttggtcttcctgtctttccaatcttgccttccccaactctccctgcttcctgggaccatcggtaggggtggggagcngcngtcacaaancccnctggggagggaggcananccncantccacntcccatgctgccctcanattcactgganagngnnggggnacaggntgaagccnnggccantnnaagannagacaattgaaattgattctctcntntgtacccagcataggaatagtgaanctgctacantggaggctgcgttcccatgacttcctcctccgctctccttgtctggganttgctggttccaggggtgcatatagggagggggcgggggccacaaccccgagacggtgaggaaagcttccgaccccctgtnaac

SEQ ID NO: 576080 - DNA, 458 bp, Homo sapiens
  misc_feature (2)..(2): n is a, c, g, or t
  misc_feature (445)..(445): n is a, c, g, or t
gntggagacgggggtctcaggagagtcggcaaccctccagcccaacacccttcaccacagggggggaggaggctggcaccgcaggagatcttggtctccctttgggccacggataccttgggccttatctgacaacagctacccctcgatccttccctcccaccccaggggcggggcagcgggctggagcttggtgtccacctggctcgggaggtggagacccccatcggagcaacatcctctctcttggttcctcggatccctgggcatcgtcacaaacccagaggtgcataataaaaactggcggagtcaatatcccggtaaggcttttcattttcatttaaaaagtaaaaggtggcggggcgttgcagctcattcccgtaatcccagcacttggggagtgcgaggcagaaggatggctggaggtcaggagttggagaccagnctgagcaatatag

SEQ ID NO: 576081 - DNA, 597 bp, Homo sapiens
  misc_feature (160)..(160): n is a, c, g, or t
aaaaaccgggaagccccccccagtggctgggagttgttttagcccaccctgtatgatttagttccaaaaattagaaaagctgtaaacgacccgcctgagggaaaaaggaaagtggaatctctggggccccttttcagggtcccccccccaaaaacccgcnacatttttgccctctttttccaaggggaagccctccgcagagaactctttgaattttgttttaaaaaaggctttgccgcccaaaacccggttgccaaatggaaaaaaccaggattttaaaacttttgctgcccccggggccttcaaacccggggcccccactttggggggaaatgcattttccgggggccccaaaacaaactggaaatgggccgcctccttgagggccccccctgtggctgttgtgggtttttttggtttagggtggggcgcccccccctgggctttgggctttgcagggttctgcctgtcccccccccccccttctgggggcaacgaacagggcccccggccccagttggggcccggtttttttgggggagggttccccgtttttcccctggggtttggaaaaaaaaaatcttttaatctccccga

SEQ ID NO: 576082 - DNA, 416 bp, Homo sapiens
  misc_feature (125)..(125): n is a, c, g, or t
ccaaggcctgggactgccttcagtcctcctctctccctctcgggctgcagtgtcgggagcagccggcgccaccgctttgccgtaaccactttaaccacttcctttttcacgactgcacggcactnactggccttccgccggcacagacagcagattcgccctggtccggtcgctcccggctccttccatggcccctgaccgaattttgtctgctcatcaggaaaccaaagtggcgtctgaagatcagtgtttttctaattagcagagactttacttcagtgaaacagaactgtttagaaacctgggtgattttcgtggtgttctgtggggagctattttgctatgacttctggccagtgtactttattttaaatttagttttgaataaatcatgcatcaaaatttgaaaaaaaaaa

SEQ ID NO: 576083 - DNA, 1119 bp, Homo sapiens
ggaacctttcccgctttcggtgttaggggcccttggccccttctggcgatccaagtgacgaaaggattcttaacggcactgagggtgcttgggtacctcatgcctggggcgaagcactgggagactcggatggggacaggaagggttgactgtggatccggttctttaatccttggagaacatgaaattgatgaaatgcttgattgaacggccctgaagaacggttttctcaggaagatccgttctggtggacggaatcgtggaacggtcagtaaccacgttggacgggtattgtgtcaaggccaatcggcgttcttgcgcaatcaggacagctagattcgagtccctacctctacggacagcaatcctgggaggatccagtcagaccagcgcgtcatcagtcaaggctgaacagtccatgtgggaaacactttcccaggtggaccagtttgaagtgggacatgtacagagaaggagaattcaccagagaagttcagccctgaaagctgtgctacggatgcttgcggtctttgggccgagcggagttctgtcaccaccataggcatacagcatactcgtgggacagcatgacgcatggcatgcaagaatgacgctagcgccgttcacgcgagaaccgctctgcatcacagtggagatttgccatcctggaaccacgggcgatgctggaccacgtggtgcccaacatgctggagactctgacagatcgcttgatgatggagaagaagaatccgcgaccaggacaggaacacgaggcggatgaaggcagtcttgccaacagcggccccggcctggtaaccagccgatcacgcacacggctcccgcggagcatgcgtcaggagacttgggccgacgctctctctccatcttctcggcaaggacagaggcgaggggacaacccagcgcaatccgtgaggatacgggcgggggtggagtcggcggtcttccaggtggaccctccgccggcacagcagttccatttgaagagccccaatcctgccccccaccccaccctccatacccctccccagtctgctggggtcaggaagaaaccttattttaaggttgtgttttgtttataaatacagaggaccagacagg

SEQ ID NO: 576084 - DNA, 350 bp, Homo sapiens
tttccctttgcaacttatcccccacagggggggaaacaggatttttccatttgaaaatttatttgaaggggggtcccgccccccggtaaaaacaggtcaaaataaattttttggatcaaggccccgaaaggaaggaatacggtggggccccctaaaggttaaatttgaggtttcattaaaaaaaaattggcttcaatggtttattttttaaatggtaaggttcaaaaacaaattgtgttttaagccccttccccccggattgtaaaacaaattttgtgttaaaaagccagggggacagggtcaaaaaggaaaagggttttacggggtttttaaaaaaaccctttgggtta

SEQ ID NO: 576085 - DNA, 150 bp, Homo sapiens
aaagtctacatgaatcaagtgtgtgatgacacaatcacttctcgcatgaactcatttgtgcaactcgcggactgagatcgctacaaatatgactgaactaatgagacagcacatgctgcaattccatttctgactctctccgtaattcca

SEQ ID NO: 576086 - DNA, 1866 bp, Homo sapiens
  misc_feature (199)..(199): n is a, c, g, or t
  misc_feature (256)..(256): n is a, c, g, or t
  misc_feature (276)..(276): n is a, c, g, or t
  misc_feature (286)..(286): n is a, c, g, or t
gcgagagtgcgtcggggtttccatgtttcagcagtgcttggacgggaatccgggatgtctactgtatacctccatcccggccgggcggccgtaattaggtcggccctccgtcgatcgtcctatcatccggctaccctacgcgcagtagcctccggaggacccccggctgtcggctaccacgttgcactggtgcatggcnagcggcctggcaggccgtctgcctcgtccttgagtctgccgtccatgaaaagaaccngctggtccatgcgtcagcantgtcgtagcntaggatactatctcaccacaggacgtgcgataatggaccggactactcacagctcggtcaagactcacaactcttggacgcctcgtaacggactttgtcgtacctggttctaccccttgtcgcactgtactctcagctaccatgttatgaccctcggcgaagtggcacttgctgtgggcctttatagaaagggtacatcgtgtaggggcgcatagaaggtcagcaatctccttcgttttcaagcaccattctacgttacaattaggagcggaaggaggcgtggaaaccaagtaggcaattgaaaggcaattaaaccattggaactgggaaacgggtccgtcgttcgatggacaccccccacatcgggatggggctcgggacccagaaggaaatacattgtcccgtatccgacggggagttgagtgctaggggaatacaacgcaagaaacctgatagtattcgcacggttgtgtgacagacaggccggggacttttgtagagttgccgataggggcgccaggttgggtttgccacgtttccaaaccactttctaggggacacacacacctcataggtcggatggaacgacggtacctaagcctctatctttgaccattggtgggaaaccttaagaaagctttataaaccagtggtgcccacaaacattggaaaccgcattattagagttgggaacgccccccccaaatattataggttggtttgcaccttttccaattttagatagaacacaccaaattttaacccctggaacacttagaagaccaggcggtggaaaagcgcccattcaaaacaagcaaacttgtggggttgaacacaactggttgaaacaaaatcttatggacgccaaagcaatgtgggaagcaggccccggaaagttcttgggacatatggagaggggaatatattcatacttaatggaacaaaatgcaacaccccctggggacagaccacggtgattaaacttgagaaatgggtaaaaaggccttcgggagcataaagttttcccccaatagggactgaggggtgtgaaacacactcccaccagctgtgggtcacacccacaacgcgacagtagcactagacattgttttggggaggtgattaccctattaacactattatctaaataacgtgtggtacccacaacacattcaccagctaagagattcttggagatttgttgaccagattccctttcaaataaaggaaactgtggtaccccggggctaacaaacacagcataaagctaacgcaacctcgcgaggacttatttgggctgggcaaacaaggagaattaaggagcgaggttcaatcgtagttagacaacagttttgttacaggaggaaaacgcaggaccaaagaggcggaatataactgggtcagtagactagtacaccagtacatatgatgtcagccagataagcggtggaatataagtgagagctagcgctaacgtcactgctgcgttagtttctcgttatcatctagtcttgtgaccatactaagtatcactactagctaataactcgtcaacattaatactagatgagacagaacgc

SEQ ID NO: 576087 - DNA, 313 bp, Homo sapiens
  misc_feature (26)..(26): n is a, c, g, or t
  misc_feature (28)..(29): n is a, c, g, or t
ttggaaaatcccagttagaacccccntnncccctcaattctgatcagggttcctcatccctctaccatccaaggtgatgtttgatcacccttgacctattttcagcaagaaaccccctttactcctgaagttccttcttagtaattttttatccagtgaccccaagctttttgttccttggctataaattcccacttgcccatgctgtatttagagttgagcccactctttctctcctaattcagaatcccattgccatggttgctatacctatcctgatggtccggaataaaatctgtcttactgtgcttta

SEQ ID NO: 576088 - DNA, 866 bp, Homo sapiens
tagaagtactaaaaattacaatgtattagtaagtttaatatttggacagggcatggtggctcacacctgtaatcccagcactttgggaggccgaggctggcagatcacaaaattaagagatcaagaccatcctggcaacatggtgaaaccctgtttggtctaaaaattcacaaaatttagctgcggtgtgtggtggtgtgccgtgtagtcgcagctgactcgtggggatggcgtgcaggcagagatgactcgctttgcaagccgaggaggcgggcgttgcgggtgagccaagatcatgccattggactccagcctgtgagagagttgaaacccccgtctcaaaaataattaataaataagttactattttaaaagtggttaatcatttatgtattcgccagtaaaattactttaaaagatattttaacaaaagtctcatatcctggtacttcagtttaggtgtgtgaatactatccctatacattaccctaaaactcagaattattggtttattttttcatacaatgtggggaagggaacatgggagtatgcacatgggatcattactccattctggggttgtggaaacaagaaaatgtgaaccttctgtttagagggtagctaactagcttggtgggggattaaaaagtgtaatacatggacttttgcactctgaagttggcaatctggaaaggggggttctggaagacactatttttacgaaccttaaaatatgttggcgtgtggtgtggcgaacagggtcttaaattttatggcaaagaaatttatccgggtttataaaccgtctttgaacttgactagtcaggaaagattgttaatgtaaaagggggtggaaggtaggacaa

SEQ ID NO: 576089 - DNA, 543 bp, Homo sapiens
  misc_feature (321)..(321): n is a, c, g, or t
ggcaggccacgatgcagaaggagcctctgcaaatgggtgctcatcagaacgcgtgattctctttcatggcagaatgctctgtggactcggttctccaggcctgattccccgactccatccttttcaggggttatttaaaaatctgccttagattctatagtggaagacaagcatttcacgaaagagttacctggatcagccatgctcagttgtgacgcctgaataactgtctactttatcttcattgaaccattcactctgtgttaaggcaacagattttcaatgtggtttcatatcaaacagatcatgtggggattaacnttgcctttttccccaaaaaataaattctcaggcaagcatttctttaaagctattaagggagtatatccttgagtacttattgcaactgggccaagtaataagcaaatggttcttataatggctacctgatttctatgacactgtgttgtgacaacgccaaaattctaggatgtagaacatctgggaaagttcatttcctggggattcacttctccagggatt

SEQ ID NO: 576090 - DNA, 905 bp, Homo sapiens
agtaggacgccatcagtgtaaatagagcttaaagtcatggttcggctgcgataaaaattgttctaacttgggttcaatatttgtagtgaaggtatctgtttgtcatttctttctcacgttataaataaaaatactatgctggccgggcgcggtggctcacacctgtaatcccagcactttgggaggccaatgtgggtggatcatgaggtcaggacgttcaagaccagcctggccaagatggtgaaaccccgtctctagtaaagataacaataaaattagctgggcttgatggcatgcgcctgtaatcccagctactcaaactaaccataatactaactaactctcactgacatagagtccggggcaatgttgacccaccatctaccgccaacagaagcctaatatccagggcgaccactctactgaaacatatcctcagcccgcaagtctttaacactacgcaggttctggactgcacagtcgcatctccttggcggaatacctgcggtatgggggggcagcacactggtagccccctttcctttagtgcgggcccgacatacccattcaccagaagatatctacgtctctacagcatccttgcggcatatatcaagcacgacgtgaaacgacagcgaccgtgactatattttacaccggcacctacgcgttggcgacaaaaccaccacgcattgaatgaagcccgcgatctctccctcacattcggggaacatcaccacgaggacttgctttatacgagtcaaaagaggactgcgccttcccacccactgttgttaaccagaacgcccctggtggacggcgagtgaccaccccaaccgagtggaacaagaaacgaccttgcgtgctatgtccttagtggcagagctggccataatcccaccgct

SEQ ID NO: 576091 - DNA, 365 bp, Homo sapiens
aagcatagtgctgggaggtcctagaaagagcagttaggccaggaacagaaatctaaggcatccaaattggaaaggaggaagtcaaattatctctgtttgccaatgatatgattttatatgtatgaatagaaaaccctaaagattccaccaagggccaggtacggtggctcacgcctttaatcccagcactatgggaggcgaggtgggaggattgcttgaggccaggagttcaagactagcctgggcaacatagtgagaccccatctctacaaaataaaaaaatagccggggcatggtggtgtgtgcctatagtcctagctactcaggaggctgaggttggagcactgcttgaggatggtccgggg

SEQ ID NO: 576092 - DNA, 210 bp, Homo sapiens
tggcgaaagtagatgatggtcatcagaggcggggaaggtaactggggggatgaagataacagtggggctgggtaatgggtacaaaaatatagtttgaatgaatacagatatagtattcagtagtgcaataggatggctatagttaacaatattttatcgtgtattttaaaataactaaaagagtgaaattgcaatattcctgatagaaaa

SEQ ID NO: 576093 - DNA, 136 bp, Homo sapiens
gcaccggtgatcgcctattactgacagtctcatcgtagctctaaaacgcctcacgtactccactgcggaatacactccatagactcacctcttctggcgttcacaatgcctccctaactctattcttgatcgtgag

SEQ ID NO: 576094 - DNA, 376 bp, Homo sapiens
  misc_feature (14)..(14): n is a, c, g, or t
  misc_feature (121)..(121): n is a, c, g, or t
aaaaaaaaaaaaanagggccaacactttttttgtttggagggaaccgggagtggtttttataaaaagctggggagtccccgttttaaaaattcggcagtttggcgtttaaaaaaggccccncagtaaaatttttttatatgtaactttcataattagaaacattttgtgcattctgtgagcagtttaagttggaagcttaagttttgcccctgaaccctggtatcaagggaagaaacaggctaataaaaatttttttttaacctgaaaaacgttttagaaaaatgatcagctttcatttcagcattgtaaattatctttcaaactggtcatttactaaaaccaagccattaaaattggttgtttccttgccattca

SEQ ID NO: 576095 - DNA, 405 bp, Homo sapiens
  misc_feature (163)..(165): n is a, c, g, or t
ggaaggcgaaggatactcgtttggaccccgagtcaaaccgagagggcctgcgagcctgctttgagtggaacctgcacccaggcatcgcaccagagaagagctggcccaggcatcgacattctagagcccaggttccaaatttggtttcagaatgagaggtcannnccagctaagggcagcaccggcggaatcttggccctggcccgggagacgcggcccgcaagaaggcaggagaaagcggaccgccatcaccagatcccagaaagccttgctcctccgagactttgagaaggattgctttccatgtattgccgccagagaagagctggcctgaaagacgggactccgggagtcaggattctgatctggtttcagaatcgaagggccaggcacctgggacagctg

SEQ ID NO: 576096 - DNA, 865 bp, Homo sapiens
  misc_feature (47)..(47): n is a, c, g, or t
  misc_feature (129)..(129): n is a, c, g, or t
  misc_feature (131)..(131): n is a, c, g, or t
  misc_feature (147)..(147): n is a, c, g, or t
  misc_feature (149)..(150): n is a, c, g, or t
  misc_feature (166)..(166): n is a, c, g, or t
  misc_feature (174)..(174): n is a, c, g, or t
  misc_feature (182)..(182): n is a, c, g, or t
  misc_feature (187)..(187): n is a, c, g, or t
  misc_feature (197)..(199): n is a, c, g, or t
  misc_feature (204)..(204): n is a, c, g, or t
  misc_feature (206)..(206): n is a, c, g, or t
  misc_feature (209)..(209): n is a, c, g, or t
  misc_feature (217)..(219): n is a, c, g, or t
  misc_feature (231)..(234): n is a, c, g, or t
  misc_feature (239)..(239): n is a, c, g, or t
  misc_feature (246)..(246): n is a, c, g, or t
  misc_feature (250)..(250): n is a, c, g, or t
  misc_feature (254)..(254): n is a, c, g, or t
  misc_feature (256)..(256): n is a, c, g, or t
  misc_feature (259)..(259): n is a, c, g, or t
  misc_feature (261)..(262): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (279)..(279): n is a, c, g, or t
  misc_feature (281)..(282): n is a, c, g, or t
  misc_feature (284)..(284): n is a, c, g, or t
  misc_feature (292)..(293): n is a, c, g, or t
  misc_feature (301)..(301): n is a, c, g, or t
  misc_feature (304)..(307): n is a, c, g, or t
  misc_feature (310)..(310): n is a, c, g, or t
  misc_feature (312)..(312): n is a, c, g, or t
  misc_feature (325)..(326): n is a, c, g, or t
  misc_feature (329)..(330): n is a, c, g, or t
  misc_feature (333)..(333): n is a, c, g, or t
  misc_feature (336)..(336): n is a, c, g, or t
  misc_feature (341)..(341): n is a, c, g, or t
  misc_feature (343)..(345): n is a, c, g, or t
  misc_feature (351)..(351): n is a, c, g, or t
  misc_feature (362)..(364): n is a, c, g, or t
  misc_feature (379)..(379): n is a, c, g, or t
  misc_feature (382)..(384): n is a, c, g, or t
  misc_feature (386)..(388): n is a, c, g, or t
  misc_feature (390)..(390): n is a, c, g, or t
  misc_feature (398)..(398): n is a, c, g, or t
  misc_feature (400)..(400): n is a, c, g, or t
  misc_feature (403)..(404): n is a, c, g, or t
  misc_feature (412)..(412): n is a, c, g, or t
  misc_feature (419)..(419): n is a, c, g, or t
  misc_feature (421)..(425): n is a, c, g, or t
  misc_feature (428)..(428): n is a, c, g, or t
  misc_feature (432)..(432): n is a, c, g, or t
  misc_feature (435)..(435): n is a, c, g, or t
  misc_feature (437)..(437): n is a, c, g, or t
  misc_feature (439)..(439): n is a, c, g, or t
  misc_feature (443)..(443): n is a, c, g, or t
  misc_feature (445)..(445): n is a, c, g, or t
  misc_feature (447)..(447): n is a, c, g, or t
  misc_feature (451)..(451): n is a, c, g, or t
  misc_feature (453)..(453): n is a, c, g, or t
  misc_feature (465)..(465): n is a, c, g, or t
  misc_feature (467)..(467): n is a, c, g, or t
  misc_feature (487)..(487): n is a, c, g, or t
  misc_feature (491)..(491): n is a, c, g, or t
  misc_feature (494)..(494): n is a, c, g, or t
  misc_feature (496)..(496): n is a, c, g, or t
  misc_feature (498)..(498): n is a, c, g, or t
  misc_feature (502)..(504): n is a, c, g, or t
  misc_feature (506)..(506): n is a, c, g, or t
  misc_feature (516)..(516): n is a, c, g, or t
  misc_feature (523)..(523): n is a, c, g, or t
  misc_feature (531)..(531): n is a, c, g, or t
  misc_feature (541)..(541): n is a, c, g, or t
  misc_feature (549)..(549): n is a, c, g, or t
  misc_feature (551)..(551): n is a, c, g, or t
  misc_feature (554)..(557): n is a, c, g, or t
  misc_feature (792)..(792): n is a, c, g, or t
  misc_feature (859)..(859): n is a, c, g, or t
tattatagacacgtgtttaacaacatatccagtgtacattttaatanttggcattatcaccacaggtagctttaattatataatcaacacttaataaatttccctacacatgtacatcaaatgtaaatngnggaatatccaatttancnntcctccttcaaactanctgttaanttactctntcttntttttttttnnnttttntnggnagtttttnnnggtgctctttannnnccgcngccggcncttnggcngngcngnnatgcnattncttncntncnntntgatgcgnngtgtttcntgnnnnccnanttgccataggccnngtnnttnccntagtncnnntctttnctgtgtagaannnctccccttcccgtgnatnnntnnncngctttctntntcnngttatgtntggcgtntnnnnngtngttnctntntntatntncntatncntatatatataantntgcctgttctagagtataantatnctntntncttnnntntttcccgtgnccgaccnttatttcntctggtttcngttttgtncnttnnnntacatctggcagttggggtctcccctgatctctggagacccagggatcctcttcccattccaagggtagacgcaccagcagagtcccgcctctccatccatggatgtctcacactgtctgctgtgataaaatccattcttgttgcagtttggcaggtaaaatttggaaatttcttctcctgatgtctcctgtgccttggctaaactctctacgactctgtagagttctattcggnagggctccttccattttttgatgttggtgacatggagagccttcgagccatcataggtactgatggngtccca

SEQ ID NO: 576097 - DNA, 829 bp, Homo sapiens
tatgctgtataccatgggttagcaaacaacagcacacaggccaaatctggcccactgcctgtttttgtaaaaataaattttactggaacacagccactctcattcatttacatcatatcaatggctgctttcgtgctacagtggcagggctgaatagctgccacagagactatggcctgcaaagccaaaagtatatactgtctggccctttacagaaaaagtgtgctgacgtccatcatatagtagtcacttgttttgacgatctttcccccttattagattgtgagttccaggggcagaagctggttctcttcatttttaatatctctctacaaaaatagagtgcttagtgaatgttgaatcaatgaatgatatatggtgacaaggaactgggtgaatggaagaagctctgctttacaaggaaatacaggagaaagtggagcagaagatgctgggtagattgctaaggtacagaaatgtggcaggaaggtgaggaacctgggaataaataggtgttgcctatagggtcctttcctagaaagtttgggaacttgcaaaggcagtctggagtactctgttggttttagaaacatatacctttacaaaatgaaacctgttttctaccagcttggattctgaatgttactaagatattaaaacagacttatgtggagccacaagggtttgatccacatggaaaattcttgtcaacggaaagagtggaaatcctgttacaagttcagtgtcgaggctactattgaaaagggtaaactccccgggcccaaatttcgtgaaatctcataaagggaagccccacaatgtcatgcct

SEQ ID NO: 576098 - DNA, 1075 bp, Homo sapiens
ggccgggtgacccactccggcgtgctgcgtccccgagcttggtactggctcagccctgtctcccccgaagcctggccgccctgctgcccgctgcccctcagtctggtggatgccctgcagccccccattgtggccctgctgtgcagctcccactgacctgtctgtgcctgcgcacctgccactggtcctgtcctgctgcctgtgcccctgatacctgcgtcctgtgctgccggtgtggtgcacccccatcgcggtggtcagcttgtgctagcccatcgctgctgtgccaccttcgattggttgctgctgcacgttcctgacatcgagaggcatcgctggagacatgcacaagacagcccactggatggaccacctggaagccattcgcagaggtggacttcccagtgtggcaccacggggatctgggacgccgccattcagccagctgcgaaaggggttgcatacagggggtcctattactggtgggacaacctataggaggatacgcaaaatcgcgggtcccccactatgaccagtccagacctcatttggcgaagcgactacagacgaccatcagtcaacagtggagagcgattccctgaggcagccccaccgattgacaagcacctgaaccggaccaacccacaggtggggtagtcgcagtcggccatagagcacaaaagccagtagggcacttggcagccctttatgggcgaacacatggtgatggttacacgacagagaacgtttggagacaatagggaactgcacaatgcttgccaacgaaccgccagtaatcaggttgtcgtgaaatagtttcgcaagcgttggtcaagaagagcggtgttggaaaggtggctggtggaaaccagctgttggacacgcgatgtgaccgcgagagtgatccacgatagtcggagttagaaaagatcccggtgatagggggcgggacatggaacaccacgcattggggtcagagacgacgcggggaaactccaaggagttggatgcaccggacgagggggcgaagggggaattggcgacgtagcgaaagtgtgagcgagagacgtgatgg

SEQ ID NO: 576099 - DNA, 714 bp, Homo sapiens
ccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggccccctacacacacacaaacccacacgcacacaccacacacacacacacacacacacacaccccacaccctgctcaagtttgtggtggtggtggctgttttaaactggggagggaatgggtgtctggctcatggattgccaatctaaaattctgcataacttgctagcttgttttttttttgttttttacacccccccagcccacccccagacttacacaatgttcaatgatctcatcataattcgttatgttaaacttttatcaccttttaaacctacatcattcacatattttgttcttctgttttcccctcaagtcataaactggtgttcattttctatatgtcattctctgtattttaataaaatttgtttttttaatttaccttttatacttactctttacccacctttttcaacctccaactcactgcttttaaccattttttccacattaaa

SEQ ID NO: 576100 - DNA, 682 bp, Homo sapiens
gcactccatatgctggctgaggagaatgcagtgatccagtgccagtgcccacctgctgatacccgagccaagcgcttcactaccctggtggccagagtctgaaaccggttgttccagattccactgcagaaacttggacgacagagaagttttcgaatggtgtacagacagaactactaactacgacaaaaactaaggacacattgcgtgctatgacaaatgaacagtggagatttctagtggaaggaggcacattgagaatacatgtagtgcccttactttatcatactctgagtggaaggattctcgagactcttcataccgaggacattgaacgacaacagacaggtcccaagcgggagggactatttcaccgaaaatgacactgtacttgtacaaatcaacacatgtggatatcgatagacaaaaacttatgctcaaggctcaagatgtcttccgaccaggcacaggacatctccacagtgtgcttcctccacgtgcttcctccaccatacccgtgaacagtatgacacagtcatgtcactggctctcttaaattataggtaataatgaatgagttgaaaaccacgtgccgcatactgtcatggaacatcggactaagacgcaattcacagaacgatagtcgaacaagccagctcctgcacaaaagagccccagtcag

SEQ ID NO: 576101 - DNA, 819 bp, Homo sapiens
ttcgatcagagcatacccctgatggaaacagaaagatgtggataaaaggccacgttttaagacaacaagtccacaaagagcaaagaggacagaaagaagaagcaaaattcatatgccctttctctccttgctcaggcgatttaacagccaccctgggtgaagggcaccattagctcctgctatggatgaggaagctgagacttagaaagtttaagcaagctgccatcagatacagctgatgggtgtacatttatattctgggcacggtcttcattctggcaccattgtcaatccagtggagcatctggtgtgttcagaggtttatagccggttcagtcccgacagttgccccctctaagctggaaatcactggtcctactagtctggataggagaactgcagctttgtttgacctgggggagatggtctgacttcaagttcctggacctgcagggaactgcaggacatagcgggcagaagagcccaggcagtggtttccgtttaggaagaggttgtctcatgatagagaagcacggtcttgctgcaccatgctggaaagctctgtccagcctcctgttctctgtccagcctcctgttctctgtccagcctcctgttctctgtctagtgggtgcaattgagtttctcccacccgtaaagaggcgattaagtcctaacccccggaacctgtgagtgcgaccttatttggagagagggtctttgcagatgtaattaattaaggccaacaagatggaacttaggatagcccttaagtccagtgactgacatccttattagaaggggagaggacacagccacag

SEQ ID NO: 576102 - DNA, 177 bp, Homo sapiens
acatacaggaaataacgcgagatctgtctacctgcccctagactacggaccctgccgggcctacttctccgtaactactacgacaggtacacgcagagctgacgacagttcctgtacgggggctgcgagagcaacgccaacaattttctacacctggaaggcttgcgacgtatgctt

SEQ ID NO: 576103 - DNA, 509 bp, Homo sapiens
caccccaccaaacagtgccctaagtcctaatgcaatactctttcctcttcaacgctgtgtctcccccatgggctggaacacagctctctccaatcctttcctctattctggagatcggcgaactacagcccaattcagccctccattgcctgtttagataagttgtactagaacacagctgtgcccatttgtttacgtacagtttatagctacttctgtggtataacagcagagttgggtagttgcaactgagaccatacaacccacaaagctaaaaatatttactgtctggccctttacagaaaaagttcgccaactcctgctctattccatggcaagagtccgactagtttgaatttaaaattcagtgtgttagctagatggaaagagtttttcaaagtgtaattatatctgacaaacaatttttgagtacaattctgtgccaggccatgtgctgttatggaagtttcataaataaattaaaaaatcattgccctcctgggtccctg

SEQ ID NO: 576104 - DNA, 778 bp, Homo sapiens
  misc_feature (617)..(617): n is a, c, g, or t
tgagcactggctgccagccttgtgtagcccactggcacagccatcccacccttggttccaacctgtatgcaaagcaggaaagggcttagagggggctgggtaattctaacaatgccagtgacaagtctgctggtggacgtcatctgtggcaatagtcagattgcgaattagcatcgtagtaaatggctggcataattccacggggcagagtttaaattgtggccgttgtgatgaacagggttagggtttatgctgccaatgtagatatttgtgcctccaaaatgttcaacagggtttgtatcgaagctccaaagtaatccttccaggaggagcagtctgaaggtgtccacttaagcatgggagtggtgcagggagtgcatagggggcaaaagtgatttaaggttaactcatccagaattcattagataggtgttcatccaacgtgaatctgcagagagaatcctagcctctgaaaaagaatttgtcacatcatttcctctattcacagaaatagttatatagaatgcgtagagccaggagcctcaacagacctaaagtgaatattagaaggcaacacaacgttagtggtcatgaggcccagattcttagaagctgancgctgaatatcaggcccaagtgctactattactactgtaagtccttaaagtgggaatctaaggctttcgggctccatttcatctgtacgtgcgatataatcttacctccaggttgggcggaagttggtccctcgcctcttttggacctaaccacgccgtgg

SEQ ID NO: 576105 - DNA, 151 bp, Homo sapiens
tggtgagagaactgacaccagacgattactggaatgtgcccaatctcagctgcacatcaaatgtacctgggatgaggtgtggtggagctttgaatctaccactattcagggcacacacctagaagctctggtttcatttgtttcatttgat

SEQ ID NO: 576106 - DNA, 308 bp, Homo sapiens
cccgggggttttggggaaaaaaaaattcccaaattttcccaaatttggtttgggaaaggagaaaaaggccaggtttttttcccaatggtttttccgttcttttaaaaaggtttttaaaacgggggttaaaggggttttgttgcccgggccggggaaaataaacccccctttgggggccccttaaaagggggaaaacccggtaaaaaaggtaaaagggggccccctgcccctgggcggggggttttttgggttttttaaacccatttttttttttttccagggaaaaaaccaaggtttttttccttgga

SEQ ID NO: 576107 - DNA, 254 bp, Homo sapiens
tactgtagtagttgttggggcccacggacccactctcgcttcttggcgtactctgtcatcttttcgggtgtgttgaagaagatggatccgggtgggctcagttgaaaaggattttctgcgtaggccttctcaatgtcacccagcgatctcatcccttatagtgtcgagcagagatgtcaatgaaggaaggtgtagctctcggcgggcatgttacccttggccatgaacactttgttgtagctgccctccatcag

SEQ ID NO: 576108 - DNA, 956 bp, Homo sapiens
  misc_feature (26)..(26): n is a, c, g, or t
  misc_feature (103)..(104): n is a, c, g, or t
  misc_feature (139)..(139): n is a, c, g, or t
  misc_feature (148)..(148): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (159)..(159): n is a, c, g, or t
  misc_feature (166)..(166): n is a, c, g, or t
  misc_feature (233)..(233): n is a, c, g, or t
  misc_feature (261)..(261): n is a, c, g, or t
  misc_feature (332)..(332): n is a, c, g, or t
  misc_feature (334)..(334): n is a, c, g, or t
  misc_feature (458)..(458): n is a, c, g, or t
  misc_feature (488)..(488): n is a, c, g, or t
  misc_feature (513)..(513): n is a, c, g, or t
  misc_feature (549)..(549): n is a, c, g, or t
  misc_feature (595)..(595): n is a, c, g, or t
  misc_feature (751)..(751): n is a, c, g, or t
  misc_feature (756)..(756): n is a, c, g, or t
  misc_feature (782)..(782): n is a, c, g, or t
  misc_feature (944)..(944): n is a, c, g, or t
ttataattatagattatagatttttntaagttaataatatgcagtgtgttggggcgctgcgtgtttaacatttaacattcatgagtaaacaaaaatggccggnnggtaaatatcttgccaaggtggttcttggtttttngctttttgngtntnanaggnggggggngggtaggggtgagggggttttcccgcacgaactcttgtcaatgagaaatccctcagccccttttgtnttgggtctcacagctccagaagtgagcngggccagaacgaagccatcctagagtccccaaggacagccctcccgtggaccccggctagggcccccagantntcatcctcaggagtgcgccagtctgggcctgcgtgccggcggggtctgcagccacaggtcccgcgagttccggacacttccaggacgtggtctcctggtgagacagctcctccgggtaccagtntcgactcctccgggcagcgacaacaaagtntgcggtctactcaggcctccttgtnatccaccaagccctctctggcttcattggtactgcngcagtgctgggcactagtatctcctggcgtctctgttgcacctgangttccacggctggatggtgttccttcctggtttcaccaaggcctcccacaccagagtctcatctttcttgtctttcacttgcagcctgatccctgatcccaagtggccaacgtagaactccgagaacagctggtcttctccagggcttcgatagcngaccnccagttccttggagagccacaaagcnagggaggtgcacagcttccacagctccaggctcagccttgatgtccagcagaggccctgccaccatccagctgtgctgtggggttgatctcacccaggaactggtcccacacacagaattcaatctcaacggtcaccgcttctctcatcacaaagcagaganccgtgttgggca

SEQ ID NO: 576109 - DNA, 1399 bp, Homo sapiens
  misc_feature (483)..(483): n is a, c, g, or t
  misc_feature (577)..(577): n is a, c, g, or t
aaggagtagctcagacactgaatcgatgcaactatctgttctatgtagtggtggcctatctggtccaagagatgtcagactacagtgtggctggagacccatagcgaactgccgaaccatcatcagatccagcagtcctcggtagtaacaacagcagacgtagagctgtacttgcagttgataatcgaagcttcgtcttagggacagtttgcttgtcagaaacaccgatagggcgtgcagcacggactcctagccatactgtgttgaactctgtgatagcctacctatggtctgtctcgtgcttatgctagctgaacgatggggggtcaacgcaagcgcctggccgtgcgggcattcgcccaggagccatcctatcaaaatgttctgaaccgtgctgatgaagcgtgaggcgtgtatgacagcaatgagatgcacgcgagtatctacacacgcggagcgtggcattctgtgcttgtactgtgnctcccgtgaacgtattgcgtcccacaaacgtgaactccaagtcccgggaggatcaagacccaagaggcagatagcacaggtagaccgcccgtgntaacccggaatggcgccaggagaggccgtcaaacaccgaagccccagaataggtgttagcgaaactggccctgagaggaacaattattgactattggagcatagacgccttgcctgtgacacactcgcgtacgcaacattgagacccctgtcctaaagcaattgaaacagaggttggtgactcggaatcgggacatgtgttccagacgggagagcggcacggacaaccattgggtctccgaggtctgcgacactcgcaggcacggagatctggaggaatttcgagggctacagaaaactgtcgtccttctaaatatatagggtcaccccaccacaacatcaaaacaatcacattcaaaggcccacgcgacataaagtaaatctttcccgatattagcgacatctgttcgcgggacgttacccacagacagaagacgaaaattgggagcggaaaaagcatacgagggcttggcacaatacgatgggaacaatcttccacccgaaccgcttaccgagcagggcgactatgagcaaacattttgttccacgggccacagttcgcatttgcacctattggtcggaaaagacacaggcgcacacaggcgggacaaaattgccaaggggcacgacatcgtgtcaaaaaggtctccaaataactacccagacggccaacagagtccatgcgcgggaccattagattgcccaggcgcagccgcaaaaggggcgcgtttacacatgggacaacactgggtgtatatcacgtgggccctcgaggcatacaacattgttgcaccataggacacgtgggcggtaacaaagagag

SEQ ID NO: 576110 - DNA, 715 bp, Homo sapiens
  misc_feature (715)..(715): n is a, c, g, or t
taggtaggaggctgggtttaaccggcgcgcaggctcgggccgctcccctttcctgcgctgcgtccggagcggccccggtgccgccaccgcctgtccccctcccgaggcccgggctcgctgacggcagagggctccgtcggcccaaacctgatgccttggtgctgccctgctgtgtcctgggtgcatgcctccactcctgccccccatgtcacctgccgtccctccgtgcccctcgacagtggcgtgccctttccctctcgctatctcctgtgctcccctgctcgcccgtcttcgcggtcatacacacatgcacacacacacaacataaaaacacaccaactatcccacatcaacccctcatccctacacacatatcacaaaacaactcccaacaccaccccacaccacgccacgcacaccaccaacaacccaacacacacaacacataaccacacaacacacaccatatacacactcactccatcgccacgcacacgacacagacaaccctagcccccacacacaccatgacgcccacacacaaacccacacctccacacgcgacaaacacagatcagagaaaaagaccggagcgcaaccacccccacgcccaaagcacacagaccacccacacgcatcacagagcccacccgccccaaccagacgccccacacccaccacccaccacgcacccccacacaaggaacaagccggn

SEQ ID NO: 576111 - DNA, 294 bp, Homo sapiens
gaattcggcacgaggttaacacagaccaaacacatgcacgctgcccccaaatttaaaaacgttaggcaccaaacagaaagtaaagaaaaccagaaagtagtgatgcaccgatgacattttttggccgatatggatatcctatattttccttgccaaaaaaacaataccgataaccgatgtttaaaatttttgcggccttttaagcattctaatacagttaaatagttaacccacacacacagcattctaaggcactgcatctcagtgcaagaggagtcactacagtcccaggtt

SEQ ID NO: 576112 - DNA, 200 bp, Homo sapiens
tgatgagaggactggaggaggcttgagaccatgattctctgttagtagaaactaagctctcaagaatccagtgacttgctaacaacccctcccccgcataagttagagacacagcaggggcaaaacctgtatctaatttttcagccagtgttcactaacagagtatccgtatatctcgcagtcttcggtgacagttattt

SEQ ID NO: 576113 - DNA, 607 bp, Homo sapiens
ggccataatcgtgtcttgtaccaagccgtgtctcagagctctgtcaccctggagtatgtgaagggcgtagacaacggatttgggccagattaccagctggccatgaaggctggtcccatctagagtgcagaagatgtcgcgtcccatctacaagcgcgtgcttgaccgggaattcaacgatggcatcttagagaatcgttgcactcggggccaatgtcacgggaccctggatgtgtgaccactgtgtagctggcaatgcctgcggtttatatcaacgtatgcctggagcgggataccgttcaagacaaggtgcgcgaagctgagcgctgagtacatcttgcagtgctttaggcggaattacaccatggacaacggtgtggccacatccagggtgcagctccatggcccttaagctcactgatcgggtatgcccccatgttagactagggtggagacccgagggattgcataccgtttagatcagtagcgagggcttcttgggggccaattgtttgggaacttgggtaaagttgtccacagaaatttttttatccgaaggcccccttgtttccggcattgctttgtccccctattttggtccttccgg

SEQ ID NO: 576114 - DNA, 364 bp, Homo sapiens
  misc_feature (37)..(37): n is a, c, g, or t
gcttccccaaccatttcttcttggataccatcaagtnacagctccacttggcaaataatagctgttacttgatggtatccaagaagaaatggttggtgatggataccagcatgtatcagttatgattgccaggtggagctgtcaggtaatttgagtgcagctctggattcagatgaagcattaagattgtcttcctcggattctccatcgggtgtagagtttttaaactataaatggcatttcaagtcttctgaaacagcatggctgtatgtgcgtggtccatagcacagtacatgcagcatctaataagagtttccattgtagaatgtgttcacatacttgaataaagtcaaatctttaattg

SEQ ID NO: 576115 - DNA, 186 bp, Homo sapiens
  misc_feature (37)..(37): n is a, c, g, or t
  misc_feature (131)..(131): n is a, c, g, or t
  misc_feature (181)..(181): n is a, c, g, or t
gcttccccaaccatttcttcttggataccatcaagtnacagctccacttggcaaataatagctgttacttgatggtatccaagaagaaatggttggtgatggataaattcagaaatgcttccccaaaggtnggtgggttttttaaaaagtttcaggtcacaacccttgcagaaagcactgnttgcc

SEQ ID NO: 576116 - DNA, 399 bp, Homo sapiens
  misc_feature (308)..(308): n is a, c, g, or t
gtttgccttctctttcctcactaagggctctcagttatccacgccaaggctccagcaggtctgtccaccagtgtggtccctacgccacactccggtaggggtcgtcaatgccgaaagcagcaaggcgaccttccctagtccctaagacgtgccttggatgcgcctcgtactcagggatatcaccagacgaggcaagatgagatgcagaaggagcagctgagaacgcatgaagaggacaccagcaaggcccatggtccgaagagcgcaaagaggacactggcgccaagggagagaggacgggcctgccnctcatctcgactacctcagccggccgctccctgagagatcttggctcagtatgttaggaggggccaggcagcggggcagggacagggagcc

SEQ ID NO: 576117 - DNA, 227 bp, Homo sapiens
tcacgtgtatctattgttgacactctgtaatctcatctgtgacagtgttcacaggagagattgaggcccaaggttaattggttcgcctctcacaccctataatacgtcccaccttgaaataatttaagcccaaagttttaatgtttagagcaatccagtagcttctccactgctcatttcattaacattaatctcaccatagtgtcaatttctgtgccgcgatttca

SEQ ID NO: 576118 - DNA, 222 bp, Homo sapiens
gtcaaaggcacagtcattacgctcccccggggcgggctgtggggggggatgggtcacatgggcaacaaggggctatgccaggtggccgggcctctgaaaaacgtaacttatcattggtattttcacacaggcacggaaaagggtcagctattcttttttttttttttttttttttttttttttttttttttttttttttttttttttttttttttttttttt

SEQ ID NO: 576119 - DNA, 269 bp, Homo sapiens
cttgcgtagaatatgggtctcactctgtcacccaggtgggagtacaggggcttgatctcggctcaccacagcctcaacctcttgagctcaagcagtcctcccacctcagtctcctcagtagttggaactataggcacacactaccctaccttgcccagccaatttaaacgttttttaaaagaggcagatcctcactattttgcccagtctggtctcaaactctgtgcctcaatgtgttaatggtcgtgtaatctctcatgtcatacatg

SEQ ID NO: 576120 - DNA, 131 bp, Homo sapiens
taacgtctgacgactgggatatagagttgtcattccttgcttgtgccttctcaatatttccagcacctcctgatgcagagaagactctcagaactggaggagccatgggggtcttcccagcttgctcaaga

SEQ ID NO: 576121 - DNA, 160 bp, Homo sapiens
ctagaggaggcgctatacacccactgctgtcactgttctcatccaggctgccatcagcttcttcagccctcctcatacactttctccccacaaaggtgggagctccttgtgcagaagttcttcatttccccttatcagcttgacttgtcgcctctttgga

SEQ ID NO: 576122 - DNA, 432 bp, Homo sapiens
aagcccagccccgtttttttatccccagtgcctggtgacgccacatcctacaagggggaggggccagagcacaaggagcccaggaagggttgggtcttgaaggaggggccaaggtctggttccttttaaaacctgcccggcagggtaggggagggtcccgtcctggacaggcctgggatggaccggcaggagcggaaaagggcacggggggattggaaggccctgccctagaagagttgaactggggggaggcaggcccagcccccgcccgggctaaggttgcccctccccttccccggctcggaggaaagaaaagcaaaaaaatgtggggaagggtgggctgtttggatttgttcccttgggtttttttttcctgcccaatttttgttatttccatcccacatgaaatgaaaaaaaaaggtttttttatta

SEQ ID NO: 576123 - DNA, 894 bp, Homo sapiens
agcctacctcgcacaatcctgatcatctcgacattcctttgaaatgacccgatagaatgcaccacatgaaaccatcctaattatctgccaggctcatccatgttcatcttacacatttacgtctctcaattaaatgactccttcatgatggggtcgcaacgtcttgtcagctaccagtaccgaatatgatccattaagtatgtacgcagaaagtccttcctaatataaatctcagatgtcgtcaatagtattgagctgaatcccataactgtatccaaatagtgcgtcgagcccgtataccttaattctatatcgcaacaggaaggaatgctaagcctcgcaaatagctcgggttcatgccatccaccactggctttcatgatggaggtctgaccacacgcataaaccgggtttactctgccaaaattgtggcgcattggttcgaagccatctagaagtcacaaatacgcctcatcatccgcatcatccatcagccagcgatgaaatcatccttggtgctctagttctacctaaggccctaattgtactcgacctcaattcaggctaactcccccatatctaacaagtagacaagttaacactgagtagtttcgaaccataacaaagacgtcgaggcgccagttggcttgcacccaaccagcttgattcggaacctacaagcgaggctaacttcctgagacttaagtatccccctttgtgtaagccccacgccgatgttggtggaccggaattccaccgtcacctccacctgggctcacacattccttcccacgaactcgcttcgcaccccggcgcaaaactactaccaccttacatctcgacggtcccctcgccttcacaccgccgctgacactggcttcggcaaactgcttc

SEQ ID NO: 576124 - DNA, 115 bp, Homo sapiens
tggcgtcgtttacattaacagctataaccatcactgcgcgtcgttttacactaacagctataaccatgcactggcccgtcgtatttacacttaacagctatttaccatgcactgg

SEQ ID NO: 576125 - DNA, 1529 bp, Homo sapiens
agatccgtgtccaccccgtgccgaagatgactcccgatgactcccagtgttacgagtgaggttcaagcagtcctgtccatcccaagaccactaagtccagattccagagcctccagtctttctgacacagttctcctcccgaaagcaatgcaagtttcaggcacctgcaagcagcagcactgcgtggaatgtacgagcaagcatagacatatctcttctggagcgtctcattggccaaaacagccaggatgtatacaaaatcagcatgaccattccagattgcatccataattgcaaaccaacaaacgtcagatctcaggaaacatatgcactcatatatacatggacaagcagtactatagataagacactcacatatcaaatccacactcctctcaacatcctcaaggcgcaaacatcatgcatagcaagagcctcaaggcgccacacgcacacaccaccacaggcaccacaacgcgagcccaagccaccaacgcaagacacaacgcacaccacccactcaaagcgcagcaaccagccacccaccagacacgcccaaaaaagcacagcgcgcacagcaaaccccgtacaccagaaccccacgcgggagacaagacacccgactcgccccacacaacatgaccaaaaagcgatgcacagatggccacacagcgccatgccacacacaaccagagagacaccgaccacacacagccccacccatccctccccgaccacgcgcggcacacggacacgccccacaccagcccgaccccgcaaacaacacaccaccaccagcacctgtactgcgccaccgcaccctgcgcacaccacccacacaccaggaccccacgccccacagcacccccccacccggccccctgcccaggcacgcggcagcccccccccctccccccgcccccacagcggacccaacccacgaacgcacaaacaactcccacccaccacccaccagccacgacccccctggcagcgactagacaacaaacaacaagcataacacaccacagaaccgcagcaagcacaccgatcaacacacacagaccaagaccgcacacacaagccactaatccacacggcgcagccaaacaaccgaacacggcagcccaacgtcagcgacaaggcacacaagaaaacgatggtcacccccaaccaccgaccgcacacaccagacggagcgcagccaccagccagcactcagccaacaccaatggcaccacacgacctacgcacgacaccagccacccagagcccgcaaccacaacagcacaaaccaacacccatcccgcccgccccgcgcgcgagcccaccgcacacaccagcccaccgcagacacaccacgcacacaccgaggaaaccaccaacatgaacagcaagccgaacgcacacgcagaaccacgcaccgcacccaacaccaagacgcacatgaccacacagccagcacccacaaccaccaacccccgcaaccacccaacccaccacagcgcgcaaccagcagaccacgcagc

SEQ ID NO: 576126 - DNA, 1121 bp, Homo sapiens
  misc_feature (464)..(464): n is a, c, g, or t
  misc_feature (474)..(474): n is a, c, g, or t
  misc_feature (485)..(485): n is a, c, g, or t
  misc_feature (488)..(488): n is a, c, g, or t
  misc_feature (491)..(491): n is a, c, g, or t
  misc_feature (493)..(493): n is a, c, g, or t
  misc_feature (502)..(502): n is a, c, g, or t
  misc_feature (509)..(509): n is a, c, g, or t
  misc_feature (537)..(537): n is a, c, g, or t
  misc_feature (540)..(540): n is a, c, g, or t
  misc_feature (544)..(544): n is a, c, g, or t
  misc_feature (546)..(546): n is a, c, g, or t
  misc_feature (554)..(554): n is a, c, g, or t
  misc_feature (570)..(570): n is a, c, g, or t
  misc_feature (574)..(574): n is a, c, g, or t
  misc_feature (576)..(576): n is a, c, g, or t
  misc_feature (585)..(585): n is a, c, g, or t
  misc_feature (593)..(593): n is a, c, g, or t
  misc_feature (601)..(601): n is a, c, g, or t
  misc_feature (897)..(897): n is a, c, g, or t
cggccgccctgggagccggcccggccgcggccccggcccccgccccggccgcctcgctggctccggttcagtttaatgatgtcgtccagagacatgtccattttgtcggccatggcgggcgcggaatcgggcatcggctcgagcccgcgcgtcagcacgccggcacgtcacttccggcgccgcgtgaggccttccggtgccacggcctcggagcggctgctgattggccgctggcggacggctgcgcgcgcgggacggggtgaggcggggaggcgcgtgcgcactggcgtgcgagactcggcgggcgctgttgagggagtcgggccgcgactgtggtcgtttttataccttcccgcgcggacgccggcgctgccaacggaagggcgggtagggcgagacggagtttcgtcatgttggccaggcccatttgagatctttgaagatatcctcaacgtgaggctctnctgccatganggtgaagatangtnctngnacggcgtgnccacttngctcttggtggccaacgatgagaacttngcntctncnggatggcntttacggatctgcctnactncnggtgcccgngacgactncccctgtntggggccagtgctcccactgtcttccacatgcgttgcgtcctcaagtggttgccgcacagtgtgggtgcctgctagcatggcccattgtggccgccggggaatggagtgtcaaggaggtggaggcccgacctggctctcgcttgaaggggccatccttgagactccttcctcatgctggcgccgatggctgctggggaacagcgccctgaggctgcaacaggtggaaccaaggggctggagctgcggtttgttgccatcactatttttgaccttttgccatatgtgaaattcattnagttactcaattcttgtggaaaacaacctgtaaaaaaaattgtcggcggccgcgcaaaaagtttaaccactcttgtgggcgccgccggaggtgggaatggctatgtccaaggaccgggggattgcggtgttccccaaaaacgcgggggcggtttgaaacatggtcggtcttgtccagcgcatccccgcgcgcgtaagaccagaacaccagaaaaaaacagagat

SEQ ID NO: 576127 - DNA, 169 bp, Homo sapiens
aaatggcattagcttatcatatttatgatcattacacaatgacgaatcctggatggtttcgaccgctcgtgaaccggttgcgcagcagcgcattccgatctagattacgccttgtgaatgacggcgttgaggactcattggccattgggccgcccagcaaacgaaaatt

SEQ ID NO: 576128 - DNA, 572 bp, Homo sapiens
  misc_feature (493)..(493): n is a, c, g, or t
cggccgccctgggagccggcccggccgcggccccggcccccgccccggccgcctcgctggctccggttcagtttaatgatgtcgtccagagacatgtccattttgtcggccatggcgggcgcggaatcgggcatcggctcgagcccgcgcgtcagcacgccggcacgtcacttccggcgccgcgtgaggccttccggtgccacggcctcggagcggctgctgattggccgctggcggacggctgcgcgcgcgggacggggtgaggcggggaggcgcgtgcgcactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggtgcgagggcgcagggggtggggcggcggccgttggaggcggagcctacgcgcccctccctccccgcacgctccgnccgatcggccagggctgggggcgctgggggcgctacgggcgcggcgggtgcctgggagctgctgggagtccttgtttcc

SEQ ID NO: 576129 - DNA, 110 bp, Homo sapiens
gaaccccatctctacgagaaaaatacaagaggttagctgggtatggtggggagcgcctgtggtcacagctacttgggaggctgagctgggaggattgcttgaacctggga

SEQ ID NO: 576130 - DNA, 148 bp, Homo sapiens
tcgagagcatggtgatgggacagttctgtatcttacattgtggggggtacaaagacacacgtgataaaatgcatcgagtttttatttgtttgtttgggacggagttttgctctgtcgcccaggctggagtgcagtggcgcgatctcgg

SEQ ID NO: 576131 - DNA, 334 bp, Homo sapiens
aataattaaaggagtagcattctattgattgtaacacagagaataaatgattgaggggatgaataccccatctttcatgatgtaatttttatgccttgcatgcctgtatcaaaacatctcatggacctcatgaatatatacacctactatgtatccaataaaagtaaaaactaaaaatttaaaaagattttaagacagaataacttcattagtcaaaaaaaatgacgtttttcccagaaatagaaaaacaatcctgtaatgtatacagaaccacaaaagccccaggatagcccaagctttattgagcaaaaagaatgaaactggagaaaaaaaa

SEQ ID NO: 576132 - DNA, 364 bp, Homo sapiens
tttgggtcgtaggaacctggtatgagtttcaataaatcaggaggtgcttccgtttcaccatcacttacttctacttcagtaacaacttttacttcttacacacttaaataataaagtacaacaccctgtttatcaagttaactatcccaccgatcttcagttgtagattcttctacctcaattcgaactggaggataattagcaagtcatttccccattactaccggataagcagtacttgcatcacatcctataataacttcaacttcaacattattcactctttcaaccgaaaatcaaacatcctaacgggttcaatatactccctctctgattctttttaatgctctcttctctactattc

SEQ ID NO: 576133 - DNA, 430 bp, Homo sapiens
  misc_feature (15)..(15): n is a, c, g, or t
  misc_feature (21)..(21): n is a, c, g, or t
  misc_feature (54)..(54): n is a, c, g, or t
  misc_feature (69)..(69): n is a, c, g, or t
  misc_feature (97)..(97): n is a, c, g, or t
  misc_feature (144)..(144): n is a, c, g, or t
  misc_feature (149)..(149): n is a, c, g, or t
  misc_feature (151)..(151): n is a, c, g, or t
  misc_feature (184)..(184): n is a, c, g, or t
  misc_feature (229)..(229): n is a, c, g, or t
  misc_feature (236)..(236): n is a, c, g, or t
  misc_feature (258)..(258): n is a, c, g, or t
  misc_feature (262)..(262): n is a, c, g, or t
  misc_feature (267)..(267): n is a, c, g, or t
  misc_feature (275)..(275): n is a, c, g, or t
  misc_feature (311)..(311): n is a, c, g, or t
  misc_feature (313)..(313): n is a, c, g, or t
  misc_feature (322)..(322): n is a, c, g, or t
  misc_feature (329)..(329): n is a, c, g, or t
  misc_feature (336)..(336): n is a, c, g, or t
  misc_feature (349)..(349): n is a, c, g, or t
  misc_feature (359)..(359): n is a, c, g, or t
  misc_feature (370)..(370): n is a, c, g, or t
agggaatttaaagcnaattcntgggtgggcgggaattttgggggaatatagttnttaggttccagcttntaccatgcaggagagaacacagaaggantgatgtatgttggtggatccatgtatgtgtccagcacagcggcctgntggantntgagaactgggaaagatcagagcaagccttgcnttttattttcgggaaaccagaatatgtttggggtggtaggagccncacaganttttttgagccccctcactcanttcnttccncctgtgcntttcctttgagagtgaaggtgggtggagttgaccananaaagggganagaattngggaaanacccaaagtgttngtaatttttntttgtcctttnacctacagaaatggtcacatgttttatttaaatagcctaataaacacatttggagcctgt

SEQ ID NO: 576134 - DNA, 154 bp, Homo sapiens
  misc_feature (70)..(70): n is a, c, g, or t
gggcggcgaggcggagctggagaattacatcgagcacgtgctgctccggcgcccgtgactgcccttcccnggtcccgccggcggcacgagggggcaggccagggtaatatcggggcgggcgcggtgggggctggggcgcggccgggggtggtgg

SEQ ID NO: 576135 - DNA, 104 bp, Homo sapiens
cctcggtaccagggttgtggttaccctacagagtatacttgaactatttgcatcaacagtatctggagctgtaatttttcaagtaactagactctgagacaggc

SEQ ID NO: 576136 - DNA, 436 bp, Homo sapiens
gcactttgggaggctgaggcagacggatcacctgagacttgaggtcaggatttcgagaccagcctggccatcatgatgaaaccccatctctgctaaaaatataaaaattagccaggcatggtggtgcacacctgtaatcccagctacttgggaagttgaggcacgagaatcacttgaacctgggaggcggatgttgaagtgagctgagattgcaccactgcactccagtctgggtgagagtgagactcagtcttaaaaaaatatgcctttttgaagcacgtacattttgtaacgaactgaagctcttattatattattagttttgatttaatgttttcagcccatctcctttcatatttctgggagacagcatgtttccctacacctcttgcattccatcctcaacacccaactgtctcgatgcaatgaacacttt

SEQ ID NO: 576137 - DNA, 149 bp, Homo sapiens
cacgagggtgactttgaatctccttctcacttggagtggaagttgtaggattctgcccctaggaaatgtaccatccttctgaataattggaccctgtaagagctggtccaggggactgaactcccggcatctttacagagcaaagcatt

SEQ ID NO: 576138 - DNA, 373 bp, Homo sapiens
attaggcgctctgcgtctctctatttagtgacaatcgtattttgaaatcctgccgccagatttgggaagctcactatagttgcagatactcagccttcgcggataacgacctgatctcgctgcctaaggaaatcggggtagcttaccccgcttaaagagctccacattcaggggaaccgcctcaccgttctgtccccagaactaggaaacttggattttactggccatatgcaggtcttcaaaccagataacaatccctggtgtgacccccattgcagaccagttccagcttgccgtgtcccatgtttttgagtatatccgttctgagacatactaatacctctactgcagacacatgcaggcctacgctgaa

SEQ ID NO: 576139 - DNA, 148 bp, Homo sapiens
gatttcgcaagtcgacgcgtagaggatccccagccgtaaagtgaaatgataaattgaatgagtatggaacctagcaaagctgttccacagaatgcatctaatgcaagatggacctatgccaaataccacacagtgttatcacggtggt

SEQ ID NO: 576140 - DNA, 180 bp, Homo sapiens
cacgaggtgggcgcctatcttataacagcttgcgcatatcttcagacagccctgattttgagtcagtgcacggagggcttgacccatccacacctttaggccacacctctcccttcctgtcagccagcctggctcagcaagggtaatactgtgaggcacccaggtttggtgccaactggc

SEQ ID NO: 576141 - DNA, 137 bp, Homo sapiens
gtagaatcctcagcatataccatcattggctgatacaagaagaatagatccgataaatatttagtcaagtccataatgtctaccaatcaaggctgccgggagcatctgaagtgagcaaagcagtcattacgagctca

SEQ ID NO: 576142 - DNA, 197 bp, Homo sapiens
cgggggggaaaaaataacccccctttttttccccccgggggggggggttttatttggggggaaaatcgccccccggggggggttttttttgggggggattttccccttttgggggggggtttaaaaaaagccccccccccccctccccttttttaaattttgggtttttttttttaaagggggtttgtttcccccca

SEQ ID NO: 576143 - DNA, 557 bp, Homo sapiens
cgagggttcactgtctcttacttttaaccactgcaattgaccttgccctgaagagtcggccatgacaccgccaggacgagtagaccctatggagctttaatttattgaatcgccccccagtactcttgccaacccacagcgtcctttgacgtacacaaacactgcccttctaaaatttcgggttggggcgacctcggagcagaaccccacctccgagcagtacatgctaagacttcaccagtcacaagcggactaactatactcaattgatcccataacttgacccacggcacacagttaccctagggatccacagcgcaatcctattctagagtccatatcaaccatagggtttacgacctcgatgttggatcaggacatcccgatggtgcacccgcttatttaaggttcgtttgttccacgactccacctccctacgtgatctgagttcaaaccgcgatgttttcccggtcggtttcatcctaccttccaattcctccctgtacgaaaggaacaagagaaataaggcctacttcacataagcgccttcccccgta

SEQ ID NO: 576144 - DNA, 390 bp, Homo sapiens
  misc_feature (9)..(9): n is a, c, g, or t
attcgcggncgcgtcgactttttggtagagacagtgtctcactatgttgaccaggctggtcttgaacacaccaggcctaaagtgatcctcctgcctcagccttccaaaatgcaaggattacaggtgtgagccactgtgcctggcctatacttcctttcttaatcaactttgtttttatttatttatttatttatttatttatttatttattgagacagggtctcgctctcttgccctggctggagtacagtagtgcactcttggctcactgtagcctcgacctccggggctcaagtgatcctcctgccttagccccacaagtagtgggactataggcacacaccaccatgcccatctaaggtcgacgcgggcgcgaatttagtagtagta

SEQ ID NO: 576145 - DNA, 414 bp, Homo sapiens
accatttgaccactttcctggagcagctaccgagttccaggtgctgtgccaggtgctgggatccaggggtcagccccagccaggggcagggcagtgggccgcatgcatgtggacaagggtaagttgtaaatatacaatttacaatacatattacaaggaggacctgggtgaaggggtgagcaaatgagtgagtgcctgcctctctgccaggcagccagtcagccacaggacagagacacaagagaagtccctgcagggtgaagaggctgcagatgggacaggacatcctgacagggaaacaggacacacacgggcgccgcccaggctaaagggctcaaaacgcagggaagcggcccccgacagcttatcctaacatttgtagaagcagccacagcaacaaagggcacaacaaaa

SEQ ID NO: 576146 - DNA, 185 bp, Homo sapiens
ggagaattatcacccgaggtcttaatcaagaggaaatatattcacctatttgagtgaaaatcagctataggggtatcaggcatgggtgcgatccagagcattcaaatgaacccccaagcgagttgatttctctctactcgtcagctctcgtttttggtctgctcagactgtattcacacgaagct

SEQ ID NO: 576147 - DNA, 231 bp, Homo sapiens
tcggtacctctttaaatgcatagcactcccttactgtgaaataaaactgtctgtctcttgctggttggctctcctcttagcaatgctgggcttgctcatgaatgtttcagagacctgtggacttgactggactccatgtgagttgcttgtacttggaatgcagtcatgacacatctgaatgtcctactgacatgtcacaattgtccttggataggaaatgggggatcttgt

SEQ ID NO: 576148 - DNA, 184 bp, Homo sapiens
gaattcattctaactagcatgtggatagtccagtctatcccagcaccatttattgcagagtgtcctttccccaatgtacttagtggctttgttgaaaatgagttggaggtaaatgtgtggattaaatactgggctctctattctgttccactggtctgagtctgtatcaacctgcatggggaac

SEQ ID NO: 576149 - DNA, 467 bp, Homo sapiens
taaatcaaaacccaaaacacttataatattaagcattgaaataaatgtcagccatatgcacatttttttaaattaataaaaacaagataattgcccaatttttggccaattactgagtaacagcagttgtggtggtgggttaaatcagggaataaatatttgcaaagataaaactgtaaggagcccctcctccccccatacagctcaaaacaatcacaaatatggtgggctcattgagcactttcctacgacatcatttattgttggacatttgtatgattattggatgctttattacaatcatttgtatccattcattttttaaggcactttttccagttcagggtcatcaagggtggctggaggctatcctggaagctcggggtgcaaggcggcaaccccccctggacaggaccccgtcccatcacagcacactcacccacacccacccaaaaacagggtttgta

SEQ ID NO: 576150 - DNA, 770 bp, Homo sapiens
  misc_feature (99)..(99): n is a, c, g, or t
atttctcgctggttcattcacgtgtcaaacaagattttaaaaagcagattccattttcactgtgtagttgaatttactagtctggaagaagacaggttntgatgtattcaatttctttttaaactccgacttcaataggccttaatgtaaacatcaaacatagcaagtacacatctgcacagtcagcattagtatccctacccgtacgcctggaaagtgtaattatggccgggaacagtggctcgggcctgtagtcccagcactttgggaggccgaggcgggccgatcacggggtcaggagttcgagaccggctggccggcgtggtggagccctgtctctgctgagaatgcaaggaattagctgggcgtagtggcgggcgcctgtagtcccagctgcttggggggctggggcgggagagtcgcttgagcctgggaggcggaggtttgcagttgagccgagatctgcgccactgaatccagcccagtgacagagctgagaactcctgtcttaacgaaaaaaaaacacccaacacataaaacacaaactgtgttcgggggcgccacatggggcccctggagaaaaaccttttcattagaacaatcctggtgtggggccggggggccccaagaataggtaaatccgaacaacggtgtcaacagcgggggcgcaaaggaaacccgggggcctgaaacaagtgcggggcggattcccacacccaatataaaaaaggccgggggaaaaccagcacgggtcgggaacaaatcgcaat

SEQ ID NO: 576151 - DNA, 140 bp, Homo sapiens
atcgacgagtgttctctcctcgtctttcgtctctcgtcacacatcgcacacatattacacacagaaatgtaaggttccatcactggtaaacaaaatcatcctgactgaaaggctgggctttttgttttggctatttggtg

SEQ ID NO: 576152 - DNA, 866 bp, Homo sapiens
tgactgtggttggactgacctgactgccagatggtgggactgtggtcctggagcaggggactacttggaaatgataaaggcaaaactcaacagatccctggagctgcgcttgtggtggagctggacccatgaaagttacctggaccttttgttttgagagacagggtttctttctgcagtctcaaactcctagccttgattgatcctcctgccttggcctcccaaagtgctgggactacaggtgcagtgctaagcacacctggtctaattttcttttcttcatttctgttcctttgtttatgttatttttatgacggagtggcgagtgtctggtccttgggtggccacagggtttgggcattggcagtggggtgctaagttctcgggctccttctagggaggtcgctcttcgaccctcgtggggttggaatctcatttgctctggcgctagaggacttctaccaaggtgaggctgggggagtacatagggcccttgttttccaatgaccgggcgcataattgtcgggtgttatacacgaaaacagcgggggtttcgtccatgttgggtgccaagagttggttctagaatgggctatattactctagggtgtgcacaccggtgtgtgtccatcgcaaaggggggggtagtacatggttgtgcagcctttggtgccgcagtgatcaaggttccttgatggggcaagaaggtgcggggaacttggggggtttagggactcgcatgggtcccaggaacacgtttgtgggtgtctggggaccggatatggggacatcaggggccggtcacccaatgtccactggccggggcacgctagtcaccacgggaaacccgggggggggggttttac

SEQ ID NO: 576153 - DNA, 319 bp, Homo sapiens
aatctaaatagtacattctttctttattaattgtaactatttttggccaggggctcacgcctgtaatcctagcactttggaaggccgaggtggcagattgcttgagctcaggagtttgacaccagcctgggcaacatggtgaaaccctgtctctgtgaaaacataaaaaaaatataattagctgggtgtggtggcacatgcctgtagtcccagctactttgggggctgaggcaagaggatcacttgaaaccaggaagtcgaggctgcagtgagcagagatggcgccactgcactccagcctagtagacaaagggaaaca

SEQ ID NO: 576154 - DNA, 503 bp, Homo sapiens
  misc_feature (16)..(16): n is a, c, g, or t
  misc_feature (65)..(68): n is a, c, g, or t
  misc_feature (73)..(73): n is a, c, g, or t
  misc_feature (106)..(106): n is a, c, g, or t
  misc_feature (109)..(109): n is a, c, g, or t
  misc_feature (112)..(112): n is a, c, g, or t
  misc_feature (118)..(118): n is a, c, g, or t
  misc_feature (163)..(163): n is a, c, g, or t
  misc_feature (169)..(169): n is a, c, g, or t
  misc_feature (171)..(171): n is a, c, g, or t
  misc_feature (183)..(183): n is a, c, g, or t
  misc_feature (185)..(185): n is a, c, g, or t
  misc_feature (225)..(225): n is a, c, g, or t
  misc_feature (255)..(255): n is a, c, g, or t
  misc_feature (294)..(294): n is a, c, g, or t
  misc_feature (302)..(302): n is a, c, g, or t
  misc_feature (334)..(334): n is a, c, g, or t
  misc_feature (337)..(337): n is a, c, g, or t
  misc_feature (386)..(386): n is a, c, g, or t
  misc_feature (399)..(399): n is a, c, g, or t
  misc_feature (408)..(408): n is a, c, g, or t
  misc_feature (485)..(485): n is a, c, g, or t
tttttttctttacaangtaatacacactttctgtacttggcactcaaaaattgccatttttttcnnnntctanttcagaaaacaacttttttttttaataggcctnttntantacaanaatactcctgccctcgcacatacagtttctcttatcttatatatntttatntntataattttgtngntctttaaacataggttttgtgctatatgtcttttaagttnattgatttttcttattcttgaaataatgtnttctttcacgcagctcaattagaaacaagaaagactacngtagaaanatttttttcttttgccttcaagacacagctcnacnaagaaacgtggtttttttttttcttttttcttttttttttttgcaagcnctcttagcttgtncattcagancagacatcacatgtaaatatttatacacagggaggtgggaggggagggcacacgatgcgttgctgcgcccccgcctnctctcactcctcttctaa

SEQ ID NO: 576155 - DNA, 614 bp, Homo sapiens
agggcgagagcttcgcgggctcggtgcaaattccaggtggcacaactggtgctggtgtgagctgactcccgacatccatatctgcggcatctgcaagcagcagttaaacaacctggatgcctttgtagcatcacaagcaaagtgagctgccagctgacaggcacatccgcacgaagcccccagtcgacggtccagtttgtatcggaggaaacagtgcctgacacccagactcagaaccaacagccagaagccatcacctcggagagcccagatcaatcacaggtttcagctccagaattatgtttttgaacactggctatcaaacattacgctgtcccacggaaagtaactgaataccagacagccactgtcaatctctctccctgccaagtcacgcaccaaaaagcccacaaaaccacctgcttcagaaaaggcttaactgtagctatccaggttgccaattcaagactagcttatggcaatgacaggacatggcagcggcatttaaaaattcacacgggagacaaagcccataagtgtgacgtctgtggcatgtgctttacccgcgcaagacaagctgaaactcacatgcggtgccacaggggcgtgaagcc

SEQ ID NO: 576156 - DNA, 593 bp, Homo sapiens
  misc_feature (9)..(9): n is a, c, g, or t
  misc_feature (79)..(79): n is a, c, g, or t
  misc_feature (131)..(131): n is a, c, g, or t
  misc_feature (140)..(140): n is a, c, g, or t
  misc_feature (214)..(214): n is a, c, g, or t
  misc_feature (257)..(257): n is a, c, g, or t
  misc_feature (273)..(273): n is a, c, g, or t
  misc_feature (339)..(339): n is a, c, g, or t
  misc_feature (341)..(342): n is a, c, g, or t
  misc_feature (349)..(349): n is a, c, g, or t
  misc_feature (362)..(362): n is a, c, g, or t
  misc_feature (390)..(390): n is a, c, g, or t
  misc_feature (396)..(396): n is a, c, g, or t
  misc_feature (447)..(447): n is a, c, g, or t
  misc_feature (524)..(524): n is a, c, g, or t
  misc_feature (537)..(537): n is a, c, g, or t
  misc_feature (558)..(560): n is a, c, g, or t
  misc_feature (562)..(565): n is a, c, g, or t
  misc_feature (593)..(593): n is a, c, g, or t
caggggagnactaaggacctggtcttgggccagcagacgcagaagcagggagtgcagaccccggtcaaacaggtgtgtngcccaggcggctcagatgcaggtaatcatacatgttatgatggctgatggtnccatctgantgcacaaagccagggtcggcatctaggaagtgggcccgagggtgggccagccagtgccgcccgtcacccacgcncgttcacctgtcggttcgttctgccgaagtgggtggggatgtnggcctcgcgcgagacncaggcccagcaccacaacccgggcctggggctgtagctcatgcaccagtggcacaatggccttgangnnaccgagngacgctgctctgntgtgtgtgcgtggttgtaggtgcccacncagacnaccacaatcttgggccggatgtgtgccagctccccattctccagccgccanagtacatgctgtggtgcccgctgcaccaccaatgccaaagtcaagctgcatgcagaggagagaagagctcgcgccanaactcgcactggngcatgagcgggaccaaggagnnngnnnngaagaagactgcgggttccttatttttn

SEQ ID NO: 576157 - DNA, 938 bp, Homo sapiens
  misc_feature (16)..(16): n is a, c, g, or t
  misc_feature (24)..(24): n is a, c, g, or t
  misc_feature (400)..(400): n is a, c, g, or t
agcggtccgattccgncacttggngagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttcccacagcacagcacacacatcttcaaacacattcaacagtcatcagcactagacatcattcgttcgcaaagcagttcttccagcgcgagcacacatgtgcaaccagaacccgagactcacacacacatcatagcattcaaccattattagcgcctacaagaggtctttgtcatgcaattaggctgcatatcagatttggaaatctctctctagtacacaagtnagcagccagtttgggctacagtgtaatagtgctatgggtatttctcagatgctcaaaaccaaggaacagaaagttaatccaagagaaattgctgaacaaacattaccaaacacctacccagacaatgactgtattgaaaaacgtggaaattgctggtcctggttctgattactgtccaacttacggaagaggatatagtatcagaacaatgtgaccagtcttctagtgcacatgggagttcaaaataacctgtctcttgggacaagaatacacaacacggttatagctagacaggactccgcctaagtaatagctcaacagagatgcatagtagggcgacagaggtcaaaaaagcataggcagcagagtatacgaccgaccatcaggcaattggcacgggatgaccgtgcaccaggctacatcgagaaggagacagggggacgccagaacgacatgggcaagcgccagcggcagacaagtacaaagacatatacaggaacacctcctactggggaacaaggcaacaacaggaatcaaa

SEQ ID NO: 576158 - DNA, 95 bp, Homo sapiens
  misc_feature (7)..(7): n is a, c, g, or t
  misc_feature (51)..(51): n is a, c, g, or t
gatccanaaataagtttaacttacggaggcttctagttctaaagatgcaangtaagatgccaaagcagtggaaagattgaagtcaaacagtcggg

SEQ ID NO: 576159 - DNA, 400 bp, Homo sapiens
aatgtcggtgaagtattcgcttctgctcaccaccgtcgaacagacggatcggcgtgccttccaccaggttcaggatcagctgggtaatggcgcgggagctgccgatacgcgccgagtccagacggtccaggcgcgggcccatccagttgaatggacggaacagggtgaacttcaggcccttgtcgccgtaggcccagatcacgcggtccagcagttgcttggagacggagtagatccagcgttgcttgttgaccgggcccaccaccaggttggaggtgtcttcgtcgaaatactggtcttggcacatgccatagacttcggaggtcgacgggaaaatcacgcgcttgttgtacttgacgcagtagcgcaccagcttgaggtttcttcgaagccagttcga

SEQ ID NO: 576160 - DNA, 685 bp, Homo sapiens
  misc_feature (16)..(16): n is a, c, g, or t
  misc_feature (24)..(24): n is a, c, g, or t
agcggtccgattccgncacttggngagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaaatgtatacattacatgtatcgagcgtgagatattctgtcgagagaggtcttccagcgcagaaaggagacagaaagcgaactaaacaactatgcattaacattattagccgccatacagagaggtctattggtcatgcatacttagaggcttgcatatcacagcatttggaagagtcctcgctctgctacatgacaccaaggtcagacaggacaacgtggtggggactatcaggtgtaataggtgactatggggtatttgtcaggatgatgtagttgtcactgacgtcttggctggtttgacttgtatatgaaggtgattcattgatcgatcagttgcgcattttagcacgaaaggtgattgcatagttacaaagattgctatcccttatgctggaaacgggatatattgacgtcatggtatgaatcaaagttgagcatcaggaagtggcaggagggtataagatcaagcattatgtaggcctgggactaaaggtggga

SEQ ID NO: 576161 - DNA, 296 bp, Homo sapiens
atggacttgaggtcaggagttcgagaccagcctggccaacatggtgaaacccagtctctactaaaaatacaaaaattagccgggcgtggtggtggtggtggtgggcgcctgtaatcccagctactcgggaggctgagacaggggactagcttgaaccggggaggcggaggttgcagtgagccgagatcgcgccactgctctccagcctaggtgacacaacgagattccgtctcaaaaagcaaaaacaaaaaaacaaaacaaagccccactcctccccacgtccccacctgcacgcc

SEQ ID NO: 576162 - DNA, 492 bp, Homo sapiens
  misc_feature (401)..(401): n is a, c, g, or t
cttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaatttttttttgttttttgtttttgtttttttttgagacagagtcttgctctgttgcccaggctggcgtgcagtggtgtgatctcggttcactaaaccctcccccacttaaggagattaaaagaatttctcctctctaaccctccggagttgttagtactacaggggggcgaccatttccggttatttttttgtatttttagtaaaaacgggggtttaccgtgttaagcaggatgaactcgnatctccagacctcgtgatttaccccccttgctctcccaagtggtgggaatacaggcgtgagccaccatgcccagcctcaatatgtttttaa

SEQ ID NO: 576163 - DNA, 882 bp, Homo sapiens
  misc_feature (16)..(16): n is a, c, g, or t
  misc_feature (24)..(24): n is a, c, g, or t
  misc_feature (344)..(344): n is a, c, g, or t
agcggtccgattccgncacttggngagtgagacgctgatgggaggatggacatactggtgtctgagtgctccgcgcggctgctgcagcaggaagaagagattaaatctctgactgctgaaattgaccggttgaaaaactgtggctgtttaggagcttctccaaatttggagcagttacaagaagaaatttaaattaaagtatcgactgaatattcttcgaaagagtctcaggcagaaggacaacccacctaaaatatgattacattattagcgcctacaagaggtctttgtcatgcaattaggctgcatatcagatttggaaatctctctctagtacacaagtnagcagccagtttgggctacagtgtaatagtgctatgggtatttctcagatgctcaaaaccaaggaacagaaagttaatccaagagaaattgctgaacaaacattaccaaacacctacccagacaatgactgtattgaaaaacgtggaaattgctggtcctggttctgattactgtccaacttacggaagaggatatagtatcagaacaatgtgaccagtcttctagtgcacatgggagttcaaaataacctgtctcttgggacaagaatacacaacacggttatagctagacaggactccgcctaagtaatagctcaacagagatgcatagtagggcgacagaggtcaaaaaagcataggcagcagagtatacgaccgaccatcaggcaattggcacgggatgaccgtgcaccaggctacatcgagaaggagacagggggacgccagaacgacatgggcaagcgccagcggcagacaagtacaaagacatatacaggaacacctcctactggggaacaaggcaacaacaggaatcaaa

SEQ ID NO: 576164 - DNA, 412 bp, Homo sapiens
  misc_feature (296)..(296): n is a, c, g, or t
  misc_feature (412)..(412): n is a, c, g, or t
ttttaaaggcagggggcccctcaaccccccgggcccatagactgaatacctgtcccagtggccctgttaggaaatgggcagaacagtaggaggtgagcagccaagcattactgcctgagctcccacctcctgtcagattagtggcagcattagattctcataggagcagaaaccctattgtgaactgtgcatacgagggatctaggttgcatgctccctatgagaatctaatgactgatgatctgagtggaacagttccatctcaaaaccatttccctgcaccctccattcacggnaaaattgtcttccacaaaaccagtcccaggtgctaaaaagggactactgttgtaaaggaataagtccctttgctattattatttttattaagatggagccagtctccgtctattan

SEQ ID NO: 576165 - DNA, 156 bp, Homo sapiens
tacggtttgcagcgtgaatgctggagattgtaatgggtatagagacatatcatatagtaatgctagggtgagtggtacgaagttttttcatagcgatgtgtatgaaattggtcgtagcgtgaatcggggagggtagcgtagctcgtaattcagtaa

SEQ ID NO: 576166 - DNA, 560 bp, Homo sapiens
  misc_feature (29)..(29): n is a, c, g, or t
  misc_feature (32)..(32): n is a, c, g, or t
  misc_feature (34)..(34): n is a, c, g, or t
  misc_feature (42)..(42): n is a, c, g, or t
  misc_feature (57)..(57): n is a, c, g, or t
  misc_feature (59)..(59): n is a, c, g, or t
  misc_feature (63)..(63): n is a, c, g, or t
  misc_feature (66)..(66): n is a, c, g, or t
  misc_feature (75)..(75): n is a, c, g, or t
  misc_feature (85)..(85): n is a, c, g, or t
  misc_feature (99)..(99): n is a, c, g, or t
  misc_feature (108)..(108): n is a, c, g, or t
  misc_feature (115)..(115): n is a, c, g, or t
  misc_feature (121)..(121): n is a, c, g, or t
  misc_feature (139)..(139): n is a, c, g, or t
  misc_feature (148)..(148): n is a, c, g, or t
  misc_feature (166)..(166): n is a, c, g, or t
  misc_feature (173)..(173): n is a, c, g, or t
  misc_feature (176)..(176): n is a, c, g, or t
  misc_feature (187)..(187): n is a, c, g, or t
  misc_feature (191)..(191): n is a, c, g, or t
  misc_feature (207)..(207): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (225)..(225): n is a, c, g, or t
  misc_feature (230)..(230): n is a, c, g, or t
  misc_feature (234)..(234): n is a, c, g, or t
  misc_feature (237)..(237): n is a, c, g, or t
  misc_feature (249)..(249): n is a, c, g, or t
  misc_feature (251)..(251): n is a, c, g, or t
  misc_feature (254)..(254): n is a, c, g, or t
  misc_feature (262)..(262): n is a, c, g, or t
  misc_feature (282)..(282): n is a, c, g, or t
  misc_feature (317)..(317): n is a, c, g, or t
  misc_feature (321)..(321): n is a, c, g, or t
  misc_feature (328)..(328): n is a, c, g, or t
  misc_feature (355)..(355): n is a, c, g, or t
  misc_feature (358)..(358): n is a, c, g, or t
  misc_feature (362)..(362): n is a, c, g, or t
  misc_feature (381)..(381): n is a, c, g, or t
  misc_feature (386)..(386): n is a, c, g, or t
  misc_feature (404)..(404): n is a, c, g, or t
  misc_feature (416)..(416): n is a, c, g, or t
  misc_feature (421)..(421): n is a, c, g, or t
  misc_feature (441)..(441): n is a, c, g, or t
  misc_feature (460)..(460): n is a, c, g, or t
  misc_feature (467)..(467): n is a, c, g, or t
  misc_feature (476)..(476): n is a, c, g, or t
  misc_feature (495)..(495): n is a, c, g, or t
  misc_feature (498)..(498): n is a, c, g, or t
  misc_feature (530)..(530): n is a, c, g, or t
tacacacaagaacagcatttatttttcangcncncaacacangtccaagcccacggncncccngcngggccccgngcggggcccngggaacagaggggngagaaaccnctaagcngggcgnggccagggccagtttcgncccccagcncagagcctgggggccgcngtcaccnagngagtgtttgcngaanacacagaagggcatgnggggggngcnggntgggnagggnagcnggnataaggggggcngnggntgagaccnagaggggcttgtcccccccnggaagccccccagtcgccgggttcctggtcccccntgcngagggcngccgactctgggaacagggaacccccntcngccncagagaacttgcctagggngtggngacggccaccagcccccngaacagtggccncaacncccccctgtcctgagccccngggcttctggcagcttggngcctgcngcctgaggncaggctgaacggcctgggnccncgtgtctttgtccaagcgccccgagggcgccngccctgccccgtgatcaggttaaggcctgg

SEQ ID NO: 576167 - DNA, 276 bp, Homo sapiens
  misc_feature (78)..(79): n is a, c, g, or t
agtattccagtaaaaaaagtagcgtcggtgtgcttacgcaattgggaaggatttggtattttattgatcacccccatnnagttgatgtggtttggtgagtctttatcgccaatgaaaattggtggattagtattactgatcaccggtatggattgattaaatcaggaacgaaaaaagcaaccgtgcgcggttctgcgcaaaaagtaaaacaagtggcagaacacgcagtaaatgttgcaaaatcaggggctttaccacgtagtgaagccaagtcgg

SEQ ID NO: 576168 - DNA, 210 bp, Homo sapiens
  misc_feature (9)..(10): n is a, c, g, or t
  misc_feature (13)..(13): n is a, c, g, or t
  misc_feature (16)..(17): n is a, c, g, or t
  misc_feature (19)..(21): n is a, c, g, or t
  misc_feature (102)..(102): n is a, c, g, or t
cgacttgannacnctnngnnnagcgacagggctctaggaaggaagaacaggaaggggacatgagagtgtgtcaggaaggggagaaggggcatcagctccctnggtgggcccagcccacctgcagtctcactgcctctattagaggtgatgggctgtcgggctagtcgggggggctagccggagctgtcgggcgagtcggtgggggcatcg

SEQ ID NO: 576169 - DNA, 342 bp, Homo sapiens
atgggtaaggaaagaatggtacctgctctcattaaaatgttaagcagtcattggttgggcacagtggctcatgcctataaccccagccctttgggaggccaaggcaggtggatcagttgaggtcaggagttccagaccagcctgaccaacatggtgaaaccccctctttactaaaaatacaaaagaaaaaaaaaatccaggcatggtggtgcacgcctgtaatctcagctacttgggaggctgagacggaagaatcgcttgaacctggggggcggaggttgcagtgagccaagattgcccccctgcacttcagcctgggtgacagagtgagactgcatctca

SEQ ID NO: 576170 - DNA, 307 bp, Homo sapiens
cacgaggaagaggcgccggatgtggtggcagagggagctgctcggaagcaacacctcgcaagggttcacccctttcgccaccccctccccagaggcatttcgcctccccggaggacgcagcccgcccaactcccatgagctgagcaagttttcgtccgtctccacagccagccacaggagtgttctaggcagattttgttctcactgatttaggacctctggccaggatttggtcagtgggacattgggataagaaggtctccaaagcccatgtgttcaatggggcgttatcgagcacggtggcaat

SEQ ID NO: 576171 - DNA, 285 bp, Homo sapiens
cactaatgaatagaactagcaacataactttgcacaggcagagccaaagctaagacccccgcaaaccagactgagctacctcaagacacagctaaaagagcacacccgtctcatgtagccaacacatcagtgggcaagcatttataggtagaggcgacaaacctacctgagcctggtgatagctggttgtccacagatagaatcttacggtaacaactttcaaattggcccacagaagcctctacaatcccctagctaaatttaactggtcagtccaaagaggaa

SEQ ID NO: 576172 - DNA, 292 bp, Homo sapiens
agccggacgacacataaagaacaccatagaatgagtaagtccaaagtgcgatagcacagtagggtgactatggttaacaagaatgtatactgcagttcaaaatagctagaaatgaagaatgggaatgttcccaacataaggaaggaataaatgttcaaggtgatggatatctcaattaccctgatttgatcatcgcacattgtatacgtgtatcaaaatatcacatgaaccccccaaatgtgtacaactatattatgtcccaattaaaagaatcctgacattctatggttgt

SEQ ID NO: 576173 - DNA, 381 bp, Homo sapiens
ggagggcggggggcccattgtggctcacggcggcctcaattttcggggctcaagaaatcctcccccctcagcttccagagtggctgggactacgggtgcatgccacaccctgttatttttttttcccccaataaagaggaggtcttgctatgccctccagtctggtcttgaactaatgtgatcccccccccttggccccccaaggtgttgggtttagggggttgggcccccaaccccagcccccatttttactttgggtaaacttttttttccaggcttttgttggtgtggcaggtgaaaatcttttttaaaaaatgttctataattatacccactattccttgtgggctttttaaaataatttttaaggtctttcgggta

SEQ ID NO: 576174 - DNA, 391 bp, Homo sapiens
  misc_feature (27)..(27): n is a, c, g, or t
  misc_feature (56)..(56): n is a, c, g, or t
gatggagtctcactctgtcacccaggntggagggcagtggtgcaattttggctcantgcaacctccacctcccgggttcaagtgattctcctgcctcagcctcccaactggctggaattacaggcacatgccaccacgcctggctaatttttgtgtttttagcacagacagggtttcatcatgttggccaggctggtcttgaacacctgacctcaagtgatccgcccacctcagcctcccaaagtgctgggattacagacatgagcccccgtgcccagcccacattgaaacaatatattatgaatatattatgaatatattgggctaaacacatttttttcccctgttttctttttcttcttaaatgtggctattaaaattttaaaatcca

SEQ ID NO: 576175 - DNA, 315 bp, Homo sapiens
tatcagctccgtacccctccataatgtgtgcccattctaaagcagcctttatccttccttccagccatatactctcacatcttctcttagagattgctctccctgaatcttcacttctcttgcttctagctcctttctatcagcacttaaaactgataaagcctctcttaccttaatacaacaagaacaacaataaaagctccacatttcccttaactctaaattcttctccaatcctagaatttcatcagccctgaaggtgcagctaagagctgcgagctcttcacagtgaggttttgggcacacattatggag

SEQ ID NO: 576176 - DNA, 222 bp, Homo sapiens
  misc_feature (176)..(176): n is a, c, g, or t
cgaggatcccacgccatcatagcgacgtatatatagatgcgtacacagatgatctcatcctgagtacagctaactggttctagatagacgtacttcaaatcttatcgtgaatggaatactgtttcttgtgatgaatttcatattgtaagtgcctagttataattcaggctgatcangtgtgactacttgaagaaaataactgctggctatactagggaaaat

SEQ ID NO: 576177 - DNA, 923 bp, Homo sapiens
gaatggcataattttttaatgaccagactgctttgaggatttgaagttgactttatagagcctataaaaagcctgttggaaaaattagcctgataccttgtctacacagtttccttacaaggttcctgaccttgcggtagtaaagaatgtcactctctggcaggcccaggagcctcaggatattttgggaaccttgacaagagaggagtgtatccaatttatacaggaattacaagtgcagtctgattgtgaatccttgtcttggcttcttagccttgagagtttttaaaagttgaatgtgaaattccttatgaaaaagttccaacaaagccaaactttaaaagagcctatatgtggtcaatcactatttttgctgtactttatgcaaataatcaggccaaatataataaaactaaaacttattttgcaaataaattggtcctgttatgatttgcctttaatagaaaagggggactggagagagaagaattatgtttcagaagaaaatgatagcatacctgttgttagattctagctttgtccattgtttttaagttgtaattatttgcctacatttgaactaaatcttggaattctttcctggctacaagtctccaagctaacatttaaatttttttctcctatgttctgacttggaaaagtaggaagttaaactatgcttttcttgaaagcctgcagactggagcagacaattgaataaactattgggaaaaatcactacagcaattttttaaacagttatggcttgtgtgttgggatacccgaagtcctgggacctgtttattaaccgggactcgtgttattatgagaacgggttaatgtttttccggaattacctgtttttttgtgaactttaaattggggtaaaaaggggggtattggcaggctaagaaggaaaagaa

SEQ ID NO: 576178 - DNA, 153 bp, Homo sapiens
acgaggaggagagctactcggacgacgataggtcatcccacatcgacgttgagtgacatataattgaaccaggagcaggtgcagatctcatcaaacaggccacgacttatggcatggccgacggtgacttcgtcaggatgctccggaaatgac

SEQ ID NO: 576179 - DNA, 174 bp, Homo sapiens
gggggggggggcccccctccaaggttttttttttctccaaaaaaaaaaaaaaaaaaaaaaaataaaattgagttagtccccccgtgcaagagctcctcgcgccccgaggggtgaaggccttatcgcgggcactggaataaagcttcggtaaaaagtgtcattggtaatcagaaa

SEQ ID NO: 576180 - DNA, 84 bp, Homo sapiens
agaaaggcttttggcggggggtttaaattcccagttttttgggggggggcccaaaattaaatgggggtttttttccccccccca

SEQ ID NO: 576181 - DNA, 159 bp, Homo sapiens
gactaggagcattggctcataaccttgacagaatttggaaacattttcataaagctccacggcgagttttaaagaagcatatgtagcatgattttgtaggagaggaaaaagattgatttaaactaggatttaaactcatgcaagcaacgacgagtatca

SEQ ID NO: 576182 - DNA, 131 bp, Homo sapiens
  misc_feature (44)..(44): n is a, c, g, or t
  misc_feature (113)..(113): n is a, c, g, or t
agcctcccaaagccctgggattataggcatgagcactgcgcccnacctcctttaactcattttaagataaagctgtgatttcgtacttgaagtccttttaatatctgtaactngttgaccagaacctgtat

SEQ ID NO: 576183 - DNA, 152 bp, Homo sapiens
gcagcatggttcgagtaagcacaaacctctgcgccaggaaaagacaaggctaattggcccaactgccctggagtcatcaatcctggagaatgtaaaattggcatcatgcctggccatattcacaaataggtagtattggcaatttgtccaaa

SEQ ID NO: 576184 - DNA, 877 bp, Homo sapiens
  misc_feature (591)..(591): n is a, c, g, or t
catcctcgaagaagcagagaatgcaaggtgcatatctgctgtaatctacctagccctcttctgcttaatatgatccattattgaatcttctcagattaaaatccattcctatatcatctacctttcccaaagtgtgtgcctgtaaacctacctgtggaagtggcaagttaactgatttttggtgtcatttttataccaatccttatggtcaaagcctttgtgctatcaatgtatttaaacctgagtggctatatgtccacttacattgtttcaacatgtttgctccaattaaattatctttaacatctttgagtgccaagaatggctaagtaactgtacatatgtggacagacgagtaattgccatgcaagcagttcataagccaaaatgtaatgagcttagtatataaccatttagattatacacctcaccattttgtatcatcatgcaaaccctcctgaagtcgatagaagaggatccaatttgcggaccttttttcctccttttgacacctgagcacaattttttttccttcatatttatacccacttgtggaaattcagtaaacccccattctgaccacttcataantggttacagtcagcgacgatgtatctcatcaacttcaaatatgcttatcctatacttaggtcactcacgggctcacactaggtgagtgcatttacaacctcgtggactttgctgggacacacacttcaggattgtttccttttggcaccggcagttcaagtgcacgagcgaaatcgcggtttgccggacgataaaggctggccaatatttggacacagcacacacacaagcgggggcataattgcacacagtctcaacaatgggctcattgcaaaacccctcgtga

SEQ ID NO: 576185 - DNA, 538 bp, Homo sapiens
gcacgagtaggaacaggccactgccttccagatcccagagtggaagagccagcttataccttcagccttgaaaagccacaggcattcgactccaacccatgagggcagccatgtgagctgcacccagcagagtcataggggtctgactgtccaagaccttgggagcacacccctcgtaccagtgtggcctggatgtgggacatggagtcatgggagattattttggagctttaagatttaatgtctgccctactgggttgcagatttctgtggggcctgttgccccttatttttggcctatttctccattttgaagtggaaatgtttatcagtctttatttcatcattgtatcttggaagaacataacttgttttctttttttttttgatttttcaaggtaatattctcaatattatttattatttattgatagcacatgacttcaagagagttaacacatttgagtttaaaaaatgatttgcttgtaagtaaaaaatagaatgtaacatacagaatagaaatctatatagagaaaat

SEQ ID NO: 576186 - DNA, 233 bp, Homo sapiens
cccctactcacatacacacacacctagccagctgtcaggcagaatgaatctattctgtgataagaaatgtgtgggaactctcgtttattgaagaggctcaattttacttgggacaaaagagatttccaaaagcaaaaacccacggaacacgtattgtaatttttgaggcaggggcttcattaggggttggaggcaaattttccccctcaaaaccacactctaagggttaaaaa

SEQ ID NO: 576187 - DNA, 338 bp, Homo sapiens
gtaaataactaaaagacacaagaacaaatggctatagatggactaagacagtaacttccggctgggtccatgaattatatagtatctgcatcttaaggttagcattaagtaatctcagattatttcagagagtacattaggaaacgggattatctatcccatatatgttttaaaatattcccagtacctattaaatccaaaatgttctaggaataattttccaatcactaattcataaatactagtgataccgtgctgcttgttagctaacaacaggttgaacagagacactccagtgtccctctgtttatgcaggttcacatgtatttaaggcggcg

SEQ ID NO: 576188 - DNA, 282 bp, Homo sapiens
gtcattattggctacttcggtcacacaagctagaagaaccctagctctcccatgggcaggcacctgacattcgcagcgcagttccttgccattaccatactatgtatgcctcctcttggagaattaagagctgggctaaatgctccactccaggataaggctgagcagtcctagttctctagacggcctcttacataaagattggattaaggtacgtgaacgggtgcagactgtaaagattttaaaaaataaagtagaacccagagaaaatgtcaaagctgc

SEQ ID NO: 576189 - DNA, 159 bp, Homo sapiens
ggggatggggcacacagcagggcacaggcagcagcaagggcaaggcagggcaagcagcaaagcacaggcaagcaaacaggcaacagcatggccctggactagcagcacacacagcccagcaggatgcatccagagtccagccagccaggcagcaggctc

SEQ ID NO: 576190 - DNA, 1130 bp, Homo sapiens
  misc_feature (892)..(892): n is a, c, g, or t
ctcacagagcgccccaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgcgagaaggccgtcacggtacagagacccctactcgggcagcaccatctccctcttccaaggcatgcagaanggccttggttctccggcagcacggatccggctgttggagggccatgatcccacggcgggtcatcgaacccgtgcaagccccggtgcctgtggacgtgctacagcgggtattcgtgagagtgacggtctgcggcccggagacagggttttggccaccggtgaacccgtaaggttggcgggggggcccaaggcgccctgccggagggagggggggcccccgtccggcgagtttgatctcc

SEQ ID NO: 576191 - DNA, 989 bp, Homo sapiens
gaggctgtagggagagaattgcttgaacccaggaggcagaggttgctgtgagccaagatcacgccagtggagtccaggctggttgagagagggagactctggcttacgaaacaaggatcaggtagactaggagagaccgtgagttgtggccgtcagacgtcctgtgtaaaagcttgtttgagaaacgtcgccgattgtggtgccagcggaatcgcagagtgacgttggcggaatagtggcgatcacaggaagagggctcaagggaaacccggtgtgggggaaaacgggagggacggcgtcaccgtatagcaaaagacaggcgggggggggtaaccgatggacgattcgggcctcgcatgacccgggagcggggctaggaagagacacatcaagggggagatttgaaaggcgcgggtaatcctgggagggaggatatcaatatattacaaatggtggcgccgtgggtctggtggaaaactggagaaaagcgacattatctgccccattggaattgagctcgggcaagacatagtgggttaccacaggtgaaaacacagacgattcattgcacacaggtgacgggtggcaattgaacagagtctgggggactgcaagggcctggattgaaaagctattggcaggttctccacagctcaaaagcaatcatcacaggggagagactggactaaacgcaaggctgggttgaagggtcataaaggccatgcaagataaccaaagaataggcggagccaccccaataatgctccacctccagggagaagtaatcgcagaaatgcgaggccaaagggagttgagagaagagcgcctacagccctcgggtctctggaaggcctggcgaagaccgggaccatatacatgaggcgacaaggaaagcggtcgaacaagacaaaaagcagccaggcagacggcccagaggacgggagccagagacacaccgtgggaaacaagagaaaaagagccacaacagg

SEQ ID NO: 576192 - DNA, 418 bp, Homo sapiens
aagatttttctgaaattttttctttgcctttgacgcacatgcggatccaggggatgcatctgatactccaaatgagccttgtggacaagaactctattttgaatggttgtctatggaacatgcttcctctccggcctcgagctggaagggggtgagcacgatcacctggccgaccacgaatcgctcccccccaataataccggccatccactggacgcctgtcagggggttcatattttctaacacggcattaaagaatgccttgttaagaaccaatacccagtatccggcctccactgttttcccaccttctcccacattcctatctcagttcttgccagtttctcgattcgtatccgatctttcgctccaattgggggtcccctccgccattctgtcttattacgcctgttgttcg

SEQ ID NO: 576193 - DNA, 193 bp, Homo sapiens
ccaggtgggggcctggtggaggagggttagctcattgagggtgtttcaacgccagatagggagaaattcaggccagtcctgctgccctgaagggaagcaaccgccatgctggaagggccaacagccagcagggaggttgtacccagtcccagccaccaggagctgaattctgccataacctcgtaagccggga

SEQ ID NO: 576194 - DNA, 670 bp, Homo sapiens
tcaagctcttatcgaagcaagaaggaagaggagaaacagtattaacaggaacttgatagtgggattatattgggatggaacagcacccagaagctccgagcatttcgtgggcatgatgggagaagattgatttcgcagacacagcgcaccaagtatgacaggaggttcaaggtgtgtaaagcgagaactgacttcctctacccctaaagtgcttgtactttactcggacgagaaaaagtcaaacagggtcccagaggagggtcctggtgaaagacgtcctgaatcggaaaatcgagatagaacggatcttgttggtcttcgttacttgccagggaggatgacattattatactccatgagcaagagtatgacagtgtgcttgaatctgtcttcaaaactgaattcctaagcctcttagcaaagcgttacgaggagaagacccagaagcaactacctctgaaattcagcaatacgcttgaactgaagttgaaaaaggaaaactggggcccctggagtgcagggggctcccggcaagtgcagttccaccaagggtttggggacctggctgtcctcaagcccagtaacaaagtgctgcaggtcagcatcggacctggacgtgccaagaactcccgtcctaccagaaggaacatacccagaatacggttatcca

SEQ ID NO: 576195 - DNA, 629 bp, Homo sapiens
  misc_feature (394)..(394): n is a, c, g, or t
aggcattgagcggtatcccaccgtcagcagcggcgccgatacaagcttcgacagcctgcgcatacgcggtttcgatcgccagcaatgacttccatctggatggcattcgcgacgacagccagtacgtacgtgacctgcataacatcgagcgtatcgaagtgctcaagggaccggccgccgtgctttacgggcgaggcggccagggacgggatcgtcgaccgggtgagcaaagtggcaagcccagggcaaaagtccagcatcgaagcccaaggcgggagcaacgatgagcgcagcctgtatgccgaccgtgagtaccgaccccaccgataacatcagcctgcgcctgaacatgggcaaccaggacaacaatagctttcgcgatggcgtcagcggnaaccgccagttgttcgcgccgtcgatgagctggcagctcactccagagctgaactggctggtgcaatacgaatacagccgctacaaccgcaccccagaccgtggcattcctggtgtcaatgggcgctcgggggatgtcagccgcagcaccacttacttgatcacggcgattacatagacgataagtcccagtcgctgcgatccagacttgcctacgagctcaacgccgagtggca

SEQ ID NO: 576196 - DNA, 205 bp, Homo sapiens
ctgtcagaaccagggtgtaccctcccaggtcaagtgatctcctgcccacgctccaagtagctggggctacagggcgtgcacgaaccagctaattttgtatttttagtagagacggggttcactatgttggctagcatagcctcaatctcttgacctcgtgatctgactgcctcggcctcccaaagtactgggattgtagacgtga

SEQ ID NO: 576197 - DNA, 250 bp, Homo sapiens
atatgcataagttcctttgtatgtcatcctgcttaaatgtagtccttctcagtggttggtgtacaacttagtgtagtctgtaatgttagcatacacttgcatggctagagatggacggaggacgatagtaagcagctataggtcttgtagcataggagctactgagactactttgcttctcacagctcactgctgaaacagcttatcatataatctcaactctcttgtagtgccttgaaatctttcactt

SEQ ID NO: 576198 - DNA, 118 bp, Homo sapiens
cggctgcggacgggacttaagaccattgctgagtgcctgcagatagctcatcaatgctgccagggctcctctaactcctatgccattgagaagaaggacgagctgtcgccgccggccg

SEQ ID NO: 576199 - DNA, 162 bp, Homo sapiens
acacagagaaattctctagttctgaatactgtgaaaccgctgctgatcagtcatttcgtgtaaccctcacgagatgtccccagagtaggatgcactgagtcagagctaagggaagtgttggacaagctgctggaactcttggcccggacagcacctcgggaa

SEQ ID NO: 576200 - DNA, 127 bp, Homo sapiens
gccggacgactcactgtcactcccgccgactggcttctctccgtcgtgtagaggggcaggcggggtgggcacaggccagccagcagctcctcagggtgacccttctctgggtcttgctggtgggaag

SEQ ID NO: 576201 - DNA, 237 bp, Homo sapiens
ccggaccggtaacacttacgtaaatatttaatatgctgcctggcacataaatactcaatgtaagtattatgtggactggcaggaaaagacattccttgccaggcacagtggctcacacctgtacatcccagcactttggcatgccaaggcagcaggatctcatgaggtcaggtgtttgagacagatccatctggcgtccacatagctgagatcctcaccctcttataatatcacaac

SEQ ID NO: 576202 - DNA, 426 bp, Homo sapiens
gtttgtctccccccaaaatgagaactttcataaaataatagcatcacatttgttctagtatgatcgggttcagggggcacttttgtttaaaaaccccattcttagggacttaggtctcttaacgtatcactttacgtagaactagaatttcccgtcttggtatagcctgcttttgtgatcttggagttgtagaggttttattttacacttcattcttagttaccacttatggagtattcactttgtggattatctgtggcaaatttgtgtcttcctgcgggctttccccatcaccacaggagcctcaaggccctcttagtttgctgctatttggcctggattttctttttcaagtcagaggttgcagtgagccgagatttgccactgcactccagcctgggcgacagagcgagacaccctctcaaa

SEQ ID NO: 576203 - DNA, 549 bp, Homo sapiens
tgcatgcttgtcctctcggctgggcgtcgccgagcctggcgttacttcaaggagcagtttctggacagtgagacgaggatgtgacttcgcgctggttcgaatccaaacacgagtcatgattttggcaaattcgtactcagtaccaggctagttgtacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaa

SEQ ID NO: 576204 - DNA, 762 bp, Homo sapiens
tattaaggactagcattgaccatctcacttctaggaatacgagtagatcgctcacacctcatatcctccctactatgcctagaaggaataatactatcgctgttcattatagctactctcagtaacccgtcgaacatccacgtccctcttagccaagtattgtgccgtatgccagtactagtcattgccgcctgcgaaggcagcggtgggcctagcccatacatagtctcaagtctccaacacgatatgggctagcactacgtaccataagcgtaaacctactccaatgctaaaactaatcgtcccaacagattatattactaccactgagatgactttccaaaaaagacatgattggaagtcaacacaaacactcgcatcgagcctaattatgatgcatcatccctctactattttggaacgcaaatcaacaacagagctatttagctgttccccaagctttgcctccgagcccgtaagaaaccccctccgtaatactaaactagctggactcctacccgtcaagaagtcatggcaaggccaaggcggagttatccagttgaatcactagtcacgaaaaaaaacctctagcgtctctatactaatgtgccctagaatttccttaatgatagcattcccagcacaggaataatcggtattgaaatcttttggaaacaagttatccccgtggtataaaaccgagaggcaccgccgaaggcgggaggggcatactccatgtaaccagggccctcccaaacgggg

SEQ ID NO: 576205 - DNA, 701 bp, Homo sapiens
acacatgacgccagataaaatgtcagtgcactcagagtgtacaaattgtcgtttatcctcttatggggatatcatttaaaaacttaatggggttaatggtagtgttgatccctaaccctacaaagagccttcctaattcccctcgcttgtgtggagcaaaccattataccttatttccagcaagcaaagtgcttggaccttcttgcttcagtcatcagccagcaagagggaacaaaactgtctttggcatttggccgctgagatatggcattgcactggttaataatgccaagctaatttatagcaagatattgatcaaatatagacaacgttgatatcaacctcacaagggctctcaaagtataatctttctatagccaactgctaatgcgaatttacaccatatttcatttaccatgatttcaaaatcagtttccatactaacccttggctggagaaacttaaaattatgccaaatgcagaaaccacaaaacaattcgacatgggggtagcaaccattggttacctattctactccttggcaaaccccctggtggcatctcatttggctcaattccacttcattgaaagtcatcatccttcattggccaatgtacttttggatacagtaggctaaagcaagtgggcatctctggtggccaaggccattgccataagttaaacctagtaaaacctttgtc

SEQ ID NO: 576206 - DNA, 850 bp, Homo sapiens
  misc_feature (714)..(714): n is a, c, g, or t
ctggcccctttcttccatttggggagaaaggcaccagcgcctatgtttcagcggatgatcgcaggggtggcgcctccttttcaaagaccccaaggtatcttcaacagagttgttttctttagagcgggtcacagagctcctgagcattttcgcgagttcccacagttgtaagaaagcaatattggtacgccctctagagtccctggaaattccgatttctcttctataggcgagatagcgcaccatttgtacaccccaaatacgctcttttcagacaatggtggtaattggcagactcgggtactttcccgtttcggactgacattcctcaccccctcggacttcaatgcacgactcatatatagtggcccctcagtaaatggtgccctaaatggaaatgttcacagccctttccatacttgtgacgccccacatcattttagcgcttctgtccaagtatgtcctcccgctaccattcgtatacgtcttgccgcccttgactgagccccaacagtattcattttgggcccatcctggatgatcccggatcgagcattctaaagtcccataatcttacccagtccagttatttccccgacccctgtgtcaccctttgtgagtgatgtcacatgcacgggacgctgtgtaattctcctgagagtggtttcaatttatcccgtgcttgcccataccctctctatcctgtctcacagnatatcttcctctgactaaatcctatttttttcataagagttatgggatagggaaatgaacttttccctcattcacctccaccatggactttttaacctgaatttttcgatcctaaattaaattccccttgctttta

SEQ ID NO: 576207 - DNA, 80 bp, Homo sapiens
  misc_feature (29)..(29): n is a, c, g, or t
  misc_feature (55)..(55): n is a, c, g, or t
gatttacttggtataaggaacagggtggnatccagccttctgtaacttgggtttnttccctggcctggctgtggacggag

SEQ ID NO: 576208 - DNA, 1407 bp, Homo sapiens
cccgaattaaacaaccacgcttttttgatacacgtacgattatgtcttgcttgatgaagccaaccaccaactcgctcctttttgttgtgttcctccgctaccattataaggacaccacgcgcgcctcatcgatcaccacccttccctctcattatattttattatccagcccggcccgcgggcgtctagatatactctatatttttactcactcactagcacactattgtcttcatctgctcacgctctgctcatctgttttgtgtgtaccgatctccacaattcaatctacattcagttgtgtttgttcatctacaaaccaacccgtacgatttgttatctattctgcccctggtgatcgttcgcgaagttagattgtgcgcgcatccacttccacatcgattgtatttcttttctgttggtttctgcgtgtcggtggcccccccccccggcggtgagtatgataggcgaatccccccttccttgttcttgtatcttttcttgtggtggggccacgacccccctcgttttctgcgctgctaggggtgaggggcatgcttttttcactcctctctttgcgtcgtcttcgcatgttcggttgctggagtctctgtcggttttcccactgctcagagtagttggttggtttctcttcctttcctctccgctgcctctcgcggtggtgatttttttcgcacgtcgcggagagataggaactctcccgccgcgcgtgtgggtgggtatcactcttcattgtttatttcttcaccgcaacattctcttctttctgatttacacgcacgcgctccaggtttatgatcgtactaccctctccccccctccccaaagagaataagatacaaaaaatatttttcttctccccctctccccctcctcaacactctcgttgtgcgttcgatagctctcacactacgaagctcacacctctccattctcctgtgcggcgtgcatcacataatataagtaataatactcttcgcgcgggcgcttacaactaccatcggattttttttttctggacgcaaagcacccctctttttgttttgtttcttactccaccccagacaggaagttctcttatatattatatgtttgttataggacaagcccccgcgtcttttctcttcccatgagtaatcgttattattcttaatcaaggactgtaagacgctggtgttgttaaaacatcccattagaacataccacccccccctgcgcgagtattttgtctgctcctccaccccacaaccacaactcctctcgacagtagatgtctctcccaccccccctccccactttttttttgttgagaaccactcctttttttttttatacaaaattttttttatccccccccctcccccccccccccatttttttttttta

SEQ ID NO: 576209 - DNA, 874 bp, Homo sapiens
  misc_feature (115)..(115): n is a, c, g, or t
gctctcactagagtgacatggtgataacagttggtgataacgggcatttgtctttgtatgctggacgcgggtgtaagaacacatgctcgcgtcacaaactgtgcggggtatacanagcccgtgcggcgaggccaagatagtgggatttccgctgtacgctaaagaattattgtgtatagagacctttggttattcaatgctcgcgccaatgtggttcccggggatattccgcaagttctttgggtccgacccatgtgaagacaacttgtccagaaacccaataagggggacacttggcaactccatctaagcctgcagggttttccgcagcgccaaagccgaggtggacgcaggctggccccccaggcgcagaacccctgtcccaaactgccgggcagatctcttcatggacgccgcaggccccggacaaagggcacaaaggggggatcccaaccgacaccacgaaagagcctgtgtacaacaaggttgcagccagacgaaacttctcgcaagtcaaaaggcgtgatgactgggtactcacgcaagtatgtgggaaagtgccccccttggacccctgggacgcacagtagcacctcaaccatgccgacaagaaaggcggtggaccacaccgagaggacacacacaattgcgcataagactggaggttcatgtcctcaagtcatggaccaaaggagagctattccaggtattgccagtcgcgccttcaacagtccacaaaatgcatcagtccaggtccggtggctcccgcctcgttaaccctacggctcgggaggccgaagtgggaggatcccctggaacccagaggtcccctggacccaaaccagcctgggccacaccaaaaaccggattgtac

SEQ ID NO: 576210 - DNA, 334 bp, Homo sapiens
aaataccttaggagagaaagctgattaatcgtgtttcttgaaattgcacagattccttgttacgtccctgatagctcagtcatgactgtcaattagcttgtgtccccctcatttgggtgcagaatttaaagtccacacacacaggcagtaagatgatatagatcaggacgtcatcactcggtttcggatgttaaaatgtctaggtgggtaagcggcgattggagatcacacaaccttgtgccacaaagaggaattcccaggccagagggagacattttattgccatgttatgatctcatcattgagttgaaaggcaatcttgtttcattttgga

SEQ ID NO: 576211 - DNA, 916 bp, Homo sapiens
agagctcaccccaggcgctagtatgtgttcgcggtctcccccggggcgtcgcccgcccggtgttcaccccgagtggtatctttcggacggggccatccagaggctcgagggttgtcgacgccctggtccccgagcgcccccggagccgcggcctccgccgggggtttcccgccctcccccccttttgcccccggtccccgccttgggggtccacggccccacatcagcgacagtcttgcgtcgccgtgagcgacaagggtgttgcgcccctcttggctataaaagcggtcgaggatcccccccaattctttccttctgcgtcacccccccctcggtgtcagaattgggtccccgggcaggcccccctttctggggcattttccgaccgataccccgtcgggggccgctttcacgtgtgctcatatgaggccccgcaccccaccggggggcgttctctcaaacccggggtgcccaaacatgctttcctgagcggttgccacaaggcgcaccacacagttggccccgcacaacagttcctcgaacgggttgcaacacgcaaccatttgtcccccccaggagaacgcgcctccccccccctttatatccactggttgcggacaaaccagtcttctccaaaaaccctgtttgtaccaaatgcccccaacataaagttatcacccataacactggtttttaagacaaacccagagcgcctactcgcacccccccccaaacgagtaaccagataactttctattgacccccacactatcgctttatattctatggctgcgcaccccttgtcaagttatacagttttgaaaacaccactctttttcaggagcacacccacctgcccccaactttgccccaaacatcgggaccccctcaaaacagttaaaacccccacataaca

SEQ ID NO: 576212 - DNA, 141 bp, Homo sapiens
ctggtatctaaaatttcatggttcaatgatgtggcaagtattatagaaaaataatgatttattctgtttttctcttttctttcttttttttttagactgtgtctgccctgtgcccagtctggagtgcagtggtgtgatctc

SEQ ID NO: 576213 - DNA, 722 bp, Homo sapiens
cgcggtggcacgtgcctgcaatcccagctactcgtcaggccgaggcaggagaatcacctgaacctgggaggcagaggttgcagtgagccgagatcgtgccactgtactccagtctgggtgacagagcgagattgtgtctcaaaaaaagggaatggggaagcgtgcaactggtctcagtatttcccaacctcgccaccataattacattcgggcctggagcatcctccggggctggggctgtcctgaccacgtgcgaggcgcgtgagcagcatcccatgtcgcgtccgcccactccgagtgcgcgagggcaccacatagtcagtgacaaggcgaggacatattccccagtgtcttctcccagttgtccccgtgcatggggcgaggaatcacccggagcttcaaaaccaggtgatttaatcgagagcttctgtagaaaatgaccggtagttgggggagcttgcaagcgaagggtttgggtggattacatgaggtaagcaaacgtaaagctctcggcacaatgtgtgtgaccctctgtgaaatcagcgtatttcatcagtaagccgcggctttcccctacgcatgtctctgggcttggggatgggtcttactgcggaacgcgcaatcaggtccttagtggcaaataaaataactgtgtattttccaaatggtcatgtcttagatcttgtggatgacagtacaattgtcattagacaagggaatgg

SEQ ID NO: 576214 - DNA, 168 bp, Homo sapiens
ggttgtccgtgtttgtgactgggttatgttgtgtggcattctagttgatatcagattggttgtgcttcctagaaatatttcttcttctagccttatgtgctttggaactcacacatgtattacctatgacatgactctgataagtatcatgcatctgtgtgggtggct

SEQ ID NO: 576215 - DNA, 162 bp, Homo sapiens
gtggtggtagtacacaacctgtatcttttgtcaaaattcatagaactgtacactaacaaagtttattattactctgtgtaaattatacctccataaacctgactttttaataaaattaagagggctggccaggtgtggtggctcacgcctgtaattctagga

SEQ ID NO: 576216 - DNA, 130 bp, Homo sapiens
aattatcacttctcattcttccatctaccacaatttgactcctgcccactttgtcccataaaatcaccacaaaccccttatttctatagtcaataggcaattttcagcatttatatttctttggtttttc

SEQ ID NO: 576217 - DNA, 388 bp, Homo sapiens
  misc_feature (53)..(53): n is a, c, g, or t
ccggacagctatccggttcaatccacgtggaatggaacggaatggaatggtanggaatggaatggaatggaatggaatggagtggaatttaatggaatacaccagagtccaatggaatagaatggaatggaatggagtggaatcaaccacaatggaatgggatggaatggaatggaatcaaccagagtggaatagaattgaatggaatggaatggaatgaaatcaacccgagcggaatggaatggaatggaatggaatggaatggaatggaatggaatggaatggaatggaatcaaccagagtggaatggaattgaatggaatggaatggaatggaatcaacccgagtggaatggaatggaaccggatagcttgccgcggaccgagct

SEQ ID NO: 576218 - DNA, 426 bp, Homo sapiens
gcaggtgttatcatcatcgcatcgatgttagcatgattatccattgtgagtacgctcgtctagttgtcacttagatctagctaagagtggcgcaagtggagtgtatcttgacaaaaagcccatctcgggccgggtgtggtggctcacgcctgtaatcccagcactttgggaggccaaggcgggcagatcacgaggtcaggagatccagaccatcctggctaccatggtgaaatccgcgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaacaacacacaacca

SEQ ID NO: 576219 - DNA, 220 bp, Homo sapiens
  misc_feature (29)..(30): n is a, c, g, or t
  misc_feature (84)..(84): n is a, c, g, or t
tatttactatagaaagtagtagacatttnnttgaattgttattctctatatcaagttgtacataaaatacaatggttacatttnaaagaaatttggtgaaggtaggctgggcaccatggctcacacctgtaatctcagcactttgggaggctgaggtgggaggatcacttaagcccaggagttcaagaccccctgggaaacatagtgaaccccatctcta

SEQ ID NO: 576220 - DNA, 710 bp, Homo sapiens
tggctttgtcacccaaagggattacgggagctgaaattgccccattgcctccacttggaggaaaaagggaaattcctctaaaaaaacaaaaaaaatatggtacttcaaaaaattattcttcatggctattttaaaataactagaaataattgtgggaattaaggtggcatacagccgtgagaatattggttgtccacccttgggtaaagtattaaagaaaaatatgtgcttggttaaaaaaaaaaaaaaaaaaaaaaaaaaaaaaaaaaaaaaaaaaaaaaaaaaaaaaaaaaaaaaaaaaaaaaaaaaaaaaaaaagagaggggggggcgccacaaaaaacatccccggaggacacccaaatatatcaccaaccaacacatatttgaagaagcagaagcatcacacaagaggtgcgagtcaacaataaaaacgagagcgaggtgcgccgcgcgtcattaacaaacagacgtgaggagagggaaacaacccacttatttagggcttatatgtgtgtcgaggcgagccccacacctagtgggggggaggcagacaaatactggcgacaccccctccacgagaggaatgtcacacgctccagaggacaaaacaacagcgggtagaagacgtggaaaccaccaacagatagctgcctgcggcagaagggtcgacggaagatagtcaagaaacataccggaggggaaataaagt

SEQ ID NO: 576221 - DNA, 207 bp, Homo sapiens
ggctgagacatgaatcttcgcgaataatccttaaatatacttggtaagcaaaacaaaagctttttgtttacatagttcttgggattttactgttcctaattttattctgaaactcaattttaccccagaccagagtccccatattcatcctggggaggggtgccgtgtgcgaatccgcattcttgggcgtggtagtgagctgggtga

SEQ ID NO: 576222 - DNA, 98 bp, Homo sapiens
  misc_feature (86)..(86): n is a, c, g, or t
  misc_feature (89)..(89): n is a, c, g, or t
acctaccccctcctccgtttcacaccttgcaaacctctttacttgggctgaatatttagtgtaattacatctcagctttgagggcntcnttggacaaa

SEQ ID NO: 576223 - DNA, 305 bp, Homo sapiens
gggacccccattcatctcattcaatcatctcatcatttaatctcatcatttgcacctcactcttttattctcatcatgctcatctcatcattccatctcattccatcattccattccatcacttaatctcatttcatctcatctcattccagttccatgggctaccgttaggggctatggaaactcctaaacctcagggtatagaagttccaataggcacacttcccaggatcaaggctctgaccggtaatcagctagtattccatagttttagaagttccaatagccccgggaatggctatgga

SEQ ID NO: 576224 - DNA, 405 bp, Homo sapiens
agccactcagatacatattcgcacctagacatgaactgagatatgattacactttgttatcagagagatctttcagacactgtctccttttctcggagcgttctgcctccagactacctcgatcctcctcttcaactgcgtgttcttctccttctctctgttcgatctcactgtattgttcttccagttcatcaatcttgttgcggcgccggtcattctcatcacggcatatggcgaactgcctccttccactgctcctcactggccgtcgaatcccacagtgctgtggtcagccgtgcattgctctcccgaagggtctgcagctcgatctcccacttcttcacgttggctgcgctctgcgtcaaggcaatcttcagcttgtcattctcagacttcaggtgtgtg

SEQ ID NO: 576225 - DNA, 111 bp, Homo sapiens
gcagcaggtgtaggacgtggtggatggcgggtgacaatcggtcgaagttttcagcatttcgcccacaagctttggtggttataagcggggacgcggatccatcgtaggagc

SEQ ID NO: 576226 - DNA, 399 bp, Homo sapiens
  misc_feature (256)..(256): n is a, c, g, or t
aggactgtgaggaggacacaggggaggatggtgaggaggacataggggagggctgtgaggaggacacagggatggatggtgaggaggacacagggaaggacagtaaggagaacacaggggaggacagtgaggaggacacaggggaggacagtgaggaggacagtgaggaggacataggagaggacagtgaggaggacataggagaggatagtgaggaggacacagggcaggacggtgagggggacacaggggaggncagtaaggaggacagtgaggaagacatgggagggcagtgaggaggacacaagggaggacagaggggagggcatagaggaggatggtgagaaggacacaggggaaaggggaaagggggtcgacgcggccgcgaatttagtagta

SEQ ID NO: 576227 - DNA, 328 bp, Homo sapiens
cccccatccgggccctgggtcatttcacagaaaaaaagcctcctccctcccgacccgcccccccactggagagggggcacaggggcgggggaggtttcctgttttgtgaaaggccgacccccggattccattaaggcccccccccagcccctccctttattcccattccccaacctaaagccgggcccggctcccagttgaatttggtgggaatccccgggctgcaaattttccaaaccaatcgtgggatctttattgactttttttttttttttgaaagcaatgactgttttttacttttaaggaaaataaacattttttagaacca

SEQ ID NO: 576228 - DNA, 220 bp, Homo sapiens
gatcttatggaggttgcctgagcggctttgtccctggacaagttcttgaacgccatgtcagtgtattccttaagcccagaaaaataccacacactctgctctgaagcacaggtgacggggcttggaagtggagagtaatttgtacaagcaggatgtgttgatttttttaaataaaatgccttttacacaatgcctccggctgttgtgtctggaggaggca

SEQ ID NO: 576229 - DNA, 776 bp, Homo sapiens
tggcgacagtcggggttgcgatgcggccggggcctgtggcggcagtgtccgctgcaggacgggagcctgtggtgtggcgtcgtgccctcgcagtggagggccgtccagggtcatcctgcgtgggatgacgaaaatgttgccagacggccagcattgccactgccagtgcatcctgcccagtgccaggaatcatgtggactgcccaatgtgtgcatgactggatgtgccccctggttgcctgtcagctgtgcatgcccctgtcccagtacgacatacccagtgctcgcagcctttcttcggagagtggaggccatggtcatccgagagctgaacaagaattggcagagccacgcgtatgatggcttcgaggttgaactggaccgagcagcagcagatggtgtcttgtctgtataccctgggctaccctggcagccaagcgcagggtcttgcatgtgaccagcatctcctggaactccacttggctctgtggtggcctgtgccctacgtgcggatggaccatggggactggagcactgcttaagtccttcgtgtgtgcctggaacctggaccggcgagactgcgtcccagcaaccgtcggcgtgtggaggtcccagcgctgtactgtgtctggcttcaccccagcaggcatccacgtagcagagggtgacagtggtgagtgtggtgtggaactaccgtttgaggacgttatgtgggaaggcctgaggataacaaagactttccagtgttgtccgctgacagacgtacagttgatggca

SEQ ID NO: 576230 - DNA, 169 bp, Homo sapiens
  misc_feature (26)..(26): n is a, c, g, or t
  misc_feature (32)..(32): n is a, c, g, or t
  misc_feature (82)..(82): n is a, c, g, or t
  misc_feature (89)..(89): n is a, c, g, or t
  misc_feature (143)..(143): n is a, c, g, or t
gaaaggccccgtctctactaaaaatngcaaanttggccgggcatggtgggcacatgcctgtagtcccgtgtactcgggaggnctggggnggaggaatcggcttggaacccgggagggcggaggattggcagtgaggctgaggnccacagccattggcactccagtctgg

SEQ ID NO: 576231 - DNA, 101 bp, Homo sapiens
cgtggagctcacacttatatccccgcgcttgtagagctgaggtgagaggatggcttaagccgtgagttcaaggttgcagtgagctgagatggtgcccccta

SEQ ID NO: 576232 - DNA, 133 bp, Homo sapiens
agttatcactgcatttatggacaccgggcttctgctgggctttgcagagctgctattggctcttccagctggagaaggactgtgccacatgcacccctttgctgatcttttctgcctctgttaccctagcatg

SEQ ID NO: 576233 - DNA, 3706 bp, Homo sapiens
  misc_feature (2094)..(2094): n is a, c, g, or t
  misc_feature (2120)..(2120): n is a, c, g, or t
ggaaactaaccctcacaaagggtttgaggagcttcctgctgtgtgtccttaaacagtgcgtgcctcttaagtctctacaacacttttttaaagggcattgaattggacattggtttaatttttacctacgctccctataatctcaggaggtaaccattatttaatcagaattacccttgctctgtttatctgtgaggcctcagacacaacggtggttcagccctctccctaagcagtagcaagctgagtaatggcacacatatgtctaggatagccagcattcaggaaaattgctgtgaacctcctgtttttaattttaatatagaaaaagtctttcaggtttgtgacacgaagacagatttagcttcccacttgtcagcaaatttgtaaaaacctcaaaacaaatgaatatttggaattcactctaagagatacaaatcctgaatttctaactatcttctcaaatattactgaggccagcaagatgcaagtgttctacaaaataatgaactgttctaagtgacagtgttgatgctggaagtggaatgttatgttttcgctcagctgtattcattcagaaagtttttcttgaacatctgccacatgaggtgcagagaatactgccaggtgctagtttttccagtatttgacttctgattactatttccttttctcatctttagtttttcaagattttgctttaccaaaatagtaaagcctttatcatcagcttatattgaataatgttgtaattggtttcaatcaaagtttctcctcaggtacttgggggcccctagccttctaaggaactcccaggcacctacttaacaaggccagctacacactcagtatgtgataagccccatgatggatgaaggttagaattcaaagacctggttggagtcctagatgtggagacaggatgatcaggtcacacttgttagatgactaacactatcagtagaagctcttgagagattttcctaacgcagcaagatttctgtgagtagaggtatcctgggaggtatcctgggaggcagcctattgacttgaccaagtaagctgatcaggtggcctcctctacccactaaagaaatgtgtaaacactagcaataattgctttatcttaaactcctggacatactcagttcttccattccactgttctattgccaataccttttgttgttttcttcacactcctcttggcagcaaatgtctgaaagtatttcaattgtgtaatgttaaggggttttttcatagcttcagaaaagagggcagcaaatatgaagccttaagttcaaaataagtcattctacctagaaatacagaccccagagcacattgcatgaaaatacctgtactctgcagttcctcaaagcagtattcttcctgaaaagccaaacaccacacctattttcctatttgctaagaatcagaataagcacgttgtaaatagtatccaaagcagattctaaaatgacatagtaagaagccagattcaaattgtaaccaaagaagacaatagaaatcccactttaccccactgtcatcagttagaacacccttgcaaaaactgtaaccacttaagcaattcatctgatcccagaagatcataccttcttttgaaagtataggacagatatcagtgggaaacgtcggcgttctgagcaacacaggataaatgtaggagggccttaaaaaataaatctcaattcatacactggagcagcaaaaaactgagcaggaaagaaccttggtgtcttctttgagttgcctggacagtatttatgaaacaaaaaactaaatgccccccatttggggacggggggaggggttcagacctctaacctggattcagagccttagaggccgagagggaatctggaatctggtattactgagatcctaggtaaaagaaccagcctggcagtctttcccacctcattggtccgtgcttttatttttaaaccctttgacctggtagaaataaacttgcctgcctgctcttaaatgccagacagttggaagcaaatgccgagggaaaggtgcccagagccatgcttgataggactttgaatattttctccttanttgtacgttgcttgtatttagacttnagatgctatggaggtctatcccatgccatgccaatgtgaattgctttgcttcagtaacaatcagaagaccagtccaacagaaaataacttgtcataattccaccttagattctagacctctcatacctgcagtgtacagaatatgtacatgttccaatggaattcactatttttggctttagtgtcaaagagattggttctacaaggttcatctgatttcccataacaagtaaattttataatcctatgattctaaattcaatccccaatatagattctaagcatcaaatcaaaatcacagacaaaggggaactggtcgagaggggtcttagttatttcaaatccatgaccaaagtgtccaaagacatgaaactcttatacctgctgagcatttcactttactatacaaaatgtcagctacccagttgcatcctgtgacatgatcagactgtcaatgtggaccagtggccaggagcatatttatgggccatttctgttcatcattctttacagagcattgaggtttcccactgaaacagcttctttagtcagacgtctatagattttacataaatttacatttaaatgcattaagttagatggcccaattgagcatctgaatgaatatagtgggggttggtggtggtgcaaattctgctggctttatgttatggttttcttcgtgttttttcttggttttgtctggcttcttctggcaagtgccctaaaagactggaacactgtataaagtcatagacatagaaccatatgggaaagcccagatgaaaaaatggaagaataaaatcaagttgtcaaagttccagcaacagccctgacttcttcaggaatccaagcaaattgaaagccaagacaaaatgtacaaatggtgcccatgccattcatttgactgtgggtggccctctagtctagggctctcttagtgaatggttgtggaaatatgatttttctaagttccttccttttccttttgatagatgagtttgagatgatggagtaggagtggggccctcaggcacttctggtaaagacattccacctgcaagcagcattttgagtaaagcactgctgtggtttgccgatttatggtccatttaatgttaggctaaagcacctttaatcatttttgttgttttaagataatgtatttgtgaagtggataaacactggaaatagggtgcttcttctggaaagttcagtgtaaaacacaaacaaggctttggcgggtttatctggctttataaacaagtctgaaaaatggatgaaagctaaatatataaagcagttggttgtctatcttttatcatttttactcagatctgtatttaacacttatttatttgttagtttttacattcaaaagaaatacactttgaactttggctaacattgtaggatattttttaattgtttctacatttttaaagcatgattcatcatttttgtaaacttagatcattttttaattgtcttttcttttccaatagaccagttaccactcatgtgtctgcagaacctctttattgtattcctataataaatgtaaaatatttgtagcaaaaaaaaaa

SEQ ID NO: 576234 - DNA, 249 bp, Homo sapiens
cgggattttttttatttttaaaaaaaatccccccccccccccggaaaataaagggtttaaaaaaaatttagggcttttttaaaaaaaaaaattctttttttggataaaacttaaatttttgcaaaaaccttaaattaaaacaaaattccccccaaaatttttaaaaaaactttttttttaaaatttaaaaaaagggggaaaaactaaaggcccttctgggtcctttaagggtccccccaatttttggga

SEQ ID NO: 576235 - DNA, 3808 bp, Homo sapiens
  misc_feature (2024)..(2026): n is a, c, g, or t
  misc_feature (2035)..(2035): n is a, c, g, or t
  misc_feature (2037)..(2037): n is a, c, g, or t
  misc_feature (2047)..(2047): n is a, c, g, or t
  misc_feature (2054)..(2054): n is a, c, g, or t
  misc_feature (2196)..(2196): n is a, c, g, or t
  misc_feature (2222)..(2222): n is a, c, g, or t
ggaaactaaccctcacaaagggtttgaggagcttcctgctgtgtgtccttaaacagtgcgtgcctcttaagtctctacaacacttttttaaagggcattgaattggacattggtttaatttttacctacgctccctataatctcaggaggtaaccattatttaatcagaattacccttgctctgtttatctgtgaggcctcagacacaacggtggttcagccctctccctaagcagtagcaagctgagtaatggcacacatatgtctaggatagccagcattcaggaaaattgctgtgaacctcctgtttttaattttaatatagaaaaagtctttcaggtttgtgacacgaagacagatttagcttcccacttgtcagcaaatttgtaaaaacctcaaaacaaatgaatatttggaattcactctaagagatacaaatcctgaatttctaactatcttctcaaatattactgaggccagcaagatgcaagtgttctacaaaataatgaactgttctaagtgacagtgttgatgctggaagtggaatgttatgttttcgctcagctgtattcattcagaaagtttttcttgaacatctgccacatgaggtgcagagaatactgccaggtgctagtttttccagtatttgacttctgattactatttccttttctcatctttagtttttcaagattttgctttaccaaaatagtaaagcctttatcatcagcttatattgaataatgttgtaattggtttcaatcaaagtttctcctcaggtacttgggggcccctagccttctaaggaactcccaggcacctacttaacaaggccagctacacactcagtatgtgataagccccatgatggatgaaggttagaattcaaagacctggttggagtcctagatgtggagacaggatgatcaggtcacacttgttagatgactaacactatcagtagaagctcttgagagattttcctaacgcagcaagatttctgtgagtagaggtatcctgggaggtatcctgggaggcagcctattgacttgaccaagtaagctgatcaggtggcctcctctacccactaaagaaatgtgtaaacactagcaataattgctttatcttaaactcctggacatactcagttcttccattccactgttctattgccaataccttttgttgttttcttcacactcctcttggcagcaaatgtctgaaagtatttcaattgtgtaatgttaaggggttttttcatagcttcagaaaagagggcagcaaatatgaagccttaagttcaaaataagtcattctacctagaaatacagaccccagagcacattgcatgaaaatacctgtactctgcagttcctcaaagcagtattcttcctgaaaagccaaacaccacacctattttcctatttgctaagaatcagaataagcacgttgtaaatagtatccaaagcagattctaaaatgacatagtaagaagccagattcaaattgtaaccaaagaagacaatagaaatcccactttaccccactgtcatcagttagaacacccttgcaaaaactgtaaccacttaagcaattcatctgatcccagaagatcataccttcttttgaaagtataggacagatatcagtgggaaacgtcggcgttctgagcaacacaggataaatgtaggagggccttaaaaaataaatctcaattcatacactggagcagcaaaaaactgagcaggaaaggaaacagaatccaaagtcatttttcatatagctgttgtcaaatagtataaccttggtgtcttctttgagttgcctggacagtatttatgaaacaaaaaactaaatgccccccatttggggacggggggaggggttcagacctctaacctggattcagagccttagaggccgagagggaatctggaatctggtattactgagatcctaggtaaaagaaccagcctggcagtctttcccacctcattggtccgtgcttttatttttaaacccannngaaagaaananacacaccctnttatgtnggaatttcccttttacaaataatttgacctggtagaaataaacttgcctgcctgctcttaaatgccagacagttggaagcaaatgccgagggaaaggtgcccagagccatgcttgataggactttgaatattttctccttanttgtacgttgcttgtatttagacttnagatgctatggaggtctatcccatgccatgccaatgtgaattgctttgcttcagtaacaatcagaagaccagtccaacagaaaataacttgtcataattccaccttagattctagacctctcatacctgcagtgtacagaatatgtacatgttccaatggaattcactatttttggctttagtgtcaaagagattggttctacaaggttcatctgatttcccataacaagtaaattttataatcctatgattctaaattcaatccccaatatagattctaagcatcaaatcaaaatcacagacaaaggggaactggtcgagaggggtcttagttatttcaaatccatgaccaaagtgtccaaagacatgaaactcttatacctgctgagcatttcactttactatacaaaatgtcagctacccagttgcatcctgtgacatgatcagactgtcaatgtggaccagtggccaggagcatatttatgggccatttctgttcatcattctttacagagcattgaggtttcccactgaaacagcttctttagtcagacgtctatagattttacataaatttacatttaaatgcattaagttagatggcccaattgagcatctgaatgaatatagtgggggttggtggtggtgcaaattctgctggctttatgttatggttttcttcgtgttttttcttggttttgtctggcttcttctggcaagtgccctaaaagactggaacactgtataaagtcatagacatagaaccatatgggaaagcccagatgaaaaaatggaagaataaaatcaagttgtcaaagttccagcaacagccctgacttcttcaggaatccaagcaaattgaaagccaagacaaaatgtacaaatggtgcccatgccattcatttgactgtgggtggccctctagtctagggctctcttagtgaatggttgtggaaatatgatttttctaagttccttccttttccttttgatagatgagtttgagatgatggagtaggagtggggccctcaggcacttctggtaaagacattccacctgcaagcagcattttgagtaaagcactgctgtggtttgccgatttatggtccatttaatgttaggctaaagcacctttaatcatttttgttgttttaagataatgtatttgtgaagtggataaacactggaaatagggtgcttcttctggaaagttcagtgtaaaacacaaacaaggctttggcgggtttatctggctttataaacaagtctgaaaaatggatgaaagctaaatatataaagcagttggttgtctatcttttatcatttttactcagatctgtatttaacacttatttatttgttagtttttacattcaaaagaaatacactttgaactttggctaacattgtaggatattttttaattgtttctacatttttaaagcatgattcatcatttttgtaaacttagatcattttttaattgtcttttcttttccaatagaccagttaccactcatgtgtctgcagaacctctttattgtattcctataataaatgtaaaatatttgtagcaaaaaaaaaa

SEQ ID NO: 576236 - DNA, 619 bp, Homo sapiens
acgccctatacgcacgacccacagcgctggggcaaactgagcgcaggaacagcggttctgccctcccagagcctccactctgggatgccagaatggaaacgccagaggcgcaacctgcagaactcatccagctcttactgtctcacatgtacactacggcggacaactgaacgccagcgcacgaagcacacgagcggagcaaactgctccagggccctcacacgggcaggcactccatggcagctgcgagcaaaccacgcggcatcctgcacccgcagcggccccactcaacttgctacactagagcactacacatgcgcacaagaggcgtttaacagaccctctctaggacacaactgtttctgctttgagcaataatttctaacctgaggccaagcatgtcccactgccccttgggcttggctggggtagtagtcctgagccaagcactccaatatcatgccccactcaactggcctagcaagctgcctgtacttaggggaaacagatggacgctcttgggcccagccagctgggcctgggacttctgcctctgccgcctccagagtggcctggcagctttgccagaggctgtggacgcgagggtagtaggagcttt

SEQ ID NO: 576237 - DNA, 178 bp, Homo sapiens
gattagctccttctcacacaacgtagcttctcctttactggattcagctccaggtagacagagctatccattacattcgtgtacaactagactgatgatttaagaatttgttggaccatttggaagaaaagtgtctttgaagattaggtgtgccccacaagtgctcagtgagcgaatg

SEQ ID NO: 576238 - DNA, 103 bp, Homo sapiens
gagggaaagatgacacagattataaccaagcgatttatagcaaggactaacccctataccttctgcataatgaattaactataaataactgttgtcaaggatg

SEQ ID NO: 576239 - DNA, 108 bp, Homo sapiens
cacgatgactacgggcagcaccctcagcaggataagcgtaactacacgcaggttattcagaacaccattatcgcacatattgataatggcgcagtgaaagctctctgc

SEQ ID NO: 576240 - DNA, 494 bp, Homo sapiens
tgcgcagcaacctgctatgacgcctcgccttttgaaaatcgacacacctgagtcctacgacctgtcctgtcacctcaatgacctgaccgacgcgtggaaactctatgccggtgcaacctggacactgctggatgcccgcctgaaagacatcaccgtcaagaacgaaggcgtcagctggcgcatactttggcggcgcgcttgccccaggcctggccagcacatatcaatgtgaatgaccatgaacgtgtgcactgacactctgggcctacgccgtggtgtacttctgtaccatgctcaccaaagcacatgtgggtacttgcgtaccggcctgacattcgaccatgtcgcctaccaacaacacggatcgctcaccgcgcatcccgaccggcgaccgtactatcttcagcctgggcctgggctaccaggtcatggataacatgaccatcacctggctactcctacctgaaggaagaggacgtcaaagatcttcggga

SEQ ID NO: 576241 - DNA, 533 bp, Homo sapiens
gggtggcctttccaatgccggctgccacctcaggcttgggtgctggggagggctccaggctgcctacatctcaccaccggagcctgagctgccggggctatgggcacagggtgccgggcagtctgggctctcgctgctgcccagcttctttccagcctggcgaatccatctgctcaggctggcacttctgcaaagcccggcagcacagtgtgtgaacagcgtggccacaaggcgggactgccggaccccccgacgcacgccatgttctggcagagcgtggcctgagctgctgctccgggcctcaccctcgcccgtgaggagcagatagcaggcacccacctcgggactgttggaagatggcacacgctaacgcatagggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccagcccctccagca

SEQ ID NO: 576242 - DNA, 380 bp, Homo sapiens
aagtgagagaaactaagtttatatgagtgtcacgaatacttgcttcagcttcagatgtctagacttgaggcaattctgacattagaacctatgtccatcttcttgcattacactaaactgcctcttcaggatgagggagagctccctttcatggctaaggcaacctcttctgtctattaatgcacattctttattaattctttcttttatttaactgaaatctgtctcccattaacatctctcattggtcctgattctggcctcaggatggatcatcagagcttatgctcttctctttccttttgccggtatgtttgctaccactgctgccataatggcctctgccatcttttaccttgtttctgtgtggaggggtaccg

SEQ ID NO: 576243 - DNA, 960 bp, Homo sapiens
gctttctctcgccgcgccgtcttgaagccgcgcgggctcgtgagcagcgcgaggcgccaaggtgcctcgcttcgccggagccgtgccgccgcggagggaagccggctcgggcgcgcacgctcgtcggagccccgggcgccgggttgagcctgttgaccagggccggtgggctcaggctgtccgctctgggctcggggcctcggcccgtgcaattcacacctcccgccccttcggattccttcccctctgtttttattcttcctgctccagttgcggatcggtttcgcaattgtttgcaattcgtccgggggccctgggtggtttttcccaattttcccgaggcccccttctttctgtgagtactatttaacccctcttgattttggggaccaggggcctcggcaaaaggggcggttgggcagcgtcccatcctgggacgacagacaggaaggctgagggtcctggagggagggacggaaggaattcgggcggacttgtggggggaaggaagacacccaagggcaacccttttctggtaaatctcccagttcgcggcccggactctttgggaaaatcacttcgagcagggcaaagacaattgccgggcaccggggcaaaggacaggagcggcccgtgggtggacaggggcgcgggggggcacaggtgccagaggggataagaccgacggagtacgggtcgacatagttggatcaccggtccgacgataccacgcagggcatacggccggaactgatgactggtgtcgacacaaaacgcggacacagggtacggacaggagtatatcagatccagggagagcttggaaacgcgaggattccaaggggggaaaaatgtttgtaaatcctacgggaagacaatttgtgacaaatatagcacaaaaggattggagggagcaagagcggagttctacacatggggggatgatggaaaacgcaatat

SEQ ID NO: 576244 - DNA, 263 bp, Homo sapiens
tcggactcacacgcccttggttacaaccaaaaaaagagatgtccggtctgctttcatctcctctggccttttctctaccaaaaatcttgtatcttacctgaggctacagaaggagaacttccaggaatgtgacaggagagcagatactgacgggatgtggtagcatgggagaagagcaggggattgaccatgcaggggtagcagcagttggtggacaaagttccccagggcacacattggtatattccttggtgagattgcag

SEQ ID NO: 576245 - DNA, 1355 bp, Homo sapiens
  misc_feature (522)..(522): n is a, c, g, or t
agtctcctgcgagcctgcgtcgaaacgagggatgtcgttgtccagagaagtgttagcgttctgatagcatgagagagtaggatgaggaaggggacgccactcagacgactgatatcgtggaggttgcataacgacatcccgtttgcattagcgaacgaaggaccagatctacacattctcaaggacacgagcgaaggagtatcgcttccacccactgctgtgtctaggatcggatgcgatctaatgtccgaggactcgagggcaagatgcatgcgagcacgttgcgatgaggaaggtcgccacagatgacgagacgctaagtgcaaggtatgcctcgcgcgcaggttcgcaagcaaaggggtgcacacgcaacgttgcagaaggctcgcacccattccagtctgcgtatactgtggtacgagagcgtggatccatcggtggcatcgatgggcacagcatataggcgcaagaattctggtcaaaacaaagcaatccatctctatgtggggtcaatgtctcgcntctgtcacggggacagagatgaacccgcacaagctctgattctcacagatatccctggggagcagcataaggagagagagatagaactgttgtagggatactaaaagggatacattgtgcataggtgtgctcatagtattgtcgcatgatgcatctgtaattaaacaatgggcgttcgtaaaactcggaatttgtacagatttgggaatgcaaccatcaaactacagattctttgagatatgttcgtcatatgggcccaatttgggcgtaaagaaggtaaaacataaataatcctcttaggtctcaattgattaaggtctccttcgttccacgaagaggagtaaaggtgaggggggcaatacacaccggaggttataggcaagtctaatggggaaacctaatcggggtgggccggatggttaaaagacttagttactactaattaaatcacattgaagaggggtaaaattggaacggtacatggtttaggtttcgaaaagggaatcaacattttaaaattggaaggttgtattgggcaatgtggacatatggttttaaaattgtaggggccttacgttacacaagaccgatacttcgaaaaccaaaaaaacgcaaagcgtttggtaagggagaggggcgttccgcgggtaaaatcgacatagagaggtgggatatggcgtaaacttcgggggcgaacaaaattgtggggtttgagaagtggaggagctccttattaaaggtatacacgagaggaacatataggcgggagcacacgggagaaattggcctagtgaagcacgtattggaaatacccctggaaaaacaggggaaat

SEQ ID NO: 576246 - DNA, 336 bp, Homo sapiens
acatggaggggcgggaaagcattatgcagcggttcgcagggtcagtcagccccatgaactcctatctacttcaagcagccggtgcagccaccaggacggggtgagggccgtgactacctgcactgtggtctagacctgctgcagaggaagctgcggtccctgtggcgaaggccattcaaattgtcactgatgtgctgacgcccgcccagctgattgtgttgtccacgtcaagcggctgcgcctaaccaggacgtggggatgacatgccccggagcaggacaattatcgcaccatcaccgggaatgttgcaaaacaggacgcagccccaggctgggg

SEQ ID NO: 576247 - DNA, 679 bp, Homo sapiens
ccctgctagtaatggtagttccagtggaccaacctgtgatgaatatgcccaaaaggtacgacaacaattccacgatgccaaattcatggcaagacattgatctggatccaggctgctacattgaatagagaacagattcagaatatgcacagttagcacagtataacatgtcattttcagttgttggtgacaaagaggaatcagtggcactgcttaatatccgcacaatgagacaataaggtccacggggaacgcaccatttctgaaactatcgaagcggctacagcagcgtcaatagagttcctgcagcattacaggcagaagaagaattttaatgaaaaaattacccagatctggctccatggaaaaggaggaatcagcgtttccgtagaatattgactcttgtactctgaacaatgtcaatttatattgaacttggaggagtgtctgtgcataacgtctgaactaggtcaaccctcgcacggcgtaactactttcttgacctagtcagtttttacacaatgtgcagtttgacaggagttaattaaaagagacgccaataaaatgagttttactcatctcagtatctgagtactggaagtgaaacatgagggatgctttagtgtaatgtgggagacttttttgtaatcttaatgcacctggaaactactccaggcat

SEQ ID NO: 576248 - DNA, 130 bp, Homo sapiens
  misc_feature (49)..(49): n is a, c, g, or t
atccctgcagagaagagacgagatgggccggccaggcaccttctaggtnacgaccacatctacacgttgtcgtcacagcccatgcatttgtataatcttcttcattgtattacccttcataatctggagg

SEQ ID NO: 576249 - DNA, 135 bp, Homo sapiens
  misc_feature (116)..(116): n is a, c, g, or t
ttttaaaggtagtgtaacctaagtgtgcaatgttcacacctacagtagtgtgcaacaatgttttaggccttcacattcactcactgttcacacacagactcatccacgacaacttncagccatgttaagtgccct

SEQ ID NO: 576250 - DNA, 288 bp, Homo sapiens
tcacaataggcacagaaaaaaatggcgtcggtactggaacatgtacatttgtctggtggttattccttaatacagtataacagttatttacatggcatttacatggtattacgtattataagtgatctagggatgattaaaataatacgggatgtacacaggttatatgcaaatagtccaccatttaatatcagggactggagcatccatagatgtgggtatccatagggggtcctagaaccaaggccccacagatatggagggacaccggtgcatgtggggagcggg

SEQ ID NO: 576251 - DNA, 951 bp, Homo sapiens
  misc_feature (20)..(20): n is a, c, g, or t
  misc_feature (76)..(78): n is a, c, g, or t
  misc_feature (126)..(126): n is a, c, g, or t
  misc_feature (135)..(135): n is a, c, g, or t
  misc_feature (171)..(171): n is a, c, g, or t
  misc_feature (228)..(228): n is a, c, g, or t
  misc_feature (274)..(274): n is a, c, g, or t
  misc_feature (283)..(283): n is a, c, g, or t
  misc_feature (318)..(319): n is a, c, g, or t
  misc_feature (321)..(321): n is a, c, g, or t
  misc_feature (394)..(394): n is a, c, g, or t
  misc_feature (401)..(401): n is a, c, g, or t
  misc_feature (454)..(454): n is a, c, g, or t
  misc_feature (476)..(476): n is a, c, g, or t
  misc_feature (486)..(486): n is a, c, g, or t
  misc_feature (489)..(490): n is a, c, g, or t
  misc_feature (494)..(494): n is a, c, g, or t
  misc_feature (496)..(496): n is a, c, g, or t
  misc_feature (499)..(499): n is a, c, g, or t
  misc_feature (519)..(519): n is a, c, g, or t
  misc_feature (522)..(522): n is a, c, g, or t
  misc_feature (536)..(536): n is a, c, g, or t
  misc_feature (539)..(539): n is a, c, g, or t
  misc_feature (554)..(554): n is a, c, g, or t
  misc_feature (560)..(560): n is a, c, g, or t
  misc_feature (562)..(562): n is a, c, g, or t
  misc_feature (564)..(564): n is a, c, g, or t
  misc_feature (567)..(567): n is a, c, g, or t
  misc_feature (633)..(633): n is a, c, g, or t
  misc_feature (636)..(636): n is a, c, g, or t
  misc_feature (641)..(641): n is a, c, g, or t
  misc_feature (728)..(728): n is a, c, g, or t
  misc_feature (828)..(828): n is a, c, g, or t
  misc_feature (842)..(842): n is a, c, g, or t
  misc_feature (882)..(882): n is a, c, g, or t
atcccctttggcccctgctnccaggttctccttgtccccctttccttgccttcatcccatgttctgtccccctaannntccctccaggcagggaaaaaaggccaggtgctaaaaaatgagcctttntaaagcacntgagcagcggaaggcagacaggcgccagagcacagnactcccttttccagcagctgtggtgggggaggttcccctccagtttgtcaagagttnaaggaggctctgtggccaggtgacctggctgccttccactccttgnaccacagtntaaacatggagtggccgctgacaaggcgctccagnncnagagccagcgtcttcatggggaagatgaatggacctgagtagctgaaggaaggcccctccctacccaaaaacntggaggnttctcagcctcaatttccctgtctgtacagctgagggctctgcctgtccccantgtatcagtatggaaccccagntgggtccctnatnnagtncnacnccccccaccgccagcagtgntcntccagccacacccntcntgctccccccacccntagccntngnccntggctggcctgccccgctccacaggccaccagatgggctcctgagaccctccccaggctgcttacngcncattntgctgggggtagagatgaggggagggagtaagttaaaccttggactagcaagtagaagcctggggggatgcgtgtgcctcagtttcntcctccacaactgaatatagtggctgaaaactggggagatacttgatggcgcgaatgtccgttttttctcccttcccacctcctgcaggaagcaggacgngggcaggcagcacntggtaggcacagctgctttgcccctcctccccttcccttntggaagtcttggggcctcagtgcttgcaacagccggccttgggcaaataaaagattaggttgtttacta

SEQ ID NO: 576252 - DNA, 199 bp, Homo sapiens
aggggagatcaagcgtggaccttcggggtaccggcagctcatcgactcaggccaactccttcgtggcacgcgctcatacaggctccggagcggttgcaaggcacacatactcggtgcagtcgacatctggagcatgggcctgtccctggtggagctgccgtcaggaaggtaccccatccccccgcccgacgccaaagag

SEQ ID NO: 576253 - DNA, 117 bp, Homo sapiens
atgagttttcaaacagcacgagatctgatcatgacattccaaggagattacacgtcatccatcactcatagactcgttacaggggagatcctctagtagtcgatcatgcagcgcatg

SEQ ID NO: 576254 - DNA, 133 bp, Homo sapiens
ttttaagtgttattcacatatttaaaacatatgatggtatagatatgatgtggatataaagtcgagataaaggagggatggtttaagaaattagtgcatcaattcttaaacaatacttcctttatctcgaggg

SEQ ID NO: 576255 - DNA, 160 bp, Homo sapiens
agctgatatcttcgccagtatgcagcagttacgagattgctatgtcaccatgacaatgtaacctagaatgtcgacaggatgcaaaagagtgtctgtagttcgaatggaaattatgcatagaggtacacccagagcaaatagcatggatttccgaactctt

SEQ ID NO: 576256 - DNA, 446 bp, Homo sapiens
ggcgggtgtggccgcgctctattaaagctggtcctttttttaagagttttcacctgataccttgcgggccgtactgtagataacattccaaaagaaatactactttgcacccaccacgcgaaaaaaagatgaacatagtctctttgtgcatctgctcctctcctcgtaaagctgatagcctttcttcggagcaattatcgtccgcttgcaaggcttctttttcagcgcggggccccgggtctttttctaccatttcatctattttatgcggaattcttttttctcagcctgtcccttctgttggatttcctcttgttttccctctgctacctagaaaaataagaaaattcagttatttaacaaacctaactctgttttaagagcgagccccaggaatgcctttattcacttaaacttctaagaaaagtttgttctgtagaaaagaa

SEQ ID NO: 576257 - DNA, 478 bp, Homo sapiens
  misc_feature (9)..(9): n is a, c, g, or t
  misc_feature (24)..(24): n is a, c, g, or t
  misc_feature (47)..(47): n is a, c, g, or t
  misc_feature (63)..(63): n is a, c, g, or t
  misc_feature (467)..(467): n is a, c, g, or t
  misc_feature (469)..(470): n is a, c, g, or t
aaaaagcantgcctgtcaacaatnacattattattaccttcccttantagtcattttgagttnaggtgtaagtgggaacttagaacaaaaggaaagaccctagctttgtggaacgtctgaattcctcctctgcaaaaatggtgatgatgcctgccctgccccacttcattagatccagagataaataatgtataagaaaacactttagcccaggtgctgtggttcactcctgtagtaccagcactttggggttctgaggcaagaggatcacttgaggctaggagttcaagactagcctgagcaacatagcaagaccccatctctaaaaccataaaatacagtagccgggcgtggtagtgtgctcctgtagtcccagctgctcaggaggatcacttgagcccaggtgttcgaggctgcagtgatctgtgatggtgccactgtcctccatcctggttgccagagtgagnannctgtctcc

SEQ ID NO: 576258 - DNA, 1009 bp, Homo sapiens
gacgctttgcccctgaagacacggaattcgtccgtggcccgtgcttgtgcccatgcctgtttctagtgccagccactaagttgaggtctggtcccatgtgcgtccttcatcgggatgctagacggccttcccgccaaggcatggatggccatggatggtctgatggagtctccttcacatgatagtcttgtcttcaatgcccgtcctctggagctaattgtgataacttatcctttgggcttgcggtgtatgcaagcctcagcgcgagtcctcccccgggcaaataggctcctgacgggtccctctggggccgtcctctcctgcctgcgtcagtgcagcatgggtcccctggagacagtgcggatggtcggggccatgtggccggtccctcaccccacatctgtggatcgtgggccccccacttcccccccaagggggccctgcccaccaccaccttcccggtgacccatgatgaccacatttaataccaatattgggtttggtgggtgacggcgccacctccagtgccaggggcacgtgctgtgagcttcctgggagcccaggttgttgctcactgctctcccgtatcgtgagcaccacctctgctgttccctgctgtagatcctaaggccaggggctgcttgtttttgtggagaccgtgtgtgttcattctcatgatgctagctcctccccagaggaccccagcgcacgtcccgggacgattgtcaggaataaggaaaggtcacacagggcacagtggacagtcatcccagtcgatctacgctgataggtgaccatgacctgatgaggagaaagaaacagtgaccacgcggagagtgagatgtgcgggatctgtctagacgagttctcccagtgaactatatagtagctttggcgttcactccactgttgttactcgttactgagtttcctagacctggggtggagtgttctacccaggaggaaggggggtcccgacactgtgtcacatgtggtggccatttgcagc

SEQ ID NO: 576259 - DNA, 965 bp, Homo sapiens
  misc_feature (260)..(260): n is a, c, g, or t
ctgtcctccaccccactgggtgggattgtgtccttctgatgctcgctatcgatacacaagtggtagccgagcagtggtggtggcacacacaaaaggtagtcaatattgtctcgcctctcaaatgagtcctcctccgcccccggtaggttataaacactgtgggggaccaacaccatcgttttggtgtgtctcataatgccatgcttgcgctgtgtatcccagtgtgggtgcgtatctatgttgattggacgacgtggtgngcaccaccactcgcttgctgggatcctcccttctgtgggcttccactcatgcgtggtccccacctacgctagctgtgctttgtctctccctcggagggatcacacccactctcttgcattggcacacacgcggagatccacacgcacgtgcttgctcacatagagatcacacaccacgcagtctgtacccacctgggcagcgatctgtgctcgctcgcgggacggccggggtttaccactctcttctgccacaccacaacccacgattccagagaggcgtgcgtgtgtgtagagacacacgtgggtggccacggacacactctgctgggagccaaaaacacaaggagtgtctgtggtgaggagacacccccgtccgctcggtggtccaaacacggctgggcacccaccacgactcactacacaccacaacgtgtctgtccaccagaacacccaccgctatgctgctgggcacaactgttgtgccatccaccaaggagcacgctccacttgtccgaccacacggggggtcacacgacgcacacaactgtgtgtgtggggacaaaccgccgccgcggcgcgtgtctccaccgcggtgtgtgccgcgccacacccaccaccacacggagaacccgtgagcacccgcggacaacacacaacgccgcgcggggagaaacaacggccccattacccccccgtggccccaca

SEQ ID NO: 576260 - DNA, 548 bp, Homo sapiens
  misc_feature (353)..(353): n is a, c, g, or t
  misc_feature (378)..(378): n is a, c, g, or t
  misc_feature (388)..(388): n is a, c, g, or t
  misc_feature (413)..(413): n is a, c, g, or t
cccgtgataccgaaagcggaagatggtaatttttttttacggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgcagntgtggaattcaagtttttcaattgngggaaatttnctgccccccccaccagatttttggngggtaaataaattttgccaaaaggagaaacatgggggggacactcactaatttatcttgggtggggaggtatggcataataaggagaaagaagggttaaattttctttggatttggttccttccggatcccgggg

SEQ ID NO: 576261 - DNA, 438 bp, Homo sapiens
caggtttactccaattccaagagatatcgagaccttcctctgggtcataagaggctttctctggttcatcaatgctatgggttcattatcaagaaccagagggcagctgggcatggtggctcacgcctgtaatcccagcactttgagaggccaaggcaggcagatcacttgaggccaggagtttgagaccagcctggccaacatagcgagactccatctctactaaaaatacaaaattacctaggcatggtagtgcacgcctgtaatctcagcctcttgggaagccgaggcatgagaattgctttaacctgggaggtggaggtttcagtgagctgaaattgtgccactgcactccagcctgggcaacagagtgagattccgtctcaaggaaaaaaaaaaagaacctgaattagaccccccagtgtgcccagggagagg

SEQ ID NO: 576262 - DNA, 539 bp, Homo sapiens
gttgtggtcgcccccgctgggtgtgtggccaactggggggggtttctcttgttgggtcgctttttgtgggaaggcccctctctgttgtggtggggctgtatttgcggtggattagtttgtgagcaggtgttgtttcgtacccccccttgtcgctcccgctgtgtttgccgcgagtgtctctataagagtgggtccccactcggcctcttgtaaaaagttttgtggcgcaccgttgttttgcttctcccccgttggtattttgttccccgtctggttggtgccccgctccgtgggtgtgtctcttttgaggcgtttgctgttctgaccgccccttcttttgtgtaccccattgcggtgttgacccgggcggcttgttgtactggggaatttgtgttctttgcccacacttttaaaaagtgtttatactcccgcgggagtaattccccccattttgtagaattttctgtcgggggtccccacgcccttataagtaagttttgtaaaaagtatccccccctttcttgggatcatttcagtac

SEQ ID NO: 576263 - DNA, 874 bp, Homo sapiens
gagcacaagattccatgcccatacgcgctgcatggccattcgccgccatcatgtacgtgcccgcgctgggactgggagttcctggcctccacgcgcctcacctccgagctcaacttcctgctgcaggacgatcgacaactgttaccacacgggacggccgcgggccgcgcgcccaagatcgaacgcgatcgtcctggcggcatcacggagcgcgagagcgcgagatcatcaaacgcggaaggagagagcccggagcagaacctgtcgagaagtactggagcgccgggcgacagaaacttactggccaagctgtacctggcgcggacgtgctgatcctgctgctgagcgccgtgccatctcctactgtgacctactacgccacgcagaagcagaacgagttcactgcgcgctgggcgcgtccccggaggggcggaggtgcggggcccgcggtgcgcgtgagctgcaagctcccgtccgtgcaatgcagcgcatcatcgccgggcgtggacatcgtgctgctgtgcgtatgaactcatctcctcgtaactcatcacctctcattccgcagagcaattatctcgaaagtgcccaggtggcataagagcgcggagtgggccatccagtctggaatacatctggctgtctgcaggaacgtgccattaagtcgtcacggtggctcatccaagagagcgactctgtgacagtgacggcctgtggctggcatcccagagcaccaagggcgagggtaacggccgcaacgggacaggccgacccgtctcgcccgaaggtccaccttcaccagcagctttctaacggaaaccggacgcgatcgcggaccatgggcggtcacgacaaccaacacgtcaagcagtaa

SEQ ID NO: 576264 - DNA, 183 bp, Homo sapiens
  misc_feature (9)..(9): n is a, c, g, or t
  misc_feature (14)..(14): n is a, c, g, or t
  misc_feature (19)..(19): n is a, c, g, or t
  misc_feature (27)..(29): n is a, c, g, or t
  misc_feature (69)..(69): n is a, c, g, or t
  misc_feature (100)..(101): n is a, c, g, or t
  misc_feature (118)..(118): n is a, c, g, or t
  misc_feature (136)..(136): n is a, c, g, or t
  misc_feature (139)..(139): n is a, c, g, or t
  misc_feature (144)..(144): n is a, c, g, or t
  misc_feature (162)..(162): n is a, c, g, or t
  misc_feature (175)..(175): n is a, c, g, or t
tattgtggnttaanttttnttttggtnnntagtgttaaacaaaattaaagttgcatacattagtaacanaactcaacatccttaatttggtatagatgtnntatatttttttgttctnttgttgttttgttaaatnacnataantaaaatgctttataaaantgttatgttgtantttaattt

SEQ ID NO: 576265 - DNA, 347 bp, Homo sapiens
agctgtatattgtaagaaaaacaagagaccgcaaccgaggtcgcccttcagatcaagaccgttcgacatctgtatgctgaagtggagcggctgattatttcaatgcacccctatcagcttcccgaaattattgcgattccaatcgtagatggcttacccgcttacctgcaatggatcagagaacaaacaggaaattaattctatgcagcattccaaccggaagatcaaagtctttttaccttactggcattttgtttccgcattttgccgatccctattgatcagcgcgtgtctggtctggatgccggacgctgccgcggatgactttctggatcctgaagtcgcgt

SEQ ID NO: 576266 - DNA, 353 bp, Homo sapiens
  misc_feature (28)..(28): n is a, c, g, or t
  misc_feature (59)..(59): n is a, c, g, or t
  misc_feature (236)..(236): n is a, c, g, or t
cctgccctaatttcactcctcagaagtnaaggcaggtaaactggggctcccactgggtnactctgaagagggttgtggctctggttccttattaaacccagggcccaggtgcagggctcacacctgtaatcccagcactttgggaaggtcacttgagctcaggagttcaagaccagcctgggcaacatagtgagaccttgtctctggaaaacaattagctgggcatggtggtacanacctgtagtcccagctacttgggaggctgaggcgggaggatgctttagcccaggaggttgaggctcctgtgaaccctgatggcaccactgcactccagcctgggtgacagggtgaga

SEQ ID NO: 576267 - DNA, 1225 bp, Homo sapiens
cttagattcccatgaggaagcatcgtaggaaatcatggaacaaggtttggtaatggaagagtgtggactaggcagttgccgtcgactgaaggttctactggccaagggaacattctcggagacagaaaattcaagtcgaagtagactatgcttcgtgactgataaggatggcctgctgatgtcggccagatctgggcagaccattctaaagaaaaagatctgaggtcggtctcatagaaggctctctcctcgctggtcaccccactatattcatggcgagttccaacatgtcaatggatcaggcaagagcgctatcggtggagagacgcctagtgtagtctaccgaggacaacggagtcttgcactgtggtgcctagccacacggacgtgacaactaccaggttgcgtgcagcaggtcctggcggtgtgctcctctcaagcaggaaggaacttatcttactgccagaagtcctttgctcaatagcacagggtcatactgcacacatgtaagatgctactcgtctagggcttacagtcacacttgggaggtcccatgcactggagtcgaacgtgttttggaatcatgctgatacggttggagagttatgactcgaaacaggttggtccaagaggcacctatctcacgatatagctagagagttggggcttcttggccggggatttgccccacttgcatgggatgtgccaacagccgagtcctgcgtcagtactccaggtggtggcacatatctcggcgtggccaaatgactccaagcaaacgccagctagagactaccgttctgtgggaaaccggggccgacaaggatgctcacagaatcatccgagtgtcagtagggtcgttcaggctttccagtgttagagagaagcgggattgttaccggatcccttgaaggacccttcgttgcaaggcaacttctctggaattgcccgggctggaggtatatttgacaatgcggtgggctgagaagcttgaggacaacaacgccaaagtggtctcccgtgcgatatggaaacatacgcgacagaggggagcacgtatatcaccctgggagatcatgcaccggcacggtgtggacaaccatgtatacatactaggaagaaggaacacacacgggaggtaaaaccaacacccaaggacggtgtgggacaccaaacaacatatagaccggaacagaacaccctgggacatcgacgacacacaaaa

SEQ ID NO: 576268 - DNA, 119 bp, Homo sapiens
ctaggataaagattccaggaaggagcgagtgcatctggtgattaaggtagcaggcggctcggcttggcaaccacctaaatcgttaggcgcgccttccttagatagaggctaccggcatt

SEQ ID NO: 576269 - DNA, 328 bp, Homo sapiens
ctagctattacgggtcctttaaaatttaagtcaggtgcagtggctcacacttgtagccccagcatttgagagccctaggtggggaggattgcttgacgccaggagatagaggctgcagtgagctatgattgggccactgtactgcagcctgggtgacaagacaaccccgtggtctttgaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggcc

SEQ ID NO: 576270 - DNA, 230 bp, Homo sapiens
atgagcagccccagatataattggagggttttctttcctggagatggaatctcgctctgtggcccaggcctgtatggagtgcagtggtgtgatctcagctccgtgcaacctccacctcccgggttcaagcaattctcctgcctcagcctcccaagtagctggggctacaggcgcacactgccacgactggctaattttttgtattttagtagagacggggtttcaccatg

SEQ ID NO: 576271 - DNA, 142 bp, Homo sapiens
aaagacagacgcgtatggggtaatataaaatctggaatcaatatattaggtgtctggggcaattatactggcaaattctaccaggtaataaaaggggagtagggtgcccataacccagaggtttcttcggtgtaaggggaaa

SEQ ID NO: 576272 - DNA, 131 bp, Homo sapiens
aggccacctcgagaatcgcgcatcaggtgggactgcgacagacagcgcaaaattgccagcgtggtgaactcgaagtaggtcagcgcctcgccaccgcgtgccacctcgaccggggggtccggcgtgtctga

SEQ ID NO: 576273 - DNA, 378 bp, Homo sapiens
tgagatccagccacagcactccagcctgggtgacagagcaagactctgtctcaaaaaaaaaaaaaaaaaaaaatccaagattaggcagggcatggtggctcacacctataatcccagcactttgggaggctgaggcaggcggatcaccatgttggccaggctggtctcaaactcctagcttcaagtgatccagctgccttggcctcccaaagtgctgggattacaggcatgaaccaccgtcccaccattggtgggtttttttggattgctttggttttagacctttctctttaaattttttggaaaatatattgagtttaaaaacccaaattacccctttaatttagctagccacggcacttccgcctgggtgcttga

SEQ ID NO: 576274 - DNA, 865 bp, Homo sapiens
ccaaagggtctgtcaaagggttccgcacggaacctcccttcggtgtccctggaggtccggggttcgccatgggccccgccccgcccggtgttaccggtattgtaagacaaccgtaccccaagtctcgcttctgccgaggtgtccctgatgcccagattcgcaattttgacctggggcggaaaaaggccaaagtggatgagtttccgctttgtggccacatggtgtcagatggataatgagcagctgtccttctgaagccctggaaggctgcccgaaatttgtggcccaataagtaacacatggtaaaaaagttgtggcacaaagaatggcttccacaaatccgggtgtcggcgtctcaccccgttccacacgtcaatctcgcaatccaacaaagaatgttgtcctgtgcctggggctgaacacaggctctcacaaacacggcacatgtcgagggtggccctttggagaaagccccacgggcacactgtgggccacaggggttctacacacattggccaacagttaatcaatgtccacatccgcaccacaagctgcaggaccaaaggaggcacatgtgaattgagggccctgcgcacgggccacaagttcaaagtttcctggccgccacagagaagagtccaccacatttcacaagaagtggggcttcaccacagttcaaatgctgatgaaatttgaagaacactggtggctgtaaaagcggctcatcccacgatggctgtggggtcaaagtacaatccccacgtcgtggccctttggagcaagatggcgggccctgcaatcatgagggcttccaaagtgctgcccccctcttaatactcacccataaattttacttcctgtccca

SEQ ID NO: 576275 - DNA, 171 bp, Homo sapiens
acctgatgggaccgagagctcacagacgcacattaagatagacatatatagcatactatccatgactggaggaggaggtggaggtgtacttgatggtagagaactgccgcctccaacagagctgaggccacccccaaatggatctgccactgacatggaaactgaagacca

SEQ ID NO: 576276 - DNA, 129 bp, Homo sapiens
gtataaatcctagcataagcccaactctcacttacccatccacagcaccagacccagatagcataggtgtcctaccccagcacagacatagcaccctagccccatagccaacttgacatactacagcat

SEQ ID NO: 576277 - DNA, 299 bp, Homo sapiens
acgtctgccctcggaggatgagatgttgactgcctgtctggctttctgttgactggcctcgggagctggagctgctgggagcctggtgagcttccctagtctgggagtaggctgtctggctgaagtcatccatcaggttgaagaagcacttgatacagatgagaaggagatgctgctctttttgtgccgggatgttgctatagatgtggttccacctaatgtcagggaccttctggatacgtttgagcaggtcaaatcgcctcactctgtagagcagctcagccaagtccccgacagac

SEQ ID NO: 576278 - DNA, 321 bp, Homo sapiens
ttcatcaggatccccgcggagagctgccctcagcaacttggctgttgatttgaaactgtgtaggtgtatttttcagtgagctggaatgtcttagacaagccttgatgatatgtctatttgtgggcttttaactgtagtttcagggaccacttaagacgagattagatgggctcttctggatttgtttcctcatttgtcacaggtgtcttgtgattgataatcatgagcgacgtgaaattgcattgaatttcaagggaatttagtatgtatatcgtgccttagaaacacatctgttgtcttgtctgtgtttggtcgatatta

SEQ ID NO: 576279 - DNA, 153 bp, Homo sapiens
gggcggggatggggagaaatagggagtaactgctaatggatacagagtgtttttttgggtgataaaaatgttctagaatcggtgatagttgcacaacctatacttaaatttactggatcatacatgttaaaattgtgaattgtatggcatgta

SEQ ID NO: 576280 - DNA, 138 bp, Homo sapiens
tacgcccgtgaggttgtgcaccctgagtatagctctcccccaccagcacggagggcagccgatgcctggggcataaggactcttccccttgccatcctctatccttcctggctccagccggaggacgagacctctgcc

SEQ ID NO: 576281 - DNA, 372 bp, Homo sapiens
agaggatccccctggtcaccacgcatggcaagctattggatttaggggtgagtgctcaattggtaccgcaccgtgggcagacggaacactttcattgggactccctactgtatgtgctccataggtcatcgcctgtgatgataacccttatgccacctataattactggagtgatattcggtctctaggaatcacagccatcgatgatgcagagggagccccccctactctgtgacttgcaccccatgcgtggattgccaattggccaatccatgcatcggccaccgcgcccggctgaacaagttattgtagatcttcaaattcctatttcaatatccatctaggaatttgaatatctctccataatgcgtt

SEQ ID NO: 576282 - DNA, 570 bp, Homo sapiens
tcaggaggcatgttacttagggggcttgttccagcatgggagggaagtaatgtgtatcagcttgagctgtgtgaatgaaaaaggaaaaactatctcgaaccctcaatctgctcaaactgtgacttgaaaagacttttttaagagatagccacttaagcagctgggcaactcattcttttgttcactggcagatggcaaaacctcagagcacaatggtgagcattttggtcagacatgtcccacacacttttatctgcaccctgaagtaggatccaggatttgcagcgcatccttcccttatcctttcgccctcttcccccttttcaaactggtgtaagttactagagcttgtaaaagtataagaactaaggaattctgctctcttgttttcttgctctgagcttggaaatacccaccacattgttaagcaaatgttctctttaccagtagtgggtaaacaaagacatgagtgagttttctgctacacctaatttaagatgtagaaaatcaaagccacagagcagggtcagtcagctctaggtctgatttatgagcatttagaacaacaac

SEQ ID NO: 576283 - DNA, 985 bp, Homo sapiens
  misc_feature (713)..(713): n is a, c, g, or t
tggccaaaaaaacaaatctaaaccaatgcctttttaaaaacagggactctcaaaatcctgctacccagtttccccaataaaaggggcccaaaattcaggaccccttaaaaacaactgacaaaaagtgtcaaacccagagggccacccttcctgtgcatagatgtgaagcagcagcacatttgactcttccattttctatctcttgattagggagacagaaaagaggcattcttcgaaccagaattagaaaacaccaagggcgtgggtgctcccataaaaaaaaacagatgtgggctttcaaagaaaacacataggagaagacccacagagcgtgtactcaattttagctggtaaaacaattaatctccaattattgccaaccagggcgatatctgagcacacccagctttctctaaactcaatagtctagtggacacctccattcctcttctcgagaactactttgggtacgtggggctcaaacagcctttgtgcttttcataatactctatcactttcaccacgtgctcctggggccaaaaagctcctttccgttaatcattggggccccctagagcggtggcgcgatactccacgttcccctccccaatctgtctctataggttgctttaacaacacacgacaagcttcttcttccacactcgacacactcacaacacaccccagggtgccctttataaccccaacagtgngctagataattgcgtgcgctttccaattcccccataaaaattaaccaagttcttccccataacctattaaatagggctattaaccaacggtcctcacacaaacttgaaatacccgcttctccccaaccaaatttttattccccttaaccgggccgagtagcaacatccggaaagccccggaaatatattttacgagcaacactccttaccacctttaaacattcggctcttacacttttcgaacttgcactcagcagccatctctcgcgtta

SEQ ID NO: 576284 - DNA, 791 bp, Homo sapiens
ggggcccgcgttggtgcctcctgaggcggccccctggatgaacgagatctgtggaaccctgggagccttgaggtaaccgaagcagctcggttgcgccagggcctgagctgctgctgtgacggcctctgctaatattcgattttagacacgagcatactatctgcagttgatgacccgggcttgactggtgcatacagctggacgccccctgagaatctcgcagacttttgtggctgccgtctatcaccaatcaaccttcatatctcgctctacatggtaatgctggtttgcacgactggtgatacgacaaagacccgcaagctgagcagggccttcgcgatcgcccctatcctgtgtcctgtctagctctctagagtcactcaccattctctgtctctctgagagcttccgtgcttgctcgacagctgcttcaccgcagcgccatgctgagccagcccaggctggatgagcctggacacccccggcggcctacatgcctgggcctcgcgctcctgggtactgggcgtcgtgctcgtgctcttccagcttctttgccctgtgggttcgctcggaactttcctagggttattacttcgggatcctcaaggaggcgagagtgacccgtgttccccttcaacatcctggacaaccccatgtactggggaagcacagcaactacctgggcttgggccatcatgcacgccagcccacgggcctgctctgacggtgctggtggcctcacctcataatggtctcctattagaagagccttacggtgagattaccgcgaa

SEQ ID NO: 576285 - DNA, 871 bp, Homo sapiens
  misc_feature (22)..(22): n is a, c, g, or t
  misc_feature (37)..(37): n is a, c, g, or t
  misc_feature (217)..(217): n is a, c, g, or t
tgaggatgacgcggcatggcangaactgcacgagggngcgtctacactaccacgagaagaagaaggacacagggctcggctatgggacccagaacatcgatgagccggatgcgtgaggattcgatgttgttgttttttccttgagctttgcagatcctgttgtcaccccagatggctacctgtatgagcgtgaggccatcctgagtacattctgcancagaagaaggagattgcccggcagatgaaggcctacgagaagcagcggggcacccgcgcgaggagcagaaggagcttcagcgggcggctcgcaggacatgtgcggggcttcctggagaaggagtcggtatcgtgagccggcccctcaaccctttcacagccaaggccctctcgggcaccagcccagatgatgtccaacctgggcccagtgtgggtcctccaagtagggacaggacaaagtgctgcccagtttctggatcccgtcgctgatgcccgaagcaaggccaccaagctggagaagccgtcccgcacggtgacctgcccatgtcagggaagcccctgcgcattgttcggacctgacgccgttgcactttcacaccgtagacagctccgtggaccggcggtggggctcatcacccgcaggagcgctacgtgtgtgccggggacccgcgacagctgagcaaagcacccctgcgctgtgctgggggcctctgggctggtgtcaccctcgaatgcgtggagaagctgtcggaggccttgggggcctgtgactgaggacaccttccgacggactcatctgctggcgggggccggtcgggccggggagtgagggaaagggggtcggcgttgtgggccaacggggtggcgcaaaaag

SEQ ID NO: 576286 - DNA, 309 bp, Homo sapiens
cagatatgatctcctcctcgagcctcccacagtgctggaattacagtacgataagccagcgtgcccagctcacattgtgcgttaagcactaaatgctgttcagaggcaggattcttcagcagatcaactaccggaagcggcatcggtgtcattgtctttgttctgtgttatgggttgagccggtaggtcttagggcggagtcaggatgaggaaggtggtgttctgcagggataagcggatattggcactgaaacaatcgacaggctgcctgaattccaggcagggtgaggcacgaggatgactggagag

SEQ ID NO: 576287 - DNA, 394 bp, Homo sapiens
agtctttctacttttgtaataataggaagttagtaggactcacttctctgattaataagcaatttgcagcacacagcgttccactgcggggtttcacgctcacctgaaaacacctgttcccaacctacttcttggtgcaagttgaccaaatcgttttaagtggtaactctttctaacctgaacagggttggtttctggttaacaaaaccgttaattctagtgccttacctggactgtaaccgtcctgagagtgagtgttcacaatgggaagataattagccgaggtgttttgtattctgtctgatttaaaagcatgtataacccttgttgtcatttataaataccttttgagtgatgttcctttatgagctgtttgtgaacctgttggctgcag

SEQ ID NO: 576288 - DNA, 825 bp, Homo sapiens
  misc_feature (22)..(22): n is a, c, g, or t
  misc_feature (37)..(37): n is a, c, g, or t
  misc_feature (171)..(171): n is a, c, g, or t
tgaggatgacgcggcatggcangaactgcacgagggngcgtctacactaccacgagaagaagaaggacacagggctcggctatgggacccagaacatcgatgagccgatcctgttgtcaccccagatggctacctgtatgagcgtgaggccatcctgagtacattctgcancagaagaaggagattgcccggcagatgaaggcctacgagaagcagcggggcacccgcgcgaggagcagaaggagcttcagcgggcggctcgcaggacatgtgcggggcttcctggagaaggagtcggtatcgtgagccggcccctcaaccctttcacagccaaggccctctcgggcaccagcccagatgatgtccaacctgggcccagtgtgggtcctccaagtagggacaggacaaagtgctgcccagtttctggatcccgtcgctgatgcccgaagcaaggccaccaagctggagaagccgtcccgcacggtgacctgcccatgtcagggaagcccctgcgcattgttcggacctgacgccgttgcactttcacaccgtagacagctccgtggaccggcggtggggctcatcacccgcaggagcgctacgtgtgtgccggggacccgcgacagctgagcaaagcacccctgcgctgtgctgggggcctctgggctggtgtcaccctcgaatgcgtggagaagctgtcggaggccttgggggcctgtgactgaggacaccttccgacggactcatctgctggcgggggccggtcgggccggggagtgagggaaagggggtcggcgttgtgggccaacggggtggcgcaaaaag

SEQ ID NO: 576289 - DNA, 572 bp, Homo sapiens
caaaatgcaccttgttctgacaatcacatttgtagtaaaatgcaaaaaaatagtctcccagtttgcttttccctgtagttggcataaatatctagcacactagtcagaataaaactgttgaaaataacacacaaggagagagttagttcatcatgaagtgccttgatgtgccttctttcagaacttgtcactctggaaaaaagtcagacgtgaacacaattcttctggccccagtggatatctagagccgacagtggggtggtccactctcaagaggcaattagagaatgcattgtctgcagaggatttaagaacaataataaaaccagctaaaagttggtctgctttatgttgttaccatgagccagtgattctgaacaattttagtgttcacatattcctccctgaaggggtcgttggtgtcctatgtccaccctccttgttaagccattgtctggcaccccacccaagtgggggcagatgtagaataaacctctgactttaatatataagaggttgtaaaacattatgaactgattctctagggtaaggaaggtcctatggatgtcgtc

SEQ ID NO: 576290 - DNA, 197 bp, Homo sapiens
atagcgagacttacgtgggctgcccgctggggctggcaggtagggagccgacagccgcccttcgtatttgtgtcctgtctggccgtgcctgtctggctatgcgtgcgtcctcagcactgaaggacttggctggtgggtggggcactgggctctggcacctctccccacacctgtctcaaccactggtccgcctcgct

SEQ ID NO: 576291 - DNA, 379 bp, Homo sapiens
  misc_feature (364)..(364): n is a, c, g, or t
agccctaggtttctttttaaattaagaaataatacaattaaagggcaaaaaaccctgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtntgagactctgtctca

SEQ ID NO: 576292 - DNA, 773 bp, Homo sapiens
gtggtggtatttatagcttggctttgtactcctcactgtttctgcctacgccacaaatatccatgtttgcctctgagaaatctgtgtggactgaaagcgctgctggctggtgaaatgtaataaagtgtgtatgcttgctagaaaattatttcttggacaataggaacagtcattgatctgtaaatcctggctcttaacagtgagtggccaaggacttgatcagtccatttctcggtccctcagtgcttgtaaaatataagtagcactgcatttgtgatgttgaatatgactctagtgactatgtaggaggcacctctgtgaggagatgctgcttcagtgtacaaagatgctcatggcctgagtcagttgagtcttctttcaggaaaccacttcagagtgaaatatccagggtttccccggcctggacatgtccagcctgtccagggaggacacagtccctggtaagtgccacctcgtgtgggtgagatttcctcctgcgtgatgaactcatcgccatgctctgctgtctcattccatcgagttctccctccctgcttctctgctctcctctgacctcgtccgttctccgctgtccacggatttcatgagcacgttccatgccatcacttggcacccagaagatgtggatggcccctccgggaaatggtgggcgtgattggcggggggtctccagaaatcatccctgctctatgggcttgcaaggtgtgggcaggcattcctgagctgaaagggaagccatgctggcttccggg

SEQ ID NO: 576293 - DNA, 564 bp, Homo sapiens
gtacacgtatctgaaaactggagggcttcaaggctctcatcgcatgctcagtacagcggggctcaggtccgagtgctcctccgcaccaacccaacttccaattatggccacaacaaccgcaccccatgaatttctccgcaaatttcctgccggcaaggtcccagcattatgagggtgatgatggattctgtgtgtttgagagcaacgccattgcctactatgtgagcaatgaggagctgcggggaagtactccagaggacagcagaccaggtggtgcagtgggtgagacttgctgattccgatatagtgccccagacagaacctgggtgtaacccagcttgggcatcatgcaccacaacaaacaggccactgagaatgcaaaggaggaacgtgacggcgaattactggggatagcttggatgcttacttgcagacgaggacattttctggtgggacgaagagtgaccatggctgacactcacagatgtctgcaccctgattgtggatctactaacaggttctaagcctacttaaccgacaggactttccaatacaacgctgatc

SEQ ID NO: 576294 - DNA, 545 bp, Homo sapiens
ggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccatatcactctcttttagtatctcagccacagaagtggagtggttattcttgattgattgtattaagacttcttcaatagtgaaaaggcacgtatataaaataatcttatagttaactccaccatccccctatgcagggtgtcatatcaccatccacatccacatccttgttgagttactggccctcgtcctccctgactctcatctgactccccaaaccaacactaaccacgtgcatcccaggggtctctccagggaagggggatataggagatga

SEQ ID NO: 576295 - DNA, 656 bp, Homo sapiens
  misc_feature (377)..(377): n is a, c, g, or t
  misc_feature (493)..(493): n is a, c, g, or t
  misc_feature (501)..(501): n is a, c, g, or t
  misc_feature (508)..(508): n is a, c, g, or t
taggaggccaggatgacggcaaacggcagcagcaggatgaccacgcgggcggcgaacatctggttctcggtagtgtctccgtcgcctccgcaggccagcttgagcaacgccggcagctcacagatgaagtggtccagcaggcggggcgcgcacagcggccgctcagccaggagcgcggtttgcgcaaccgagttggtgaggccgcttagccaggaggcgctggccagcgtgcgacataggcgcggggagacgagccccgcatagcgcagcggccggcacactgcggccgcgcggtccagagccatcaccgccaggaggacgcattcggccgaacccagagccagcgatgcgcacagctgggccgtgcagtggctgcncgggagcagagcgcttgtccggcaggttggccacaccggcggaaccaacgctagtaatgaagcccgggtctaccaaggccaggtggagaggaagtatacattggccttttcaagcnccggtcgngcaccgncaggagcacagcggccaattgccggtaagtcaagaggtaccccagagccagggccaataggaccgcttgaggaaggccatcggagaaccccaccggagaagggttcttttggctctaattgccctagggaggcttccgatggttgggc

SEQ ID NO: 576296 - DNA, 368 bp, Homo sapiens
gagaggatccccagttggccagagtagaagcacggttgcagagactgagaagggtaatgggtgcatgagaagatgtggatggttaatgggtacaaaaaagttattaacagaaagagtgaataaggcccaatatttgatagcacaacagggtgactactgtcagtaataatttaattgtacatttaaaaataactaaaagaggccaggcatggtggctcaggcttgtaatctcagcacttggggaggccgaggcaggcagatcacttgaggtcagtagttcaagaccagcctggccaacatagtgaaaccctgtctctacaaaaatacaaaaattagccaagcgtggtggcgggcacctgtaatcccag

SEQ ID NO: 576297 - DNA, 259 bp, Homo sapiens
gggcacaagatcgaaatccctctcaaaaaaaaaagaaagaaaaagaaaaagaatggattaataagagggctgtagtcattcttcctattcaacaaattttaatgggtcaaccacggtttcaggctcttggttctgcatggggtaagttctggcccttttggtggagctaagttaagtaaggggagattaaataatcacccagatacatggtagaattacagctatatatgggtggtgaatggaaggaggaggaggaatg

SEQ ID NO: 576298 - DNA, 506 bp, Homo sapiens
tgggcttgacccaggatttaaaaactggaacggtgaaggtgacagcagtcggtgggagcgagcatcccccaaagttcacaatggtgggccgaggactttggattggcacattggttggttttttaaatagtcattccaaattatgagatgcgtttgtccacaggaagtcccttgccatcctaaaagccaccccatttctctctaaggagaatgggcccagtcctctcccaagtccacacaggggaggtgatagcattggcttccgtggtaaattcatgtaatggcaaaattttttaaatcttcgccttaatactttttaatttggtttaatttggaatgatgagccttcgggccccccctttcccccttttttggtcccccaaactttgagaatgtatgagaggctttgggtcctcccgtgggaagtgggtggaggcagccgagggcttcaccgtgttacactgcacttgagacaccagctgtgaataaagagtgcacacctttag

SEQ ID NO: 576299 - DNA, 452 bp, Homo sapiens
tataatcgggcgctacgttgttaacaggggaagagaattatcataggggagatcaagtggaaagtgggaatcaattctctaggggaactaaaacagaagatggccaaagggtggcaaggaagtgacagcaacatctgcttacaagaagacatctgaaaccttatcccagggcgggacagaaggcctcagcgtgctttttcgtctggtggggtcagtcatcaccaaaaagctggaagatgtaaaagtgcaagccattttcacattcctttggtatacgttccattcagcattcaattagcatgcctgctatgagaaactccccaacttttaaatcatttgaagaacaggtcgaaaacttaaagtctaaagtagggggaaccaagcctgctggtggtgattttggagaagtcttgaattcggctgcaaatgctagtgccaccaccacggagcct

SEQ ID NO: 576300 - DNA, 218 bp, Homo sapiens
cctgataccgaacctgaaagactggctacctcctggggcctttattctgggattatgggcacttattatcatgtctttcttcaaaacttatcgcaattaagcatatgaagttcattttttagggttgacgatgaatgaagaatgcatggaggactgcaaacttggataataatttatgtcattatatatttttaaaaatgtgctcctcttgcatgaat

SEQ ID NO: 576301 - DNA, 445 bp, Homo sapiens
cccacttaagaccccagagccacacagcgccttcatttatttccttagaagataaggtgtgaatgtatgtattattagagtccgaaagctttgtataccggactgtttcccacccacgctggtgagaagacaacatcattgcagaatgattttttttgtgcgggacaatcaagggtactaaaaaaacagtattacggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgtcttgcatggattaactcctttattctaac

SEQ ID NO: 576302 - DNA, 106 bp, Homo sapiens
cttctagctcggtaccccacaccacctgagtcacaccaccacaccacctgagtcacctgagtcaataaagtgattggcttagtgggcgaaatattatgctttgttg

SEQ ID NO: 576303 - DNA, 210 bp, Homo sapiens
gactggacgatctctagcaggatccccttgatgaggaatctgtatctagaatgtataacgaacttttaaacactcaatcacaggagcctgggttgtggtggctcatgcctgtaatctcaggcactttgtgaggctgacagtgggagtgatcacctagaagtcaggagttttgagaccagtccttggagtttcatatgcctacatgtagtg

SEQ ID NO: 576304 - DNA, 619 bp, Homo sapiens
tcccttctaacattttgttttgggaggctcttcggggatttggaaaagtatactctgggagtgttaaataaagttttttcccaaaattaaaaaaaaaaaaaaaaaaaaaaaaaaaaaaaaaaaaagaaaaaaaagaaaaaaaaaaaaaaaaaaaaaaaaaaaaagacaaaaaaaaagaaagaaaaagaaacacaaaaaaatagaaaacacggcgggggaccagacaacaaacacacacaggaagcagtgccctaatgagatccctgcgcagcgccatgacatccaagaaggaagaaacaatccacacccagcggcgcacgcgacaccaaaaacaagcacagcagaatggggaaatgaacaagatggacgcagctcgcagcagaaggacgaccacagcagccaatacaacagagaagccactaatcgaaaggaggaccaaaaaataaccatggcgcgcagaaacccaataatcaaccaaatagacaaaaagaaccccacggaagcaaaataaaaccttcaaaccatgacaagacaagtcatccaagaccaacagcccaccaagagagccacgaacccaaagcaaagaccaaccaaacaaggacagcatcacagacaaaca

SEQ ID NO: 576305 - DNA, 157 bp, Homo sapiens
ccccccccccctttttttttggggggcgggttttcaaaaaatttttttttttccccctccccccccggggggaaaaacaaaacaaaggccccttttttttatggaaagggggttttttttaaaaaaaacccaaaaaaaaccccaggcgggtttttta

SEQ ID NO: 576306 - DNA, 142 bp, Homo sapiens
agaatagatttagttatttgtattgcttgatgaataaagcctatccttgaaagctctgcatcatgggcatgtgagctcagtggtatcttggaggacagtgcactgagcctcttgcccatgaatcagagctttcaaggatagg

SEQ ID NO: 576307 - DNA, 235 bp, Homo sapiens
ctgagatggtgccactgcactccagcctgggcaacaaagcgagactctgtctcaaaaaaaaaatttgtgaaggcttctctgatttttttttcccaacagttgtcctgaatctttagcatgtccagtaatttttaaataccttttaataatggtagtaaaaccttaaaattagtgatcttaaccatatttaagtgtccaatagtgtcactattcaaccctatttttcacaacatat

SEQ ID NO: 576308 - DNA, 780 bp, Homo sapiens
gcatgctcagaaaggaaaggctttaaaaacttgaaagaactcggcaaatcggtaccccgcctgttttacccttacatcaccgtctggcatcaccagctattagaggcaccgcctttcccacgtgacatcatgtttagacggccgcggtacctctaaccgtgcatataggtcagcatgaatcacttgttccttaaatagggacctgtaaggagttgctccacgagggttcagctgtctcttacttttaatccatgtgacaatttgacctgtcccgctgaagaggcgggcatgacacagcaagacgagaagaccctatggagctttaatctatattaatgcaaactgtacctaacgaacccacaggtcttctatactacccaaacgcgtgcattgaaaatgttcggtttggggcgacctcggagcagaaccctacctccgagcagtacatgctaagacgttcaccagtcaaagcgaactactatactcaattagatccaataacgttgatcacaacgggacaagttaccgtagggataacagcgcaatcatattctagagtccatatctactataggagtgtacgacctccgatgttggatcaggacatcccgagggtgcagccgctattaaaggttcgtttgttcaacgattaaagtcctacgtgatctgagttcagaccggagtaatccaggtcggtttctcctctatcttcaaattcctccctgtacgaaaggacaagagaaataaggcgtagttgcacaaagcgattgccccctgaat

SEQ ID NO: 576309 - DNA, 178 bp, Homo sapiens
ccgccccgcaagatgatcaaaaggctctctctccgaccagcgcccaggcaatttcggccaccttggccctggcagatccacaatgaggtaattgacgaccaaggacgggccggagcctccacggctgcccgggtgtcttcgccgcgtgtgtattttctgccttttggacttgagatgc

SEQ ID NO: 576310 - DNA, 138 bp, Homo sapiens
atatatgcaatagaagagcatctgccaaccacagaattataaaacatccaaaaagtatgtttgcgacatactaagtactttggtggtggtgtatgagtgaccagaccgagaagtggtagataagattgcggtgtttgg

SEQ ID NO: 576311 - DNA, 409 bp, Homo sapiens
  misc_feature (180)..(180): n is a, c, g, or t
tggaaaggatcaaccatatacaatgtccatttcctgccctctaacctggcaggggagcaagcccagccaaggagttacagaaactgaggcttggccaggcgtggtgctcacacctgcaatctcagcactgggaggccaaggtgggcagatcgcttgagcccaggagtttgagaccagccngaggaacatggcgaaaccccatctctacaaaaaatacagaaattagccaagtgtggtggcacgtgtctgtagtttcagctactcaggaggcttaggtgggaggatcacctgagcctgggaggtagaggttgcaatgagcagagattgctctccagccagggagacagagtgagaccctgtcccaaaataaataaataaataagaataaaatttaaaaaagaaaaaaaaa

SEQ ID NO: 576312 - DNA, 269 bp, Homo sapiens
cccccaccctccaacgaggaagagaatgtgaagcttggcccattgtgaagcacaaggagcagatctgagtgggcaggggccatttccccattccgttgccttggcttgagcatccattgattgttccaaggggcatttcccaagagggcccttacacggtccacctttttaaggtaagggctccttatctaccctcaccccacgggaaagcccttccaggattaccactagggccttgcccaaataggacctcagggcatagcccttaa

SEQ ID NO: 576313 - DNA, 359 bp, Homo sapiens
tccgggtgtttaataaccttcataagtttcccacggctcagactctgggcaaggggtctggggcttccctggactgatggggaggcggatgctacggcccacaacgctcgagcatgaccctgcgacaggtgaccggctttacggtccgcgaccgtagcgccatccagtacgtcacagcgtcatgatgtaccatagactcggcgtaaccaggcctgtcccacgaggaacagactcacacatctgaccagccgttcattgaagctcctagtccgtgcggctgactatggtataacgagctgtcccaccagacagatgtctacagaacgtgcctaatgctccgctctgattgcgtcgctctc

SEQ ID NO: 576314 - DNA, 1197 bp, Homo sapiens
ccgacctctgtttgtgagcgcctccataggtggtgtgcaccactagagtaggcggagggactgtctgtgggtcgttatataatttcttcttcggggcccccacccaccgggtgtttgctgccgcgccccccttttgatgggtgcgccgacgaaagtgggtgagtttgatatgtcccccggatccgtctccacaccagcgggcgtccgccctcttttctgatgaggaggtgagccctcgtgtcaacacggggggttgttctcaaccgcccagtggtagacggttgcagagagccacaaaatacgttgtttatccaagaggggaagggtgtctaaagaggccccccccttgtcacacccccttggggcaaagaaaggaagtcctcttgggggggcccacagtgccgcgggtctaagtgtgttctcctccttgggaggggcgcaccaacgaaaccactttttgtgtgagccgcccccctttcttgtgggccccccccgcgttggcgcctggtgaggcacatattttgggtcgaggacaccgcaaacgacacttggcccctctgtgggggggttttcccaagagctgggcccacccctgtgtcctggccccgcgacccgcggagagggctctctgtgggggtataccccccagccacgggggtgtagggcccccataccccctctgcgagcccccagagtgtgtcccccaaccacggaaccccccgacgccccccctcggggatgtttccctcttctcccctcccgactatccctctggacgcgttttctggcccgctctttccccacagctgggctcttgtgatatctcttgtgatatcccctctctttggggccgtgaagcccagacccgagttctcccccacaggcgcacccccacattttgtgggggacaccctgtgatatttttttagacacaacaatctccccattctccccacacatggtccctctcccccttctcccatagctgcccaacattcttaacaccgccatatgtcgactcttgtgcttgtcttgtttatgttcttgtgtaataaaatggaaattttttggagatgaccccctcccctgtgcccggctggttccttcttccccttttccccctggtcaccggcgtacttcaatggaaccaggacccactaagggaccttcgattaaccacaaaaaagaccaataata

SEQ ID NO: 576315 - DNA, 346 bp, Homo sapiens
  misc_feature (71)..(72): n is a, c, g, or t
  misc_feature (90)..(90): n is a, c, g, or t
  misc_feature (147)..(147): n is a, c, g, or t
  misc_feature (189)..(189): n is a, c, g, or t
  misc_feature (244)..(244): n is a, c, g, or t
  misc_feature (254)..(254): n is a, c, g, or t
  misc_feature (270)..(270): n is a, c, g, or t
ccgtctgggaggaaaaagttggatcaagccagagggaaagaggaacttttgccgccgttgactccccatgnnggatctttgagagacaantttgttgacttggccatcagcaacggacttcactgtggaggatgtggagaccgttcnacttcgtttccgtccatcactcgtctacaccaaaaaacattnggatctgactttcgatcttctcgacaagactttgaagggattgtaatcatttttncttttgtttnctctttaaagctgtanccattttatcttcttcgctgaccatctagcttgttattatttcaaaatataattaataaattaaatattcatttat

SEQ ID NO: 576316 - DNA, 232 bp, Homo sapiens
tcttggattgcttggttaaaaacaccatcaacatcaacaaccattctcctaaccagtcctacaaaaccagatcacataaacaaaatgctgggccggacatggtggcatcacgcctgtaatcccagcactttaggaggtcgaggcaggaggaatgcttgacgcccaggacgtttgacgaccccggcctgggacagcactacgtgagaccccactcatctcacaacacaaaacc

SEQ ID NO: 576317 - DNA, 125 bp, Homo sapiens
cgcgtgtggaagagctgatcggtgcgccgatcgacattattcaacgggcccggaccgcaacgagaccatcgttctgcgtcacccgttcgcgtaataagctgttgatgtgaaaagcaaagggctcc

SEQ ID NO: 576318 - DNA, 861 bp, Homo sapiens
gacagccgagggcactatggcttctggagttacagtgaatgatagaagtcatcaaagtttttaatgatgatgaaagtaaggaaatcttctacacaagaggtagaatcaaaaagagaaagaaagcagttctcttctgtttaagcgatgactgaaagaataaataattgtagaggaagcaaagcagatcttggtgggtgactattggtgatactgtagaggatcgcctacacatctttgtgaagttgctacctctgaatgattgccgatatgctttgtacgatgccaagtagaaaaaaggagtctaagaagagaagacctagtattatagtattctgggcatccgttgaaagtgcacctttagaaaagcaggatgagtttatgctagctctaaagatgccattgaaagaagaacattgtacaggtattaaacatgagtggcaagtaaatggttggatgatattaaggaccggtcgaacttggagagaaatgggaggcaagtagtagttcacttggaggaaaacattataaaatgacagtcaagtgccatctggatcttagcgagcttccatttctccagctcagtgcatcgaatagtattaggtggggcaagggtcgtatttccccctttcactgggccttccaactcatgaatgaggactcgtatttactttaagaggctataagtgattgccttaaactggggaaaactgggtctttttttagaaccaggaagccgtcggggcatttagcacacacggttttgctcctggggagcccaacggtgtggccgcgtggaccagaaaggcaggggcacaagagcggaaaaccggggaaggacacaaatataggaaacgaggagaa

SEQ ID NO: 576319 - DNA, 364 bp, Homo sapiens
  misc_feature (110)..(110): n is a, c, g, or t
  misc_feature (310)..(310): n is a, c, g, or t
tgggcatggctgctcacgcctgtagtcccaacactttgggaggctggggcaggaggatggcttgaggcaggagttcatgaccagcctggacaacatagcaagaccctgtnactaaaaaaaaagaagcagcagctgtgtgtggtgctatgtgcctgtagtcccagctacttgggagcctgaggtgggaggattgcttgagtttgaggctgcagtgacctgtgattgtaccactgcactctattcagcctggttgacggaggaagactctgtctgcaacaacaaacaaacaaacaacaagtgatattgggantaacttagttcgtgcatatgtttttttttaaaaaagagagaacctttgacccac

SEQ ID NO: 576320 - DNA, 138 bp, Homo sapiens
ttagcttggcagttgcttttgatttgattgttttaatgacaatgggtatactaccctatattactcaggttgaaactatttcatttctacacaactattttaaaaattgcctactaggtgaaacataacaataaaact

SEQ ID NO: 576321 - DNA, 273 bp, Homo sapiens
cgtcgacgaaaaaggccagcagacgggctgcctacgactagtatctcttctttgggaaaggatgattaggatatatcactcaatgagttaggaaggggtgtgggcagcgaggtgctgtggaagtttcaggtagtttcggtcccaggcagcactttctacctaaaggggaagaaatgctggtcttactgcaggacagcctcttcacagggtcctcagacttcacgtactccattgctttctccttgtgtgcccttctgcctctttctagtcgac

SEQ ID NO: 576322 - DNA, 1028 bp, Homo sapiens
cagtgccttttgttcccgcgtgatctctccctgttctctctctttcgcagatcggccttctctcgtctcggtgactcctcggggtttctcgaattctggggccaacatgggctccagcaggtcgtgcatgccgcttgtcccttcggggagccttttgtcctatgggccagacctccctgttggccagcgccatccgggggacctggtaccacccactttctggagactgctcctcatttccggggaatttggcctttggttctcccagggggcctcctgagattcaggacagttcgtgcccattaagggccaagtgctcccgtctggtcccttgccccatgtgaagtcactgtgccagcccaggacactggtctcggcccgagaagacctcctttttccaggctttaggtatcacccctaaatctccaggggcacccttgaaatcctgagtgatgtgcagctgatcaagactggagaccaagtgggaccccgcgaagccacgctgctgaacatgcgtcaacatttcccccttgtcctttgggctggtcatccagcacggtgttcgaccatggcagcatttacacaccctgaagtgcttgatatcaccacgaggaaactctgcactttctcgcttcctggaggggtgtccgcacatgttgcccgtgtctgttctgcacgatttggctatccccacctgttgcactcacgtatccccacttctatcactccaccgggtacccaacgagtcctggccttgtctgtggagacggattacaccttcccccttgctgaaaaggtcaaggcctttcttggctgatccatctgcctttgtggctgctgcccctgtggctgctgccaccacagctgctcctgctgctgctgcagccccagctaaggttgaagcccaggaagattcggaggagtcggacgaggatatgggatttggtctctttgactaatcacccaaaagccacccacttagccagttttatttgccaaacacaggaaatataaggcttacttcttta

SEQ ID NO: 576323 - DNA, 367 bp, Homo sapiens
  misc_feature (347)..(347): n is a, c, g, or t
  misc_feature (356)..(356): n is a, c, g, or t
gagggaagggagcggatgctgagagagctcaggaagtgccataggaccactcaccacaccctgttgtcttgaatccctagtgcccacacgcataccactctccagccccagggtccatgcctggacaaggtccaggtcctactcttggagtcctgtgagggcctgtctcccttactgataataatcccccagactcaagggaatccaagggacctgctgatctggcaaccggactcaacctcccaccaccccaacaggtaaagaaaccaaggcacagagaggttaggttcccttctgagggccacacaggaataagttgtacagccaggataaatacccacatactntctcctgangcctggctctt

SEQ ID NO: 576324 - DNA, 166 bp, Homo sapiens
ccgaacatgacatataggcaggatattagtataccaaagcagtaagaatacatatatatatatatatttttttctactctctacactctgtcacccaggttggagtgcaatggcacgatctcagctcactgtagcctctgcctcctggattcaagtgattctcctg

SEQ ID NO: 576325 - DNA, 264 bp, Homo sapiens
aactgggccccttttttttgaaaaaaccaactgaaaaaaaaatgcttccttaaggggtggcagcctttttaacccaaaccttttaaattgggcagaacaaaaaaataaaatcaaaggctggttttggccagatattagggtttcccgccttcatgtgggaatcaaaagcaaaaacaaaataatgtttaaccattttgggcccaaaccttttttggaatgaaactgaaacttaatgaataaaaaaattccttggtccttttttta

SEQ ID NO: 576326 - DNA, 230 bp, Homo sapiens
gtattactttcgagaagtgacgtttctgctctgtcacccaggctggagtgtgtggacaatctcggctcactgcaacctccgcctcccaggttcaagcgattctcctgccccagcctcccgaaaagctggggctacaggacacgcaccaacactgcccggactaacttattttttggtacttttcaggtacgagactgggttttcacccatgactggacaaggctggatct

SEQ ID NO: 576327 - DNA, 373 bp, Homo sapiens
ccgttatcattgaggaggtggaaggatcacttgagccccagaagatgaggttgcaggctgggcatggtggctcacgcctgtaatctcagcactttgggaggccaaggtgggcggatcacctgaggtcaggagttcgagaccagcttgggcaacatagcgagaccttacctccacaaaaaattaaaaaaattacccaggcatggtggtgcttgcctgtagtcccagctactcaggaggctgagttgggaggatcgcttgaacccaggagtccaaggctgcagtaaactatgatcacaccactgcactccagcctgggggacagtatgagacccggtctcaagaaaagaaaagaaagaaagaaattcaccattac

SEQ ID NO: 576328 - DNA, 141 bp, Homo sapiens
tcgagagatggcacgaccctgtatttccctctgcctttacaggcccacgcaccccttcaatgcccaggctggcaggttctggcactgtggatctgcatagtgcatgccactgtcaccggaggtctgagtcggtggcctgag

SEQ ID NO: 576329 - DNA, 376 bp, Homo sapiens
gcgcctcccacttggcttgcgtggctagctgctacaacgattgctttgtatgccacccctactggctggcaactttttcggcaatttgctgcgacgcgagcgcaactgtccctttgtggggacggcgagcttcgcggaccggttctgaccacctccgtgataaagatggactgtgggctgtccttgcctggatctccatcctagccatccgcaagcaaagtgtggagagatcattctcaaagatcattggcaaaagcatggccgggaattacttcaccaggtataattacgaggaggtggaagctgagggcgcaaacaaaatgatgaaggacttggaggtcctgatgatggatcgctcctttgtggtgaagcagtt

SEQ ID NO: 576330 - DNA, 2436 bp, Homo sapiens
tttaagttctcttgcacacccagttcccaggcatggctctccaatctcagctccctcctttctctccggattttaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaaagccaagtctgtcattgggctaaagtgccattcctactaatcctttgcctcacctgattcatttggaataaagggccaggagcttgagtcacccccatgccaggacctctgttgctatttgctggctgctggagaggtggggtcttgcgggccctggagaggtggggtcttgtggggcagagctggagcagatgctgcatccagcagtaagcatgagaatgagcactcacagttttgggtcctgtgctggacactgtgcaagtcctgtgcatatatcacctgttgcatttcccacagtgacccaatgaagtagatactgttatctttaccattttatagatgagcaacctgaggcttcaccagaattgcacagtgagaatgtggcgtggcctggattctcacgtcgggagtcggattgcaaagccttactgggcctcgccgcgccccatggctgtcagcgcattccatgctgacctggccgtgtatgcgtgcgtgtgcacgcatgtgtgtgcgtacgtgcacgtgtgtacatgtgtgtgtgcttgtgtgcacaccacatgtgccgtgtccataggtctgtcatcatatcaggtaggactaggtcggctcatagcttggaagggctttggagacagccactctcctaacagatgggagaagttgttttgattcttactaaggtcccagaatcctattgatggctttgctgagtattgaaaggctggccttaaattaggtttgaaactgaatttggtaataggacaggatgtgttaaggaagggaaacatacagggagctgcctgctctggcagctgttgaaagtgagcaggccacggtgcctgcagtgggagtggggcagcaggcgtgtcaccttgggccagagcacatgtcttgtacacggttgcaccaatgcgtgaggatgtaggtccccaagagccaagagaaggggagctttgttgaatacgtgatattggagaaagctttggcccaaaagaacaaatttagattcgttctctctgcaatacaaatgtattccagtgggtcaaaatgttaattattattaatttctttttttgtttcttgagtcagggtctcgctctgtctcccaggctggagtgcagtggcgccatctaggcttactgcagccttgacctcccgggttcgggtgattctcttgcctcaccctcccgagtagctgggattacaggcacacacctccgtgcccagctaatttttgtacttttagtggagatgggatttcactctgttggccaggatggtcttgatctcctgacctcgtgatccgcccacctcggcctcccaaagtgttgggattacaagcataagccaccatgcccagcagagaattcaaaattcttaacaggatacttataaataaactgtgtaagaaagaagtataaatagtctaaaccagaagaaaaacatttaacttttttttttttcttctgagatggagtttcactcctgttgcccaggctggagtgcagtgacatgatctcagctcactgcaacctccacctccctggttcaagcgattctcctgcctcagcctcccaagtagctgggattacaggcgcccgccaccacacccggctaatttttgtatgtttagaagagatggggtttcaccacattggccaggctggtcttgaacccctgaccttcaggtgattcgcctgccttggcctcccaaagtgctgggattacaggcatgagccatcgtgcccggcaacatttaaacttgactttccatttaataccggtttttttaggtggggcatgatggctctgcaatcccagcactttgggaggctgagaggggtggatcacttgaagccaggagtttgagagcagcctggccaacgtagcgaaaccttatctctactaaaaatataaaaatgagccaggtgtggtggcatatgcctgtgatccccatgacttgggaggctgaggcacaggaattgcttgaacccaggaggcggaggttgcaatgagccgagagcgcgccattgcactccagtctgggtgacaggagtgagaccctcaaaaagaaacccgtttttgtgatgtgttgtcattcttcctgagaattc

SEQ ID NO: 576331 - DNA, 195 bp, Homo sapiens
acgacaggtccagcgccctcaggtctggcaaccactgctacactcagcctcatgagccacttcagaccagccaggatgtcttcccgggccctgccagaccctggtcacattccctctgctggtctgtgctgctctcagaaggccacacgcgcccgcattccactcagccaggatgcagctgcgtttcacttccga

SEQ ID NO: 576332 - DNA, 312 bp, Homo sapiens
acgaccatctccaacctgtatctccttttctccctggagttagtgatacttccatctgcctattcattgacagtaataatttattatcacctttgactgtttttctttctcatttctcacatacaatcatcaaccaagagctgcagattctgtaaactgtttcttcatgttagttgttgagtcaaatatctctcccactaaattatgagttgatacattacgaggagcccatctattatatctttgtttactatgcacagtgcctgacacacagaaggtgttatttttgctattggtgggtcagaagataag

SEQ ID NO: 576333 - DNA, 1506 bp, Homo sapiens
tttttttttttggccccagttcaatgaaggggaccattttatgtaaggctctccagagggcccagggggcctgtgggcgaggaaggctgtgccctttaaaggaaaaaaacaaccttttattgtgacacctttctttcttgtgggacacccgaggttgtgtggggtgtgtacaccacaacttctctctctcttgtgccggccagaggtgtcgacaccagacacccacagagagggtgtagaagaggcagacaccttataaaacacatgtgtgccgcggcaagatatcatatctgtgtgtctccgccagagtgtagcgctatatatctctgtggggacacaaccttgtgtcgggagatagaagacagagcgctctcaagattagtgtggcccacactctcttcgacagaggtcccgcacacacacaacacagagtgtgtgcagagcgtgtgtggacactctctcttctctgtgggaacagtgtgtgtgtcatagtctctgtgagagacaagaatgtgtgcgcgggccactatctctctctccaccacgcgctgttgtgtgtgatgacaccggcaacacactatattatctacaacaacgcgcgctgtgagctgatgagtctaccgaggtgtgcgtaataatattcaccccctctactctgtgatcatcctctagtactgcaacatcttatgtcgtgcgtcctcatgtgaaggacactattctcctctcttccacagagtggagttgtcgtcttcacccttgtgtcgcgctcctttcaagacactcctcttcacagcgcgctgtgctagactgtagggtactaatgtgtcgccaccagagttgtagagaggggcgtcttcttttcatcacaccaaccacgaaggatcaattctcctgctgggacacgcatagttggtcttgctggacggccgctcggttctataccgaagctacttccttcgcgatggcgctgcccggccccccctgtcttgccggcccctgtgttgatcacgcagaccacaccacacgtaaggacgggcggtggtcgctcggtaggcctcccgcctggggctctctctactcaattgaacgcacgcaacggatctcaattctatcagcttttccgcccccggcctctactcgtcctgagtatgaatagggtcagggggggagcgcccaccccccccacgaaaataagcaggtgcctcctatttaaatcgaccgcccggcagcccgtgtcatattacacccccccgacaagaaaggactgctcgattacataaccatgcacgcttggtgacgtcatatacccccaacaacctccacgcgtagtcagcggtatgggtgagagcgatatctcatctacctccctcaccacctcgcagatttcaaatagcatcaagagtcggtggtcgatgattaagagcgagcaaatagtgttagatatcaccaggaggaacactatatagctctgcttatctatctattattagcactatgatcagagcg

SEQ ID NO: 576334 - DNA, 144 bp, Homo sapiens
ggtgcaagaacggaggctgatattggagctttccgtcaatggtccgcaaccgccttcgcattttgagcgccgtggctttgccgctcgctctgctggcatgcgcaaagcgcgatgacgatcgcaatctcgattcgctggataacg

SEQ ID NO: 576335 - DNA, 447 bp, Homo sapiens
  misc_feature (280)..(280): n is a, c, g, or t
ctcgaggccaagatcgagcgtggtgcggatcaggtaaccgccacgggccagctgttccttactgatccccgcgcgcgacaggtactcctgcacataatcgcagaaaaaggcgcgatcgccggcggcgatgcagcccctgggcagttcgttgggctgcggcagaattcccagcggctgggtcttggccgcgcgcagcgcgtcggcctcgccggggatgttctcgatcatcgtgtcgagcaccaggttgcgccgggccagggcgccctcggggttggtgtangggttgagcgcgctggtcgactgcaccatgccggccagcagagccgcctgctgccagttcaggtcgattgcgttgaccccgaagtaggtccgggcagcgtcctggatgccgaacgagttgtttccgaacgagaccaggttcaggtagcgggtgaggatctccggttt

SEQ ID NO: 576336 - DNA, 397 bp, Homo sapiens
atgtccggccaggaagcacacagtgtcggcctgcacacgtccctgttgcaccaggggcaacaggcgctcacgtatgtcactgagtccgcgctcggagccctaacgggccccgtcctggtacaaggacaggagctactgcagatcataggcatcgcgaagaagcagcatagtcagcttgcacaggtcagagtcgaagagcacctacagctccagagtgctatgtccaagcatggcttgcacctcgcacaggtactgctccaggagactgcacacgtcctccatgtccgcgcccatcagggcttgctacacctgcagcaccttgtacaaccgtgctcgcgtatcctactccaacagggtcagttgttcctccagttacgatttgtaggccctctactcc

SEQ ID NO: 576337 - DNA, 310 bp, Homo sapiens
gtataacagattcatcatactggaaaatgagattttacagataaaagttttagtactgtaagttaaatactcaaaactggtggtattcttcatactcacctgacctttatcttcaatcactactcgacatagagctttggcttgtcttccttcagaagactggtggccgttttctcttaatgtgttatgttcattcatattcacatgtcttcttggcttgctgtttacagaattttactcactttaaaaaatgctgacagcctttgccgtatttgcttaccctcttgtgcactgctgcttacttattaca

SEQ ID NO: 576338 - DNA, 250 bp, Homo sapiens
  misc_feature (215)..(215): n is a, c, g, or t
  misc_feature (221)..(222): n is a, c, g, or t
  misc_feature (224)..(224): n is a, c, g, or t
  misc_feature (228)..(231): n is a, c, g, or t
  misc_feature (235)..(236): n is a, c, g, or t
actcatgagggcagcgcctcttaaaggccccacctctgaatactgcaacattggtgtttaaatttcgatgcgagttttgtagtggacagacattcaaaccattgcattgtattagcttcagaacttctcaagtgcacacagagatgatatgattttagcttctgtcactgccactgtggaatgttttagtgcttttcctctctacccagttctcngcaggnncnaccnnnnaccnngccccctgctctca

SEQ ID NO: 576339 - DNA, 345 bp, Homo sapiens
  misc_feature (7)..(7): n is a, c, g, or t
  misc_feature (11)..(11): n is a, c, g, or t
  misc_feature (30)..(30): n is a, c, g, or t
  misc_feature (35)..(35): n is a, c, g, or t
  misc_feature (98)..(98): n is a, c, g, or t
  misc_feature (127)..(127): n is a, c, g, or t
  misc_feature (145)..(145): n is a, c, g, or t
  misc_feature (187)..(187): n is a, c, g, or t
  misc_feature (212)..(212): n is a, c, g, or t
  misc_feature (253)..(255): n is a, c, g, or t
  misc_feature (257)..(257): n is a, c, g, or t
  misc_feature (260)..(260): n is a, c, g, or t
  misc_feature (297)..(299): n is a, c, g, or t
  misc_feature (320)..(320): n is a, c, g, or t
cctcaanaggncattatccgctccctgaantgtcnatgtgagtgagccctgctgatctgggagtacacaaggcagcaggctgttctcgcacggagatncaaagccatgatgtgcctcccttagtganctgctgctgctgttcagncttttttaaaaaaacctatttggactaaagaaacagattctnaaatttattgtgataatttgtattncttttttcttgcaatttaatgccaaaagtttgccatgtgcnnnanacntattactatatattttcccctttaataaacacttttnnnaattgtattcttcctttaatnaaatattttaagcaattgtggaaat

SEQ ID NO: 576340 - DNA, 653 bp, Homo sapiens
atttgttcaagtgtaatgggaggctctggagacctaggccagccccctgagctgcagcctcatggacacgccattcagaagcacgtgtcagtgctctggtcagcttctgtcatgagacacaactttccatgtgaactaagaggataatgacaattgagtgtgacctggaggtcaggcctgcacagctgatttgggaaagatgagtctgggccagatgaaggtaaatgaaactgacgaagggacaaggaaaaccccaaaacagaacgtgaaggatggcaactgctggaaggcggtcaaagcctgtgtgtgaagtaggagaaatctggatgggcttagtccttcttcccttcagaccgcagggtaactaattggcaatttcttttaacactcagcagctacataaatgttttatgtattcacaacaaagtctgtggcaaattgaaactttgatgattatgaaacaccaaagaaagccttattagacaagatgggtttcgtctttcttaaaaaaaaaaaaaaaatgcttttgaatggaactgttgctcatcataacattcaactaaaagtgtgttcctacgtcttgatccttggggctgtaatagtgaagtttaccattagcacgggctggggtagccgccttgaacagttccaca

SEQ ID NO: 576341 - DNA, 1013 bp, Homo sapiens
ggcttgtctttcgcggaatcaccatggcggctgggacccagtacacgtatcctgaaaactggagtgtgccttcaaggctctcatcgctgctcagtacagctggcggctcacggtccgcgtgcgtctccgcaccaccccacttccatatttggccaaaccaacccgaacccctgaatttctccgcaaatttcctgccggcaaggtcccagcatgttgagcggtgatgatggattctgtgctgctttgaccagcaacgccattgcctactatgtgcagcaactgaggagctgcggggaagtactccacgaggcagcagcccaggtggtgcagtgggtgagctctagctgattcctgatctagtgcccccagccagtacctagggtgtacccaccttgggcatcatgcaccacaacaaacaggccactgagacagtgccacaggacggaacgtgacggcgaacttcctgccgcatgactgcgatgctctacctcgacccgcacgacggcaccttccttggtgccgccgaccgagttgacactcgcgtgaaatcacacgatgatccgcaaccccggtcggggctccctataagccaggatacaaagaagccatcacaacagcaggggcaatacccaagaacacacgcacggtccatccaacagcaataaaccaagaccacagaaccaggcctaggccaggcccaaggcaaacgaggtgcgaccacgccgccagcctggacgccaacacacgctggagagaacccaaactaaacaaggacgaccccggacaacaaaggctacggcgccgagaacccaatgcccagcgttgggcggaagcgtcaaaaacgagcggctgcccagggtcaccaccaagcaaacggagtacttgacacagccggtttacagcacacaggccaaggcacaaacgaatcaacccccacaactagcgcggcagcaacccaacacacagacaaattaacacacacacggaaaccaacccagccatgaagacaggat

SEQ ID NO: 576342 - DNA, 1909 bp, Homo sapiens
taccacacactgcttctgaattcttggcacacacaaagctgacctgctagcgatcacgcgctgatagaccccggcaactgctacacgctgtctctggctgcaccacacgcactgacctatcctacaaacgcgcctgcaccactacacatagcgaacccataactgcgcggccagcacgcacgctactacgccacctagaccccacgcatgcctagacactgaaacacaaacctcacccccactctgcgcgcacgcgcctctgcacgcgctaaccacgcgcgcgcacagctgcgcctacctgcctgctctctctctctccacgcctgcgcacacgcccacgccatcaatgcacgcctgcgcgctgcaccacgcgcactgcctctacgcactaaacagcgccatcctaccctctacgcgcgctgctccacctctgactccacctctctgcaccgaacgcacgtgcacccaccaccctcccctctagcccacgccctctgcgcctaacacgcgcgcgcctgccttcggccacgccgccccacccttgcgccacgcgcaacccacctcactacccacaaaccctagatctcacccccatctgcgcgccccttgcactcttccatgccacctactcactccctcgtccgccactgccgccccacgccttcatacctctgacctactccctaccgtctcgctctccttaacatcgacggagaaacaacggtactcaactagcataaactacttacgccaccgcagccggcaccctcggcgcagacacctcacacgccctccgtcccatcaccaaactaacactccgccctctctgcccccctcggatcgcggcacagcaccactactctgagcacaacacacccaccgcctcctctcccgtcccatccctctcccccccaccatactcctcaaactactcacacacaaccactacccaaccatcgtaccactccctacatcatccttccacccttcccctctccaccctatccccttactgccaacccacgccgcacaacctcacgcaacaaccacttcgccgcacccaccctcatcccccctccccttcccccctcactacaccgcatcattcctacttcgcacccaacactcgacaccctaacaactctatcaacccaccaacacacacacacatctagaccacccaactcctcctttctacccgtcttagtctctcccaacccacatctacatcctcttcccctcgccaccccccctccccatctcctctacccactccagcgccctcctgcgcctctcccccatccccccctcttctatccctctctacgaccacacctctacccgcctatcctcgccatatctcaaacataccctaaaccccctctatatgacacactacacaatcatgcacttctctttcacctgtaccaccctacattggcacccatcatctctcacccagccacaccccaccctcagcgcactaacactgccccttgatccacccacacacagacctgcccgccccccgcacaccaccactctacacccacgcacccagacctcgcacatctatcgcccgccgcactctccccaccagcctgccccccactatcccatcctactccgctctctaacacccaacagacacacacccacaacctacacactgctacactaccttaacatcatccaccacagaccatttcaaatcccacaactatcccactatacaattaccacactcacacacccccacatcactcacaccccctcacccacttcatcccacaacatctatcttatccttatacccactccacaccctccctcaccgccctctcccgccccttctcccccctccctcctccccctcgctcccctccccaccttactcaccccccccatc

SEQ ID NO: 576343 - DNA, 208 bp, Homo sapiens
tactgctggtcgctctagagcgatccccttacatccccacgatcactgagataaatgcatatctagattgcttccttaggagaggctaatcagaaactcaaaaggagcgtaaccatttgtctctatatctacctatgacctgtgaagcccctctcccctaattttgctatcaaggttgtcccgtcctttccagcaccgatgccaatgc

SEQ ID NO: 576344 - DNA, 365 bp, Homo sapiens
  misc_feature (23)..(23): n is a, c, g, or t
  misc_feature (26)..(26): n is a, c, g, or t
  misc_feature (91)..(91): n is a, c, g, or t
  misc_feature (122)..(122): n is a, c, g, or t
  misc_feature (216)..(216): n is a, c, g, or t
  misc_feature (218)..(218): n is a, c, g, or t
  misc_feature (239)..(239): n is a, c, g, or t
  misc_feature (356)..(356): n is a, c, g, or t
  misc_feature (362)..(362): n is a, c, g, or t
cgccgcgaggacggccggccgcncantgcacctgatgaagaagcgggagaagcagcgcgacagatggagcagatgaagcagcgcatcgcgnaggagaacatcatgaaatccaacattgacangaagttctctgcgcactacgagcggtggaggcagagctcaagtccagcaccgtgggtctcgtgaccgtgaatgacatgaaggccaagcaggagncnctggtgaaggagcgggagaancagctggccaagaaggagcagttcaaggagctgcagatgaagctggagaagcttcgagagaaggagcgtaagaaggaagccaagcggaagatctccagcctgtccttcaccctggangaggangaa

SEQ ID NO: 576345 - DNA, 400 bp, Homo sapiens
  misc_feature (103)..(103): n is a, c, g, or t
tagtgttatagcagtgctgttgcgcgtggggaggaactgtgaaccctgctgcactgctgctaggaatgtgggatggggccgggcgcgttggtcactgcctgtnatcccagcactttgagaggccgaggtgtgtggatcacgaggtcaggagttcaagaccagcttgtgcaacatggtgaacacccatctctactaagaatatcaaaattagctggacctggtggtgggcacctattatcccagctacttgggaggctgaggccgagcattgcttgaacccgggaggcttatgcggggcagtgagctgagatcgcaccacttgtactccagcctggggcgacagagcgagactcttgtctcaaaacaaacaaaaaaagccccgaaactttacattgtagac

SEQ ID NO: 576346 - DNA, 244 bp, Homo sapiens
agcatgtagagagactatagacatttcgcatcgcattgataggcctgagaatgcagccacgaattagtaaagcgtgaaagcccgacagccatcaccttacagattccagatcatattacttcacactctctcagacccgattggaccattctatcaccctatctaaggtccaggtctgccggaaggtccaggtctgccacaaggtcctggtatgccatactggtccaggtttgccagacggggc

SEQ ID NO: 576347 - DNA, 401 bp, Homo sapiens
  misc_feature (258)..(258): n is a, c, g, or t
gtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgngatgaataactcctcctcctcaggcccagtcccaaggtacaaacttgcaccagcaggcaagataggcagaggcagggaagagagctgggtgggaagacacgttaccccctggaaggttcaaggaggggaggtcgcctgggtta

SEQ ID NO: 576348 - DNA, 1056 bp, Homo sapiens
ccccgcgtcctgttgcgcgtggtgacgggcacctggttggtccctggtatactctggtagcgctgacgtaaagctggagctgcttgagtagcttgcatcctgctactgcgacgttgtgatgagcagcggatcatgccactgtctacgatgctaggtgatctagactctgtttcagaagacaaatgaataagtaaatacaacatatacataacactagttggtctccaattgtaatcagaggcaatgggcgccccgatcattgcaccttattttgacctaatattagttgcttgtgtgccaccgctccacatcctcgggtgatgggctcccgtagtccatgcacattatacaacgtcacgttgatcgtctgtgatcactgcccacgttctccatcgcgtacgttccgtagctgcgacattgttgctgagtacgtggtatgggcaggaaatagggaggtagggaattggagtcaagtgctcatcacgtcatctttcatcagagaaaagttacattcctccatctgctgagatgtcctttctcgttggcaacgctagaggatcatgctctctactctattaccccctttacttctggttgtcctacatctccattttaaactggtgggtccctctaattgacatgtacttagtttattctccttttgggggcaagcatcgctgatccatcaactcacgactaactttaacgctcgttctcccctgttcagatgctggcctaaactgtgagtgtgccttacttcattccttattacgtacgtacaccacttgtttctcttagacctagttatcggcaattcagctgggtctcggacttacgggtggatgcaaaaccttgttaatccccagttcctttctgggccaggccgaagggtggggtgaagctccattgtaatgtccaggcagcttaatgaacgagcctggggcacacctgggtggaagaccctgttctttatccgaacatggctatgtttttaatcgtccatagtggggacttcacctgttctgcccgacttggcgatgtcgaaggaggaacacc

SEQ ID NO: 576349 - DNA, 296 bp, Homo sapiens
tttttttttgataagtctcagatttatgttcgcgactccagaatagtaactgtagaaagaattgtcatatcacctgctagcctgagaatctcatctgatgtcaacggtaagatagcacaggcgcagtaggggcgatctgcttacctgcagcagatgaatcgtctcgaagggtatccctgaacttactctccgttgagcacgcttaatctggttcaagcagtccagggtcacactttccagcgcccttagagagctgcgctaactttcccaagcttgattcccgggcgagcactccc

SEQ ID NO: 576350 - DNA, 117 bp, Homo sapiens
gtggtacatatgtaggtacctacttagtacgttgtgttgtgttgttaggatgggtttgaagtcatccaattgcttacagaggtgttggttagctagaatacatgttctatctcacct

SEQ ID NO: 576351 - DNA, 158 bp, Homo sapiens
  misc_feature (90)..(90): n is a, c, g, or t
  misc_feature (109)..(109): n is a, c, g, or t
tgcgagacgatagtgacctgactaaatcgcgaccatggtgaacggtagacagtgagggtggtgacaccggatgaggcgtgtcagcgggcngacagttacgcaccagccncgtggttaagtaaccatagccgggacctgaatcctagagccaaagcgag

SEQ ID NO: 576352 - DNA, 187 bp, Homo sapiens
catcagccccgagtagctggaacgaggtgccgcacagccggtaattaggtagtagagatggggttcagtggtagccaggatggtcttgatctccggacctcgtgatccacctgcctcgacctcccaaagtgctgggattacaggtgtgaggcaccgtgcctgtccactaattcatattttaaaagag

SEQ ID NO: 576353 - DNA, 592 bp, Homo sapiens
atcatagcctgcacagctaaaatatttataaaccggccctttacagaaagatgtgtgcagatccttcttttacagcccgtgctgtagatattctggcagtacaactcgctagtctatgataatgttcattcattcccatcataaatgtaatcattctaaataggtgtcttctgatgtcatcgctgttacctgattttaaactttttcttcatcttcaacattatcaaagttcatccttatacctcttgccttgatttcggagagtttccaatttatcacttattaaggcagcgattgcttttgcatctctggtatttatctgctcttcttgaaaatttctctttgctctttcgtagaaataaaacttaacagttggataggccctgatcccagctttctggcatgtctgagcataagcctgacagtctacttttccagctttcacttttcctttaatcatcctagccaagagctcaaattctggagcaaaattctggcaaggtccacaccaaggagcatagaaatcaatcacccaatgatttttcccttgtagaactttttcactgaaagtctgaggtgtcagatctgtgga

SEQ ID NO: 576354 - DNA, 275 bp, Homo sapiens
aggttgcacgcatgagccatcatgctcagcctctgttcatctttctacattgaggttttgtttttgtttcttcatattgtaaaatctctgatgacttatcttcaagtttactgatccaaatcaaatccactgttgaggccatctcatgaatttttcattttagttattgtgcttcttcacttgattccatttgggttcttttaaatattgtctattttataaatcacccattattatacccttcccttaatttttaaaacatggcttttctttag

SEQ ID NO: 576355 - DNA, 962 bp, Homo sapiens
agcgggttctcaacatcagagggtccaggcccgaccctgacagagtatgggggctccgggaagcagagcgctgcgatggagtggtctgctgggcctctacttcctcagccacatccccatcaccctgatcatggacctgcagggcggtgatggcgtgcgagctctacccaagttgcaacgcttggagagaaagcctgtctgtacagctgcgtagtggctcaaaggagattcacaatacctcacgtgttttacatggagcccccaggcctggctatttaaggtactttctgattattgaccagcagctcaggtgtattcaggcgtgccttatcttttaccctcattagcaacggttagtgccttcctcaataggttggataaatggtgggggaaacatcccattaattgactcacgtaaatcaggtcccacaaatctgtcaggcgacaggtatctccaaagcggaagtggcgatggatccccatacgctcttgtagtggagaatgctaccatggactcttggtggtaaatacgccagagtagatctttgcctagaacgggacatcacgtgtggcgtcacgctcactgtctgtggtcaccaggcctgcactgctgccggcacgtcgtactgggaataagtaccatatgtcggtgaactacatgaaagccctgcacgacatacatgtgaatgcaaatgacgctatggttccctcttggggtgagttcccgccagacacgaccttggattctctcttttatgcggcctatatactattcctcatggcgtcaggcctatgtatccatacaagagctgtactaaacgctggaaggaaacagcggctaaatccctataatgttgcttactcatacttcaacctctctctacctgtgcccatctcactcaactgctcttctacacacagcgtgacccccgcccaccaactccacatgccaaacacactgc

SEQ ID NO: 576356 - DNA, 818 bp, Homo sapiens
gctgaggcgtgagtatctagctgactgggcctgggaacgtaaaagtcattctttgtcctccaagggttaatcactgacaggcaggagatatgggtgtcatatgtacctggttttaagtcctgcctctgccccttggtgttaggtgtcttttttattgttatattttgttattgcgaaaatcggagtatcatggcatcggtgataacccaaggatggggtaacagggggccgagactacagggcattcactggcagcattcaaccactcctgtgggcccaaagcaactccctcgccagatgtcaggcctccgtgaggttagcgtgaggactacaggttgcaacgccaccacctcgcgtggcccaggccttcgttaccaaactccttttctagagacaatgtggaataccaatctaccgactgtggctcgtgtattacacgcgtgggcccacatataacgagcgcctctcgatcggctaccaatctatctatatattacataatttaaatgttaccacagcgtggacaccaaagtgcttatctttacccacaccgtggggtacaacaagtgccacacgctaacagtgggctctggggaatttccgcacagagacagagcaccgggggtttctaagagttcccttaaatttcacacaccaactgtttaccctagccgtgtgtgtgagaacctgtcgtggaaaggatcaactacagcagatatacagtgggggggctcaaatataaatcgtggttacccatggggcacagcattctaccctcgataagggggcccattggggtgagagacgtcgcaaattag

SEQ ID NO: 576357 - DNA, 744 bp, Homo sapiens
gctctttcccttcggtgtgccactgaagatcctggtgtcgccatgggcgccgcccgcccgtggtaccggtatgtaagaacaagcggtacccaaagtctcgcttctgccgaggtgtccctgatgccaagattcgcattttgacctggggcggaaaacggcaaaagtgatgagttccgcttggtggccacatggtgtcagatgaatatgagcagttgtcctctgaagccctggaggttgcccgaattgtgtgccaataagtacatggtaaaaacgtgtgtggcaaagatggcttccatatccgggtgcggctccaccctttccaatgtcatcgggatcaacaagatgttgtcctgtgctggggttgacaggctccaaacaggcatgcgaggtgcctttgaaaagccccagggcactgtggccaggttcacaatgtgccaagttatcatgttccatccgcacaatgttgcagaacaagggagcatgtgattggaggccctgcggagggccaagttcccagtttcctgggccgcccagaagatccacatctcaaagaagtgggggctttcaccaagttccaattgtggatgattttgaacgacctggtgtgtctgaaaagcggtcatccaagatggtgtggggtcaagtacatccccaggtggtggcctctggacaagtggggggccttgaatcatgagggttcatgtgtggccccttttaatattaccataatttattctgtctctt

SEQ ID NO: 576358 - DNA, 1991 bp, Homo sapiens
ggcaggcgacggccgatgttcgtgcccatcgtggccaccggtacccgcttgaggcgccattcgagccttgcacgggagcgatacttggatggcatggagatctggcatgcaggcattgacgtcaatctggcccgtcgtagctgagtaatgtctcaccttgtgtaaggatgcgccatggccatccatggcaacccccgagaagctcctctcgctggttcgtggcgtgcgtctccggtcaacgagcggcataggagacgtggtctacaacgggactgactcgcgcagcttcagttctcgtccagcacgtagtggactctgcgcagcctagtgtctactagcaggatagcgcagcgacacgatttctggcgcagtcaactgaagaccgaaactcgacggctaggagcacgcgcacagctggagattggcttcgtgcgaatttgatggaacacactcgaaacaacggggacgcggataagccttacaggcaatgtgcagaatggcgctaagggagatgcgtaataggcgcgtacgccaataagattaatccgtgtatctacgcaatgtggcatctaattcgctttgaggttgttgcacagattccaggcagtcttattcgaagtacaaattaactacatccaggccttatcctgaatgggaagatcaatgcgaggcgtaggtgttaatgctagacgctggagtgacaaacccacagtgggatcttcgcagacgggggttcgcacccacaggtttacgtggcgccttagggtggaaaaggggtagggcggccatgttcccactgaacgaacgaactacaaatagacggatgagtactacaaattctgcaattcggatcagcccgatgcagggagcacaaacacacgcaaaagaaatatatccacggtgtagagcacagactggaccttcgagccgtcggcacactattagacggaacgtagattagggcggacaatgaggagagaggacacatcgcacccagccagatccaaaaggagcaccagagaccaaatagaggaggacaagaggacgaactaaaccagaaaacacaaccaaggcaacacaggcagaccacgtcgcaaaacttaggactcacaaatctcccagcggcgatagtcacacacaaaaggcgacctaaacacaggaatcgcacaccctagcgacgacaccacaacagctccctagagcagcacacgaaaagaacacgaacgatgcgcaccaaaaagcaagggaaggaccgggcgacaaatcacaacttatcacaaattcgtgcgaaactgtacgaacacgtcactagctataggatcaagagcagacgcaaagcagatataacaaacacccgaccgtgaagagatagttagccgtataacaagactgacgcgcaacccacaataggaacgtagacaggaaaattgcgacattcggacacgtcgcaagcaccacacagaggaggcaacagagacaggcacacagcacagacaaaccagaagcgagcaccattacgatatgaaagaaaacacatggacaaaacaacaaggaggaaaactaccagaagataacgagcaacctaacaacatataagacaatatcgaacacacaacaacaaagatagacatatagaaagatatcacacacataaacaacacacatattacgtcacaccaaatattcaatgataacaaactaaacaataagattgctaacatacattacaaattcaatcactactgaccccaagacaacgcagaactctaaacaaactgtattaagcaacggcctcacaaacagcgacaacggaaaaaaaacataagcgataacaaacgataatcctcaacttactcaataacacacatttcactaatcgcatatgaacatatatcatgtaccaatttgacaagagaatcactacaaacacaaagcacacaactaacagagacttatcataaacacagcaaatcgaacatcagccataacaa

SEQ ID NO: 576359 - DNA, 273 bp, Homo sapiens
  misc_feature (7)..(7): n is a, c, g, or t
  misc_feature (61)..(61): n is a, c, g, or t
  misc_feature (67)..(67): n is a, c, g, or t
  misc_feature (147)..(147): n is a, c, g, or t
acggttnagcaattacccaggggtaccattagtggtgccttccaggataagacattgttgnatacanggtcttgcggatatcaatgtcacactccatgaaacaacttacaatagcatcatgaagtgtgacattgatatccgcaagancctgtatgccagcagattccataccaatgaagctattgtaagttgtttcatggatgccagcagattccataccaatgaaggagggctggaagagtgtctcaggacagcggaagcgctcatcactat

SEQ ID NO: 576360 - DNA, 223 bp, Homo sapiens
  misc_feature (7)..(7): n is a, c, g, or t
  misc_feature (61)..(61): n is a, c, g, or t
  misc_feature (67)..(67): n is a, c, g, or t
  misc_feature (147)..(147): n is a, c, g, or t
  misc_feature (173)..(173): n is a, c, g, or t
  misc_feature (175)..(175): n is a, c, g, or t
  misc_feature (178)..(178): n is a, c, g, or t
acggttnagcaattacccaggggtaccattagtggtgccttccaggataagacattgttgnatacanggtcttgcggatatcaatgtcacactccatgaaacaacttacaatagcatcatgaagtgtgacattgatatccgcaagancctgtatgccaacaatgtcttatctngnggnacactatgtaccctggtttttctgatcggtattgcagagggaatt

SEQ ID NO: 576361 - DNA, 447 bp, Homo sapiens
  misc_feature (36)..(36): n is a, c, g, or t
  misc_feature (74)..(74): n is a, c, g, or t
  misc_feature (99)..(99): n is a, c, g, or t
  misc_feature (108)..(108): n is a, c, g, or t
  misc_feature (204)..(204): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (293)..(295): n is a, c, g, or t
  misc_feature (297)..(297): n is a, c, g, or t
  misc_feature (299)..(301): n is a, c, g, or t
  misc_feature (305)..(306): n is a, c, g, or t
  misc_feature (308)..(308): n is a, c, g, or t
  misc_feature (310)..(311): n is a, c, g, or t
  misc_feature (314)..(315): n is a, c, g, or t
  misc_feature (320)..(320): n is a, c, g, or t
  misc_feature (323)..(323): n is a, c, g, or t
  misc_feature (326)..(326): n is a, c, g, or t
  misc_feature (328)..(328): n is a, c, g, or t
  misc_feature (335)..(336): n is a, c, g, or t
  misc_feature (340)..(341): n is a, c, g, or t
  misc_feature (416)..(416): n is a, c, g, or t
gctgtgtgcatcagtggagatgtgagaccgtaaganattatccaggacttgctggcccatgcggggctttttcngactgcacggagagggcacctgggnccttttggnacccatacaggtccctggctgttggccctgatacacacggaaaacctttttcatggcggtggaaacagctgcggtgtgaaattcctcctgcgtcancagcgagcacctggtggtacggtggtcactggggtctgcccttccaaggccagcccatatacttgatatgtcagcttnatntnacanannntntnnncaanntncnnaanntgccngangtncntggctgnnaggnncccagcccaacgctgtagttcctgcagcagcggccttgcgctgaagctgctctgagggctcccaggtcacggacnggaactcccacagtcctgccagcagacctga

SEQ ID NO: 576362 - DNA, 767 bp, Homo sapiens
  misc_feature (219)..(219): n is a, c, g, or t
agcgtgggtatttctcaactgtgactaactcctaagtactcctaattataactgcctttagatcacacgataagtattcacctgtgtagcctagagcgttcatgagattttctcaccccatcattcgttccccttattatatagacaggactgtttccgctatgtgtgactacatgacctacgtgtgagactagtgaagactacacttgacaccatagntgctacattgctaggtatggtaatctacttcttagaaaattggtacttgactcaagatatccgttaccttgcagaattcgacaggatacttgacttatattagacaactcgatttgagcctaatgttgactgttcttacatttgcataatatacgcacttttgggttgatgaggttgccctcatgtctgtagttaccagaagagagcttgcaaagtaggtctttaactattcttgagcccactggaacgggtcagattcctgagacacaggctacctcttgattcgacgacgtctcaatatctatccgcatgggaagttcaagtagcgaggtgactttcaccatatccttctgaggcgttataacttcccttctatttcacaaaagagccagtgttcttttaagggtagccccttattcttacaaaagccagatttaaaagcgaccttgtagttcttgccccttctacacgacacggctacaggaaactttcgatctcatcgatcgccatactctagactacagatacctttgcacaacggtaccctc

SEQ ID NO: 576363 - DNA, 238 bp, Homo sapiens
gcacaagcaaaactctcatatgattccattgcttaaatttattcctgggagatctgctgtgtagtaccaaaattggaaatgacgaaaagaaaaaaccaataatttatagatgaatcaaagaatgatttgttcggcagcttgcaatcctcgaacttcaagaaagtcgttaattgacattttggtctccagtttttattgctctgatgtcaccacatctgtacccttctgtcgtcttctc

SEQ ID NO: 576364 - DNA, 133 bp, Homo sapiens
gtattgctccaccgcatcagcctgggtgacgagtgagactgtgtcacaaaaacacaaaaaaaaaaataacccaaacaccacccactttagggaaaaaaatttttccaggactcactggcgctgaaattggggg

SEQ ID NO: 576365 - DNA, 959 bp, Homo sapiens
agcgggcttttcccaccccctagcgccgctgggcctgcaggtctctgtcgagcagcggacgccggtctctgttccgcaggatgagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576366 - DNA, 865 bp, Homo sapiens
  misc_feature (3)..(5): n is a, c, g, or t
  misc_feature (7)..(8): n is a, c, g, or t
gcnnncnnctactactactaaattggcggccgctcgacaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576367 - DNA, 772 bp, Homo sapiens
tacctcccgcgcagtgaggttggcacagccaaccgtctgtggctcgcttggttcccttagtcccgagcgctcgcccaactgcagattcctttcccgtgcagacatggacttctgcgccactcaccagcaccgccgtgacaagatgtggacatacatgggctggaacaggcctggattgatccagaacattctccgacgggaagaacttgaaaaaactttggtggaatcttccatttgtgggaacgcccatctgcattgcctttaattttcggggcaacgactacaaacacactgtcggaatgtgcgggtccctcctttttgaccactggccttgtggccaagtgccagccgaccactcaatccattgccttttcacaagcgtcaaaccttacccaagggcgagaaacattcttgggggctctctggaaacggccacacgcaggggccttgacacccgcattgttcccataagctgaaacccaccaggctttgtgtgcggcgctctccctttggacggggcaagggacacgacttccagggccgctggggagacaatcatttgggccacactcacatttgcggattccaggtttccatttcgacccatgtgcaccccatcttaattgagcgcacccctcacaggtcccttttcttaattgggcatggcgaaccgtccaatttcctatggtaggcccaaagaaagggaacgttgttggcccaataatttctccccaatgtgggcttgggaagcacggtatttggcccgcaaaaa

SEQ ID NO: 576368 - DNA, 907 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576369 - DNA, 1576 bp, Homo sapiens
  misc_feature (799)..(799): n is a, c, g, or t
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagccttaatggaaaaaaaaaaaaaaaaaaaanaaaaaaaaaaaaaaaaaaaaaaaaaaaaaaaaaaaagaaaaaaaaaaaaaaaaaaaagaaaaaaaaaaaaaaaaagaaaaagccacgccaaaccgcaaaaaaggaaaaaaaacagaacagagaagagaagggaggagaaggagaaagagaaaggcgggcgaggagacggaagaaacaagagagggaggcgagggggggagcgagagcgtagcgaaccggcgagagaaggaaggcagcacgaaggggacagaagggagaaaggaacagagcgaaggggtgcagtgctggcggcgtagcgggagaggagaaaggggagtagacaagagaagggaagaagaggagacagaaggaagactaagcagaagacaagacgaggaagagaaagggaagcagaggaagactacagaggggaaaagagggagaggacgggagacacaaaaaggagacggacagaacaagagagaaagacgacggagagactgagacgacggcaggaaaagaacggagcaagaaagacgaaaagcagggcgggagagacacaaacacgcaagaaaaagaagagcacaagagaaggaaagtgatgatggtggttgagaggagagggagggtgggagaggcgatgggggagagaggaaggcgagggtggggggaaagaaggggaggaaaggaggtaggaaggcggaggcgaaagtcgagggaggcgagatgggagaggcgagggaggaggagatgagagagagatggaagggaagtagaaggagggaaagaaagagggaa

SEQ ID NO: 576370 - DNA, 969 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaacagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576371 - DNA, 1514 bp, Homo sapiens
  misc_feature (737)..(737): n is a, c, g, or t
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctcttaatggaaaaaaaaaaaaaaaaaaaanaaaaaaaaaaaaaaaaaaaaaaaaaaaaaaaaaaaagaaaaaaaaaaaaaaaaaaaagaaaaaaaaaaaaaaaaagaaaaagccacgccaaaccgcaaaaaaggaaaaaaaacagaacagagaagagaagggaggagaaggagaaagagaaaggcgggcgaggagacggaagaaacaagagagggaggcgagggggggagcgagagcgtagcgaaccggcgagagaaggaaggcagcacgaaggggacagaagggagaaaggaacagagcgaaggggtgcagtgctggcggcgtagcgggagaggagaaaggggagtagacaagagaagggaagaagaggagacagaaggaagactaagcagaagacaagacgaggaagagaaagggaagcagaggaagactacagaggggaaaagagggagaggacgggagacacaaaaaggagacggacagaacaagagagaaagacgacggagagactgagacgacggcaggaaaagaacggagcaagaaagacgaaaagcagggcgggagagacacaaacacgcaagaaaaagaagagcacaagagaaggaaagtgatgatggtggttgagaggagagggagggtgggagaggcgatgggggagagaggaaggcgagggtggggggaaagaaggggaggaaaggaggtaggaaggcggaggcgaaagtcgagggaggcgagatgggagaggcgagggaggaggagatgagagagagatggaagggaagtagaaggagggaaagaaagagggaa

SEQ ID NO: 576372 - DNA, 791 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagccctcaggggcccaagtggcgattactgcgccacttactggaccaatgacctctctcaaaacagttccccaccttagaaggatcccacacctggggatgtcagcctccggtacacccgcc

SEQ ID NO: 576373 - DNA, 1002 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaaaaaaaaaccaaactcgagactagttctctctctcc

SEQ ID NO: 576374 - DNA, 120 bp, Homo sapiens
gtataactcacatcatcttcacaaagcagtttctctgttccccatgattctcctataaggtaagggtacctgagctcgcaattctgtaatcacaggtcatatgctagtttacctgtgtag

SEQ ID NO: 576375 - DNA, 183 bp, Homo sapiens
atgtggtcatatcacaggaatactatgcagcactgaaactgatgagtcatgtccttgtagggacatggctgaattggagacatcattctcagttgaaactatcacatggcacactcaatagccgccatctgctgccctacttctagccttgacagttcatcaagttatgtcctcacatggtca

SEQ ID NO: 576376 - DNA, 722 bp, Homo sapiens
ccagtctgggctacagagagaggctgtctcaaaaaataaattaagtagccgggcatggtggctgatgcctgtaatcccagcactttgggaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaaaaaaaaaccaaactcgagactagttctctctctcc

SEQ ID NO: 576377 - DNA, 724 bp, Homo sapiens
  misc_feature (398)..(398): n is a, c, g, or t
  misc_feature (433)..(433): n is a, c, g, or t
  misc_feature (493)..(493): n is a, c, g, or t
  misc_feature (535)..(535): n is a, c, g, or t
ggtcgcattgtggcctttttctccttcggacggtgcactgtgcgtggcaaagcgtagacaaggacgatgccaggtattggtgacgtcgagatcgcaagcttgtgactggcctacttgacctcgaagtgaccacactaggagccttcgtgatccatgtgagaacgggcaggcatggcgataccttgttgtgggaagcgtctagttgggacaccaatagccaggcacgtcctggagatgtccgtacaagggcgcatgtgaactgacttcaacgcgactaggttccgttgatcgggcactgtacctgtaggcctggctgatggtctctagctggtgctcagctcgttcatgctcggaaacatgagcgcaggaccacatgggaccagtaccagcatcgtaancccgtcgccatctgcccctatcctcttgcctccanccataattcgctccggtcgcagccggcatgttgcctatcgcaggaggaacacactatgantgcacgtccaatgtgcccactcgttgcccattacagcagggnttatgtggcccgacgatctgtggtcccgttcgcaagctaaggtatctctgagaattctagtcacgatcttctcgtagagtagccccctaggaacctctagtctcccctttgggctcgagacattcgaccaagaatttcgcataaatatcttgttgcaacaggcatggcctggcatggttatggcagagg

SEQ ID NO: 576378 - DNA, 458 bp, Homo sapiens
  misc_feature (3)..(5): n is a, c, g, or t
  misc_feature (7)..(8): n is a, c, g, or t
gcnnncnnctactactactaaattggcggccgctcgacccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576379 - DNA, 265 bp, Homo sapiens
cggtcgacagcttctgagtactgggatataggcgccgcacatgcccagctaaatttttgtatttttagtagagatggggtttcaccctgttggccaggctagtctcaaactcttgacctcaggcgattcacccacctcggctcccaaattgttgggattacaggcatgagccaccggccccggcctgaccctttacccttgaatacttcattgcgccctaataacaagggctttcccttacgtaaccaccgtgcagtgcttaggt

SEQ ID NO: 576380 - DNA, 590 bp, Homo sapiens
  misc_feature (89)..(89): n is a, c, g, or t
  misc_feature (117)..(117): n is a, c, g, or t
  misc_feature (206)..(206): n is a, c, g, or t
actttaattcaaaagctagaaatgataaagcttagtgaggaaggcatattgaaagccgagacagccaaaaggctagggctcttgcaccnacagccagggtagtgaatgcaagggaanagtccttgaaggaaagtaaaaatgctactccagtgaacaccgaatgataagaaagcgaaggaggcttattgctggtaaagtaacgtttncatgttctggatagaagatcaaaccagacataacattcccttaagccaacgcctaatcgagtgcaaggccctaactctcttcaagtctacgaaggctgagaggtaaagaagctgcagaagaaaagttggaagttagcagaggttggttcatgatgtttaaggaaataagccatcttcagagcataaaattgtaaggtgaagcagcaaatgctggtgaagcagctgcagcaagttatcaaaaagatctagctaaggccaggtgcagtggctcatgcctgtaatcctagcactttgggaggatgaggcgggcggatcatgaggtcaggagatcgggaccatcctggctaacacagtgaaaccccgtctctactaaaaaaaagatac

SEQ ID NO: 576381 - DNA, 218 bp, Homo sapiens
acctggactcccggggggggttgtgggtacagagaatcgcttcccccaagcctgcccctctgcctcattttcctgtagctcctctggttctgtttgctcattggcctgctgtgttcatccaaggtgggtcctcccagaagtgagtgggcctttccctcgcatcccttggtggcactggggcatgctgtgccttgccctagcctactgctctgagtgca

SEQ ID NO: 576382 - DNA, 340 bp, Homo sapiens
  misc_feature (83)..(83): n is a, c, g, or t
atgtgattttaaacctttttaaaacaaatgtgaaaaagtcagttttaaaaatttcgtggtagaaagttaggcatttgtaacanggaaagagagaagactaataatctcaatttagaagtaaatcattgagatagaaaaagattcccattgactgtagacttcttcccattttgtctccccttccgcaagtttccccttcaggcatggataaaggaaccaaagtgatttgttgttgttccaacctgggctttgtgactttggttagggccacaaccttcttccctcctttcccccttcaatttggaaataaatttctgtatatggtgcaaaaaaaaggaaa

SEQ ID NO: 576383 - DNA, 173 bp, Homo sapiens
tgtcactccacctacctcacatactgctaacagtggacacagacacattcaggtgccattatgcagaaagagatgccagaggctcttgaagatcacaaaggggaggagtgaagaaatcctgcatctcagtccctcacaagacagctgtctcaggctacaaaaacggtgagaga

SEQ ID NO: 576384 - DNA, 353 bp, Homo sapiens
  misc_feature (174)..(174): n is a, c, g, or t
cgttctccccgttgccagttcgctgagggtgggagtaggaacaaaagtttaaggctgaggcactgccatgccctggatgtaacaaccaggaaaatcatgttaatcaaaggaaaacaaaaattccttctagactctggcaatactgcacttcttaaacgaaaaatcaaattgganaacaaagacggttgtctgcccacagtgttctcaggaataacaggatgcccctgtcccactggagaagcgggcagcttcttgcaggtcaagagtttcttttgattcagcccctgggaccccatttaattcacaaagggggaaggaaacgggggtacccggagcttccgaatttcggaaat

SEQ ID NO: 576385 - DNA, 384 bp, Homo sapiens
tctgagaggatgtggtgtcggacacactacgtgtgaggcgattctacgggaatcaacaggggatcaagttactgcaccgctgcagacagtaggaccttctcactcagagacttcttcctcctactacccttggcatcctttgcctccttggcaaggttagggaggctagtaggcatggtactcttggcactgggccgtctagacttcttgcccattggggtgtgcttcaggctgaggaaagatctgtagggcccacagatgacaggtgagagagcagaagtcaacacggtgcctggagggcttggggtcacattgtattcatccagacggcgcacaatgtcatggtgcatgcgatcccgagccacatcccggggaagacgatcc

SEQ ID NO: 576386 - DNA, 680 bp, Homo sapiens
  misc_feature (35)..(35): n is a, c, g, or t
  misc_feature (59)..(59): n is a, c, g, or t
  misc_feature (105)..(105): n is a, c, g, or t
gccgagttcgaaataagccttggttaaaggaacanaagctgcagcaccccaccgctganggcgctctagctctagtggatccgcaggttgcatgaattcggctcnaggccaatctttccttgctagcctgatgtggtcttgacggcctatagaatatgtacacctctgcacaaaatgtacgtcaatctcagattcttcagaccctcattgtctgagtccattggctcgcgtcatgagtacagatataggaaagtgtcagccatttatgcacaactccatgtagctgaagacgagcatgattaggcctcccttcgtaagacacgtctggtctagataactcttgatcgtgcttcctggccgccacaaacatatcattcatgggatttcctcgggctcagtctttcccccggacagttcgcgaatagatgctaccctgacacaaaatcccctatgagtcccaagcagcagggcatgctaacctcagaagtatgcaccctcagtcacaatgtcagaaagcccaggtttcccaaaggcattaggtttcccccctgcgttgtgctgatatcatggcatccgaaattaaatgtggaatgtgtcagaaacattatgttcgccaatctatggccagtcgcagtttatttttcatgctttcagctacctggatatgtcttatttgaaac

SEQ ID NO: 576387 - DNA, 309 bp, Homo sapiens
agacgccagcatgaggcgtctgcactcagccgctctgtcgcctatagactatcgcgggccacagctgctgatgcaccggggcttcactcagtactaaggctggcgcagcacgaactggtccagctaagcagccagtgtgccagagacaggtgttgcagtataaattaacactccattcgctacagctggctatgtttgttttgagactcacagtcccattgtcaccaaggccttggccttggggatcagcttgctctgtggtggcagagaagacctcactttggtggagggaatgaagggagcctcgct

SEQ ID NO: 576388 - DNA, 1205 bp, Homo sapiens
gcattcgaggagcgcgcgggcacagtgttgcctggtgaccgagcgggtgcatcagtactccagaacttggacggcatgatgatgactctgctgctgtttgtggtggcatgcgtgctgatccatgagcgtaggactgggcaggtccgtggagggaccatgacggtctcagacgaatgacgcgtccagcgaacagtgtccaatactcagggtaagctaacgatagcgtcaactagaggacattctaaacatgcttgtcacacgagggttgcacaacagagtacatctgacgtctcagtaagataaagaacgcagacacgatacgatgcgtcaaagtactacttgtcgtcatgccataaccgtatgaaccgcaaagtcccaatggaacggtaaagcaaaacgacgcgaatttgcgccctatctcgcaggagcgctatgtgggaacttccaggcatgaacgacacatgccttgacatgggaaagtcttcacccaaggggacggtagttgccaaagtagatagaacgccaatgcattcgcgctccccgtccttggggtacaggaatgttagctataagggccccttgcccattgtacaagacccaatagcagcctccgttgaccaacttgtacaccggttttccttagcggagcaaactgccagcatacagttggcccaccgaagaaagtttgggctcgttccaagggaggccccgttgcggctcttggggccgcggcccctaggacttttggcaaagaggaagggtatcccccgtgtgaaaccctcatggcaaggccttacagcgccccctttttcctttacccgttggccgtttggcggagttcggaacactttgggtgctgggaatcccgaccaactgtccggaagcttcgccgccgtagcccttacgggaagggaacacctggaaccccggggcccacgggccaccggaaatgcggccaagcccagtttgacctttgtaggagtttggttcccacattaggccaacacggggaagctccaaccttttttccaaagagctgcactggctgaggcgtgggttaccccaaatggcgaagtttcctcatttaaaaggaacccggggaaatgtccatttccgttttaccacaaagcgggaagccacagacggagattcttcccttttccaatactccggcataggtaggggaataaggacacacccaccag

SEQ ID NO: 576389 - DNA, 134 bp, Homo sapiens
cagatcttactaatgctgtcctactgcatactcgcaatctccagttatcttagcatactcacgtctcggaatctgctatggttgtgattaacacgataccagctgagccactgaggcagattggctgctgctac

SEQ ID NO: 576390 - DNA, 450 bp, Homo sapiens
ggttactgctgactggttcttggtcatgttcggttggtcaaagataaattttttgtttgagagatgaatgcaaaggaaaaaaaggttttccaaagtccatgtgaaattgtctcccattttttggcttttgagggggttcagtttgggttgcttgtctgtttccgggttggggggaaagttggttgggtgggagggagccaggttgggatggagggagtttacaggaagcagacagggccaacgtcgaagccgaattcctggtctggggcaccaacgtccaagggggccacatcgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttggagccctggaggagc

SEQ ID NO: 576391 - DNA, 439 bp, Homo sapiens
  misc_feature (210)..(210): n is a, c, g, or t
  misc_feature (264)..(264): n is a, c, g, or t
  misc_feature (280)..(280): n is a, c, g, or t
  misc_feature (312)..(312): n is a, c, g, or t
  misc_feature (321)..(321): n is a, c, g, or t
  misc_feature (328)..(329): n is a, c, g, or t
  misc_feature (352)..(352): n is a, c, g, or t
  misc_feature (410)..(410): n is a, c, g, or t
gtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctgggatgccagcactgtggcttcttagagagggcagatgctttgtatatcgagctgcagcantcatcgtagaaaatgctacaaagctgtctctcttcccctctctcagtttccctntttcatcaagatgaangcgttgggtaagactaagtgattaacaatcantatgattanactagannaaacctagaatttttggtgtccntttatcataggggttaagttttaagatgtagaactgattgcccagaagtgatgactancctgtgtttactcctttggcttgtttgtg

SEQ ID NO: 576392 - DNA, 124 bp, Homo sapiens
atatgtgttggtgattgagactagtagataattgcttctagaactgtttcatcatcccccaaaagaaagccttcggtacgaattttaattagctgagattctgcactctgggcgaattttgtat

SEQ ID NO: 576393 - DNA, 909 bp, Homo sapiens
acgtcgacccacgcgctcgctgggacttgctgcgactccatcttgagtgaggactaggaaaaatgaggctgggacttgctgcgactccatcttgagtgaggactaggaaaaatgaggctggggctttatcaggctgcattcccagaaagtgaggcgttcacagttaagggaacagattgataatgtttactaagcagacctagacttgggagtgtgctgatatcctgatatcttcagaacagaagcatccctaattttgctttaaaggtaataatatcaattcttgcaaaatacagtaattaggaaaattctttatcacaaaccccagtggcagagcacgtgtcctcatgatctttgatcttttttcatcctatatataaacgagtattatacctagggtggacacgttcctccttactttccggaacgtcctaactctgtctatggagcagctgttctgtcaccactttactttcttttctttttttttccttttttttttttctggaggacagagtctcgctctgtcgccaggctggagttgcacttggcacaacctcagttcactgcaacctccgtttcccaggtccgggggattctcctggcctcagcctcctgagtagctggatttgcttgccacgccaccacgcccagttaattttggtggtcgtctagtgtgacgacggggttttggaccattgtttgggcccaggcttggtcctcgatactccgtgacctcgcggtgatccccacccgcctaggcctcccaaagtgctgggatacacaggaaacgagcccaccgcacccagactaactttactttcttaattaaacctgggtttgtgcttcgcaaaacccaaaaaacaatacatatacaactaatcaacctcaaacacaaaataaaaaaaa

SEQ ID NO: 576394 - DNA, 361 bp, Homo sapiens
aacagtatgccaggtacacaggaggctgaggtgggaggatcacctgagcctgggagatggaggctgcagtaagatatgatcatgccactgcattccagcctgggcgacaaggcgagactccgtctcaaaaaaaataaaaagcatccagaagagccgtgcacggtggtggtgcctgtggtgccagctactcagaggctcgggtggaaggattgctcccagatggggcaacatagcttggccaacatggtgaaaccttgtctctactaaaaatacaaaaaattagccgggcgtaggtggcgggcacctgtagtcccagctcctccagaggctgaggcaggagaattgcttggacccgggaggt

SEQ ID NO: 576395 - DNA, 103 bp, Homo sapiens
tcacgaagcacaggctgctcataggaaaggttacaaaagtaaaggaactcggcaaatcttaccccgcctattttagaccaacccctgttcggttgagcggaga

SEQ ID NO: 576396 - DNA, 91 bp, Homo sapiens
cacggatttgctggtgcagtacaactaggcttaatagggacatgccactgcactccagcctgcgcgacagagcaagactccatctgcaaaa

SEQ ID NO: 576397 - DNA, 146 bp, Homo sapiens
tagttcctggcctgcgtctggatgctatccggggggcatcggggtcgtgtgggaacaagccttgctgttgccgccagtgttggtcgtgttgtcttgctggccagcaatgcaccttcgcacgatgcttgcgatcgctgtgacttcca

SEQ ID NO: 576398 - DNA, 404 bp, Homo sapiens
  misc_feature (361)..(361): n is a, c, g, or t
  misc_feature (396)..(396): n is a, c, g, or t
aatgttgctttatataataggtctgtttctcttaagtgtgcaaaataaatttttgtaaattgagctatacttaagatattgttaaagaaccatgaagtggctctttgtgtaatttgctgtgtaaaaatcttaatctgatttcttataagtttttctgcattttaactgcaacctgttcatcataatctaatagatagtggtttaagagcatagaatctgtagtcagactgcctggggttcaaatccaggctcttccatttagctaccagctttatgcttggttgtaggatcctgttaaggtagggaataatagtagttactttaaaaggttattgagaaaatctagagagttaatgccatnaaaaagtgtttaggaatcctgcctgggccaccctnaccggtat

SEQ ID NO: 576399 - DNA, 218 bp, Homo sapiens
cttcctgcttctggccccatcacaagatcctgagaccaagaagagccgtgtgaagctgccctccggctccaggaaggttatctcgctcagccaagagagctgtggttcgagtgtggtggctggagatggccgagtggacaaacccatcttgaagtgctggacgggcgtaccacaaatatgaggcagaagcaggaagcaggaagcggcagaagcaggaa

SEQ ID NO: 576400 - DNA, 1292 bp, Homo sapiens
  misc_feature (294)..(294): n is a, c, g, or t
ttttaaataccagctttacataaagtgattgttgactctggctctgttgtctgacaccgtttccagaaagataagtcaactctgttcagggctacaccaagagtaggaacgcaagacgctggtggagtgctcacccttcttaccaaggagctaatagtacgaaatcttgctgtgactcttagactcagctaagagcacatggcttcgcagcacacgtaggacgtacgacgaccctataggccccagggacgagtagagacgcagcgttcatgcgtacgacaacatggtcatcancacctgattccaaatttccccctgccacgcctctactcgccttcaacctcctacgccctacactgcggcgcaactgcgcctacacaacgcgcttgcgcctgagcttgcccttctcgtcccacctcccgtttttcccacgccgttccccacgtacgaccgcccccctgttcctctgcccgccctaattcgctgcaccctgtgccgcacaagggcgaacccttgacccgagcagacccacccttaagcgccttgttccccttctcgagcgtgcccctttggactcccccactttgccggaacgtcttgtcgcaagacacacacttctccttgggcgctttactaaccaacgtcccacaggcgcaacgcgccggtcaacggcaaacacacccgtactcacccttgggcgacgcccctacgcgcccagaagcccacacgcccaacgaccctcttactcctggcccctatatccctttgacacacgccttcggcccccattacgcgcagtatcgcgcacgcgcgccgctcttaacacaatggtctgggcaccccctttaccttaggagcggccattggggcgccccctttataccgggcaaaccaacatcaaggcgcgacagtttatcccgaaatctatgccccaagagcgttagtgtaaacgctttcgtctacgagcaacggtatactgtccccccgtttgtattagcccgcaaaaggggcggtctgaagaatcgtacactgcagacgacgaatatgaccagggctccctccgagaagaggaggagtccacgtccgacaactggtgtctgtcagctggcgccgctaacatagatgttttggggagagctttatagatgttaccccccgccaaagtagtggggctggtgatttctcaccgtaataagagggcggggggagtacccacgtagttattccgcccaagaaatattgtttggtggtgcccccgcatatgttgcgggtcgcgccaccccccagcaaat

SEQ ID NO: 576401 - DNA, 2198 bp, Homo sapiens
gtgagggcgcgatggggagtgagcggcgtgtgccggtggcatgctccgatgccctcccgcgggtaaggagcccccgacggtgcctgcgaggccccttgatgcggggcctgccctcgtctcgccgctccgcgcccgctgcccgctgggaatgatgacgaaggaacaattccagccaagcggggaccatcaggatggaaaccatgcagcctgaacctgctccgagaagtgtcggctgggtccggacaattctgcgggaaagggattttcaagggagatcttggaaaaacaccgctatgtggtgctgacaatggggacccagactctacatctctgagaagcgagggtaaccagatgatcaaaaactattccacagaggtatctgaccctgagttgacctatgcagaggtgtgaagagctccggaaggtccaagacgcaggtacgcaggacgaaatccatagcaaggttactctttgaccgatccaaagagcccggtacagacggcaccgagactgatcttccttggaggtgagttccagacgagaaaggaatcgtgaatacagtgacctacaagttctgcaattcagccgagcacatgaaccgtatcttggatgagggtcaccgagaggaggacagctatcttggccaatccaattgaaaaagggacaaatcatgcatctacgacagcaacaaggggagcacccttactttgcggtgctacccagcttatacaccggtaggagttgtcagcactgggcgattaatccaagagggacccatatcccttaggaaacagcctttttttattagaattcaggctcccatgccaagcttggccacagaatagaccgggagtcggagaaggaacagccaggctggaagattacgttagagctaagcggctaccaccattgacgacgcccgataaagatacacaattgatatagattattgcatgtgatgactctaagaatgcaggataggagggcagaggacaaagaggcaggaacaggaacggccaggacgagcgaggcacgcgggcataagcgaacaaagcgggcgagcagacgacgagagagaagcgagcgaggagaaggagactagacgagcagcagacgcagcgagaccggcagacgacagagaggcggcagaccgagcaccgcaaagcagcgagagcgagcgcaaggccaggaaggagagcacagcgcggaagagatgacgagaggcgaacaacaccgacagagcaacgcgcagcacgacaagagtgagacagaccgagacaaacacacggcgacaggaaggaaggaacagggcaggagccagagagagaaacagaagcgagcgcggacacaccacgcagcacaccacgcacacgtaggaggacacagacacagagagcagcgagaacggacgagcagcaggacagagaaccgagaagacagcaaagcagaagacaatagacgagatcagaacgcagcacgcgacgagcaacacgaagacagaggaagcgcagacgaagaacgcacagaagcggcacgaacacgggagagcaagcagcgcgacgaacaaaaagcaggcgcacgaggcacgacgtagggagcaaggccgaacggagagcgagcggagaccaaaccgggcaggagcgacgagagcggaagaagcgaggaggcaccgacagcgacgacgcgaggcagagaagcaggcagagagagaagagggacacatcgcagcacgacgaggagaagaggagagcggaggcaaagacagtcgaggcacaggcaaagaggaacgaggtagcagcgagaggcgagccacgaaagagagcagaaccgagccgagctggcgagcaggagcgaagaagcaagggggaggagacgcgcacagcgagagggaagaaggacagagggaagagcaagacgagagagacgagcgaggacgacgcacggggagcgcatgagcgagagagcgaggagaggggagagaggacggagcgagcggaagactaggacaagacgaggagagccacggacggaagcagcatgaagagaggagcggcggagcgagaagagacaagcggggacgggcagaacccgaagcggaagggcaaccggcagacagaggaaagaacgagcggcacgagagagaggaaagagcgcagcagagcacgagggagcagcagaggacaggatgcaggacgagg

SEQ ID NO: 576402 - DNA, 232 bp, Homo sapiens
cttactctaaatcactggtcattttatagacccctgactttctggaaataaaatgtgtgattagcttttactctgagtcatatctcccacctgctgttagaggttattcattcattatttagagggcctctattgcccggtgccaggtgttattctataatcatcactttatgaagaataaaatctgtctttcctgccttcaaagttctcgtttgaatatttgctactacca

SEQ ID NO: 576403 - DNA, 1744 bp, Homo sapiens
  misc_feature (50)..(50): n is a, c, g, or t
  misc_feature (61)..(61): n is a, c, g, or t
caaatcagctgatgaggcaatacactttgcgcagatagctaggaagtttngagaagtaccnttttatgtcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactattttgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtcttaggaagagcaaaaaaaaaaaaaaaaacaaaaaaaaaaaaaaaaaaaaaaaaaaaaaaaaaaaaaaaaaaaaaaaaaaaaaaaaaaaaaaaaagggggggggggcgcgcgcgacagaaaatcacaccacagaggagcggcgcaccaccaaaagacgccgcaccccaccgcaggtcgtgcgagaggacaaaagagggggcgcgccccaataaggggcgcgcgaatatatataacacgcacaagggggcggcggcgagagtcaataaaaacacagaaactaggaggggcggagacacagcggcggcgcaaaggaggcagagagcatactagagagaagagaacgacaccccaccccacggaggggggaagagagaggaaaaacacgagaggagagaacaacaaaaacaaaacaaacagacagagattataaaacacgcacacgcagcggagcgagacaacacacacaccaaacctctaaggcaaggcgaacatagaaagggcggagcaccacaaacacaaaacgcgcacgccaccacatacagactgcgaggaacgcgcaacaaagcaaagcagaaaaagagacccaaaccgcagagacgaaaacaaccaatgaacaacacaaaccagacaaaatacacaccccaagcgaagccgggggacagattactgttacggataacaaaatacacactcacaccagataagatagaaaaaataaacaataagaacaaaaccatccaacagaagaaataccagaacgcaaacaacaacacacaccaagtacgacatacacacaaaacaacacacacaaagagagcaaaaataaacaccaaacacagcaacaaacaaaacacagacaacagcacacgacagaaaacgacaaaacgaaaacgaaaatagaaaacaaagaaactaacatccgcaagacacgagtaagacaccaaaagcaaaggaaaagacagcaacaaatgaccaacaacaacagagcgacaaagaagaaacaaaacaggatcagcgagccgacaagcagaacgaaaacacgacgaacgcaacaccagacacctaggcacacggcgcagacaaagcagagaacgcagtacgctgaaaaaggacaaagcaacaccggaaagaaaagcgacaaacacaatcgaacaaaaacgaacagaagagaacagatgaaacagcaagacagagaacgacacaacgagcagggaagggaggagcaaagacgaagaagcagaaggaaggaaagaacaagtatgaagacacgaggatgcacagt

SEQ ID NO: 576404 - DNA, 406 bp, Homo sapiens
  misc_feature (3)..(5): n is a, c, g, or t
  misc_feature (7)..(8): n is a, c, g, or t
gcnnncnnctactactactaaattggcggccgctcgacacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576405 - DNA, 531 bp, Homo sapiens
  misc_feature (50)..(50): n is a, c, g, or t
  misc_feature (61)..(61): n is a, c, g, or t
caaatcagctgatgaggcaatacactttgcgcagatagctaggaagtttngagaagtaccnttttatgtcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactattttgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtctttttttactttaagagcataaactcgtttttattttgcacacttttctcatttcctgagaatttacca

SEQ ID NO: 576406 - DNA, 81 bp, Homo sapiens
  misc_feature (6)..(6): n is a, c, g, or t
ataacnacgcccaactggcttgttttattggagaaggggacgcagaataaacaacgtgagacagctgggtcactcatgatc

SEQ ID NO: 576407 - DNA, 387 bp, Homo sapiens
cctttctcctgttccaaaccccaacccatcatattccttagaacaaagggtcttttctgccaaggagggaccagaggtcagggatggctgtggaggctgagggtcccttggaatctctgtggtgggcaggtggagtggggagtgtgcagagcgactatttctttgttctgaggaatggagaggtggctggctttgtgtgcaggactaggagtgcagtggagaggagagctgggggaagcccaggagggagctgagagggctgacggtgttggaggagagtggaagaatggggggtcctccctggttgcctgacgcttctgcggacatagacaaaaattctaggggtcgtgaaggttaaggaagagagttgcagggggatgaagcacc

SEQ ID NO: 576408 - DNA, 150 bp, Homo sapiens
ggtaccttattttcttctttatgaggaggaagaggaggatatggtggtggaggacctggttatgacaactatggaggaggaaattatggaagaggaagatgaagaagagtcagagtccgaggcaaaatcagtcaaggtgaaaattaagct

SEQ ID NO: 576409 - DNA, 362 bp, Homo sapiens
agcgggcttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgactgcaaatatggtgtgagtgctgcaatatgctgcagc

SEQ ID NO: 576410 - DNA, 226 bp, Homo sapiens
agagtgtcactgatgctttatttacatgcgtcacctgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagca

SEQ ID NO: 576411 - DNA, 725 bp, Homo sapiens
  misc_feature (210)..(210): n is a, c, g, or t
gtccctcagttaaaaggctcactagctcactagccaagaaatttttattttctggaaagcaattatttttttttgggaaagtcctaggttctttgggaaattggaatgtcccaatattaaagcaacttctggagcctaagaaactttaaattaacttttccctaaaatggtcccaacatttactatacaatatttctttggaagactatnaactgggacatgggcagacactggctttggaacaaaaaccacgcctagtgaatggactggagtcacagtcctttagggctggcccagtcattctattagatgactaagggaaacctagaaaaagattacaggttcaccctggtcagggtcaacttggtgacacgacacgaagtttattcaactggtaagagggtaacattgacggtggagctggtttacagcatcttagtttggaccatgaaacttggtctatagaattactggtgtagctggtgccgtacgatttaatttcctcacatttattttatttaacaggtcttatttaatgtccgggtgaaactactatagtgggattcgtcggccatcttaattttcgccacagaagagacctatttgggaatattcaccaggttaataaattctcacaaataagctgggacttgtgtatcacaacaagttccggacagcttaacgaataaaatggcccgggtgtagtagcagtggacaaatgctgg

SEQ ID NO: 576412 - DNA, 267 bp, Homo sapiens
gatttttagtttttaatgctgtctttgcttaatataaaatatgtgttgcctatggctccccaaattgtgtggggagtctctaaatgttcctcctgaagggtccattattgaaagtgggtaaggggcacaatgctattttttgttgataggttgggttttatggacccctatggggtttaaaagaaatctgttaaatggtttccaggagttaacactttttttttgataatttggaataaagtttgttttttaagcccaaaaaaaaaa

SEQ ID NO: 576413 - DNA, 180 bp, Homo sapiens
cctggtgtcagttcagaggccttactgggccatgctcctctgccctctgcagcacttgctttgcaaggttcctctggagggtccccgaatgtgcgcatatatcttgggccagccactgcatgaccaagctggttaaacttgtgggagctcagccactaaacagcgaagttgagtgcctcg

SEQ ID NO: 576414 - DNA, 951 bp, Homo sapiens
gctgaggagtgcgggaagtgctgtgcagtggttgaaggggtgattgctgactagcggggagggagtgggcagctgatgtgtgagtggctggctgaatgaatgtgtgccctgtgtgctcctgtgtgcgcgctgtggtgtcatgctgtgtggtgcaagtgcgtgagtgcggagtgctggcctcgtgaggtgtggtgcctgtcgtggtgcgtggagctgggtggctgcagccagtgccgtggaacctgcactgcttcgagtgcgcccagcgcggggtcacctacgtggatatcaccgtgggcagcttcgtgtgcaccacctgctccggcctcctgagagggctgaacccccctcatcgtgtcaagtcaatctccatgacaactttcactgagcctgaagtagtattcctgcaatcccgtggaaatgaggtttgccggaagatttggttgggtctgtctgatgctcggacatctttagtaccagattccagggatcctcagaaagtgaaggagtttctccaggaaaagctatgagaagaagagatggtatgtccccccagaccaagtcaagggtgcccacttataccaaaggcagtgcctccaccccttgtgcagggctccatcccagaagggaagccccttcgggacacttctgggtgatccttgcacctgtctctctacaggttgctgccttccactcgagccagcccgtcagtcagtctcacgctcggacattccagggccggagcactcaggcacttcccatcctctgtcagagaagccaggtaatgacttcgtgcgttgagaatcgcgttggaacgccgttttgttggcccccgaatggcccagggttatagctgagttccgtgcgctacaggtggccaagagttccaatgaggggttgccacagttagtggattaacggtgcccgggtcattaggctggagcagcctcg

SEQ ID NO: 576415 - DNA, 557 bp, Homo sapiens
  misc_feature (216)..(216): n is a, c, g, or t
  misc_feature (283)..(283): n is a, c, g, or t
  misc_feature (351)..(351): n is a, c, g, or t
tatctttaaggttagatatatttgatgtgcctgttttatactttacatatatgtgtatatacatctatatgggtgtatgtatgtgtatacatgtaaatgtatcaatgttgatattacatagtatagtattttagaacatagactttactatttattagctgtgtgacttggcaagttacctgatctttttgtgtatctgtttttccatctgccaanaatggggagtaataatctatattttcccttataggggtataatgagcgattaaaataggactaaaantaaatattttaagtgctctggcactatcgtaaattgatatatagtgaaagtgtgtaataatttactgnttatctcgtttcctttgaagattgtattaatttttatagcaagtcacttatctaaggtgcgccttttataaattgcagataattgattcttttccacgatctgcaaaatgagtaataacgctggctcactgggtagcaaaaataagaaagaaaggagtctatcgagcatgtatctttcaagcaaagaaagaaaacaaaaaaaaacc

SEQ ID NO: 576416 - DNA, 743 bp, Homo sapiens
tacacatacatttcatcctcagtgagtaggtgccatgtctttatcaaggcttttgatgcagatgctatgctttcacttctcatggtcgatactttttgaatcttaaagtctgattgttcagatatctagaaaaggcgatgtctggctttgctctgccctctgactcactgtgctggttcatctttaggcctggagcaggctaccagaactactggctaatgagagatgaccgaccttgctagtgacatgtacaaatggccacatctgctatattgactatcattactgcttattaatagttcattaaacggagcttactgaattactattattttggctttaaatatatatgtgtcacttacgtagctctatgtccaaacgcgtgttctcaaacttgggacccgatcaccaatccctgttggttcgtcagctccttgctctccctctcatctctgctctcagctatatcacccgcctctccgctggatccatcacgtcgtcccctctcctctaacctccatccgctcccaactttctccgacctcgctccatatcgtccattcctcctgtcactcccttctcccaccttctactctcttgtcctctactcaacccgttgctcacgatctttagccctgctccaaggcttccaccctctcctcaacaccatccctctccttcacctctcattcttccctatctcccctctcctcccgcgtctaccctcgctcccctcctcccct

SEQ ID NO: 576417 - DNA, 138 bp, Homo sapiens
gcatcagtctctcacttctctccttcccttaggcacagactggtcaagttaactcctcatgttcggagtacattcttggcccatctgcagatctgctcctatatttcagacaatgccgtgccaagtggagactgttct

SEQ ID NO: 576418 - DNA, 486 bp, Homo sapiens
  misc_feature (37)..(37): n is a, c, g, or t
  misc_feature (43)..(43): n is a, c, g, or t
  misc_feature (67)..(67): n is a, c, g, or t
  misc_feature (100)..(100): n is a, c, g, or t
  misc_feature (131)..(131): n is a, c, g, or t
  misc_feature (147)..(147): n is a, c, g, or t
  misc_feature (226)..(226): n is a, c, g, or t
  misc_feature (242)..(242): n is a, c, g, or t
aagggttgggggtgttggtccccccccaaaagtcctnaaggtnaaaaatgggggtccccccgtgttnaaaaggtggggccccgggtaaggggtgggtggnaatggtgggggggggggaattccttaagggntggatttggatgctgnccctcttgggtgctggccctcaatggataagtgagctcctcagggaaatctgggtggtttaaaaagggtgtggggtgcntcccctcggacccccnacctcttgctccccactcctgcccatgtgacaggcctgctccctgctagccttctgccatgattgtaagcttcctgagacctcaccagaaacagatgccagtgccatgcttcctgtacagcctgcagaactgtgagccaattaaacctcttttcttataaattacccaaactcagatatttctttatagcaatgcaaaaatggtctgacacaccctatgaccagtcattgaatatattctccac

SEQ ID NO: 576419 - DNA, 1178 bp, Homo sapiens
  misc_feature (312)..(312): n is a, c, g, or t
cgtggaggaggagaaggtccggtacttcgggaaaggctacatggtggtgctccggcttgggacgggcttctcccaccccctcacgcagagtgcagtcatgggccaccgcagtgatgtggaagccatcgccaatgctcatcaccagcttcctggagctgcactgcctcgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgnccacaggacccgtggcacattcccggtgtgcctgagcccgtgcaccggccacaggacccgtggcacattcccggtgtgcctgagcccgtgcaccggccacaggacccgtggcacattcccggtgtgcctgagcccgtgcaccggccacaaggacccgtggcacattcccggtgtgcctgagcccgtgcaccggccacaggacccgtggcacatgcccggtgtgcctgagcccgtgcaccgccacaggacccgtgggcttggcttcagttggaggctccagccgagttggcctattgcctgctcatgctgcttgcttgcacactgcactgaagcaggcagggccagacccagggacatccagaagtttctccattcgtgagggccgaggactggccgttctgcaagccgggaagatcacgcagcccgggaaccctggattgggccacaagaagacacccggggaactagaaaggagggcacaggcgggacctatgggtcaaaacagcggatgatgggtcccgacacaagggtcacacaccgtggggacatccaccgggtcagaggtctcaagggacgcggggggaacctccaggcgcacgaagcggtgatcaccagtctacacctgagagagggcgcgcacaccgagacacacaccttgtgtacaaagagatgagggagacacgatgccaccagccctaaaagaacgtccccaacaagccagtaataggaccaaaaaagcaagtcatgatatggagcacacgagacgatcatctagcagacgctgcagtagtcaaatctactctcatcgtctgccgctgccgggctcgtcccccgcgcgctcgatctgcgcacaagaagaaggggaa

SEQ ID NO: 576420 - DNA, 214 bp, Homo sapiens
gtaagttgttgcgcgacaactgcgttcattaggacttgcggcggatatggacctcggcgttcatgcgcacgccgatggtcccatacagctcatgatggacgaaattgttgctgcacacgccgaggaaccacaccccttggtgcacaaatctcgatggacgaagttgtgcaacaacttcgtccactaggacttgtatggacattcggcgtgtgca

SEQ ID NO: 576421 - DNA, 146 bp, Homo sapiens
ctcaaggcttatacttctcaaggcttatacttctcaaggctttatacttctcaaggctttatacttctcaaggctttatacttctcaaggctttatacttcataccggggaaagaaaggagcgtggaggaagtataaagcgtggag

SEQ ID NO: 576422 - DNA, 182 bp, Homo sapiens
  misc_feature (99)..(99): n is a, c, g, or t
  misc_feature (160)..(160): n is a, c, g, or t
ggtactacttgtcctatcctcggtcctaccctggcacgtgaatagggcttactcaccccttcatggaggctcgggcggctactcggtatgttcaaactnagacacgaaaaccagaactgcatcaggatatggtggtaccatggagacgattaagtagtanagttggagtcaaacactggatg

SEQ ID NO: 576423 - DNA, 617 bp, Homo sapiens
gtatatagaatcaacctaaaaatatatgaacagatgaatggatcaagaaaatgtagtctgtatacacaatggaatactattgggcatattaaagaatgaaatcatgtcattggcaacagcatggattgaagtggaggtcattatgttaagtgaagtaaggcaggcacagaaagacaactttagcatgttctcacttacgtgtgagagctcaaacatgctgatctcatggagatagagagtacagtgataaataccagagacttggaaaggtgtgtgagtggggaggacgggaactgaaagagacggtcggtcaatgggtaccagttagatagaacagtatgagttctaatttttgatacgacgtaatgttgacctactagttaaccacaaatgtattatatatttccagtagctagaagactagaacttgaaattttcccaatatgtatagaaatgataaatactcaaggtgatggataccccaaataccctgacttgatcataacacattctgtggcatgaaacaaagtatcacatgtatcccatacatatgtaacaatcatatgtggtcactaaacatgattagtattgtcagttgcacaacattaaaacataaa

SEQ ID NO: 576424 - DNA, 144 bp, Homo sapiens
ctcccatggcccaaagcctgtcccaggagcaagatgctggctgactggcttgagtgggaggcatggtggtcccaggagcttccggggaagctctggcacagccgagagtcaaaagactacagcatccctgagagcagggagagg

SEQ ID NO: 576425 - DNA, 403 bp, Homo sapiens
  misc_feature (46)..(46): n is a, c, g, or t
  misc_feature (68)..(68): n is a, c, g, or t
  misc_feature (71)..(72): n is a, c, g, or t
  misc_feature (126)..(126): n is a, c, g, or t
  misc_feature (136)..(136): n is a, c, g, or t
  misc_feature (143)..(143): n is a, c, g, or t
  misc_feature (150)..(150): n is a, c, g, or t
  misc_feature (205)..(205): n is a, c, g, or t
  misc_feature (210)..(210): n is a, c, g, or t
  misc_feature (225)..(225): n is a, c, g, or t
  misc_feature (233)..(233): n is a, c, g, or t
  misc_feature (253)..(253): n is a, c, g, or t
  misc_feature (295)..(295): n is a, c, g, or t
  misc_feature (314)..(314): n is a, c, g, or t
  misc_feature (326)..(326): n is a, c, g, or t
  misc_feature (335)..(335): n is a, c, g, or t
  misc_feature (341)..(341): n is a, c, g, or t
  misc_feature (399)..(399): n is a, c, g, or t
ccacccaatgtgaaccaactgtatctcactgccccccggcccctcncgtcgacaaaaacaaaatgtgngtnnccaacgtaacgtgagtactggttagtattaggggccaccaacgcccatagctgntaaaaaaccnggcatcnagaacgnacacaacaaataggccaaagattcagccgggggatgggcccgggaccgcgaacgnaaagnggagtaggccatgcnacattgtntatacatacccggggaaagngaaatcaaagaataatagctaccaaattactgttgtaatagnaaattatacaataagaccnataaagtgtctntgtaaatcngtcacncacacacaagcacccagaccgtgaccagtgcgcgaaacacccacagccacccacaccnacag

SEQ ID NO: 576426 - DNA, 141 bp, Homo sapiens
  misc_feature (96)..(96): n is a, c, g, or t
ggcttgacttcacagtttattcagagcaggtgcaggtgacctggtgggcagggtgcccaggaggggcagggtgcgtgatttcgctgggttccttgnggtctgaggcaggaactccatttttttttctcctgcgacacagaa

SEQ ID NO: 576427 - DNA, 694 bp, Homo sapiens
  misc_feature (22)..(22): n is a, c, g, or t
  misc_feature (114)..(114): n is a, c, g, or t
  misc_feature (165)..(165): n is a, c, g, or t
  misc_feature (179)..(179): n is a, c, g, or t
  misc_feature (181)..(182): n is a, c, g, or t
  misc_feature (226)..(226): n is a, c, g, or t
  misc_feature (229)..(229): n is a, c, g, or t
  misc_feature (233)..(233): n is a, c, g, or t
  misc_feature (257)..(257): n is a, c, g, or t
  misc_feature (266)..(266): n is a, c, g, or t
  misc_feature (274)..(274): n is a, c, g, or t
  misc_feature (278)..(278): n is a, c, g, or t
  misc_feature (290)..(290): n is a, c, g, or t
  misc_feature (320)..(320): n is a, c, g, or t
  misc_feature (325)..(325): n is a, c, g, or t
  misc_feature (333)..(333): n is a, c, g, or t
  misc_feature (338)..(338): n is a, c, g, or t
  misc_feature (404)..(405): n is a, c, g, or t
  misc_feature (409)..(409): n is a, c, g, or t
  misc_feature (413)..(413): n is a, c, g, or t
  misc_feature (416)..(416): n is a, c, g, or t
  misc_feature (418)..(418): n is a, c, g, or t
  misc_feature (438)..(438): n is a, c, g, or t
  misc_feature (457)..(457): n is a, c, g, or t
  misc_feature (459)..(459): n is a, c, g, or t
  misc_feature (476)..(476): n is a, c, g, or t
  misc_feature (504)..(506): n is a, c, g, or t
  misc_feature (528)..(528): n is a, c, g, or t
  misc_feature (576)..(576): n is a, c, g, or t
  misc_feature (580)..(580): n is a, c, g, or t
  misc_feature (588)..(588): n is a, c, g, or t
  misc_feature (600)..(600): n is a, c, g, or t
  misc_feature (611)..(611): n is a, c, g, or t
  misc_feature (614)..(615): n is a, c, g, or t
  misc_feature (626)..(627): n is a, c, g, or t
  misc_feature (632)..(632): n is a, c, g, or t
  misc_feature (668)..(668): n is a, c, g, or t
taaaatgtaattcaggattttntttctctagcctggcttctcactggtatcatgaaggtcatggcacagacaataactgttccaaatatatgacgtattgttcctgtgctttcnaggctgggtagataccctatatactctgtttttcccattatcccaactgantagtattataatanannccctcccctgcccccaccaagtacatagcctcaatccaaaacgnganagcnggatcactcacctcttcccaatcnacacctttnaactcgtnttanaaacaataaganatgacctgccctctccattacactcgttgnttctnacacacanaatancaaacaaaaccaatttacgtgatgcccatgtctttatacttccacactctggaacaaacacacttnnaaanaatnatntnttttatttttaaaattgcgntgaaaaaattgataatatntntaagtataaaataattnaaaaagcatgccagttgcgcaaatattnnnttatgcagcacttttcacttgnactgaataattgtggatatatttaattaattaaattgagattttgtgnacantttatttngtgtcatattantatactttacnatnnattcttatcannatttntaatttattacatccccccttcccgaaatttaaatnttgtatcgtttaaaaataatttaatt

SEQ ID NO: 576428 - DNA, 141 bp, Homo sapiens
taaattagccaggcgtggtgacacaaaccggtggtgccagctattcaggatacagtggggaggatcactggagaccaggaagtcaaggctgcagggggccatgttcacacctctgcactcaggcctgggtgacagagtgaa

SEQ ID NO: 576429 - DNA, 124 bp, Homo sapiens
atttgtcgtgatgaaattgagtggccctaagatagaggagacacctgttagttgtaaggagaagatggttaggtctactgaggctccagggtgatagtagttccctggcagatccgcttgccgt

SEQ ID NO: 576430 - DNA, 689 bp, Homo sapiens
cgaatattatgaggcgtgtaccggtttttatttcaggtacggggctagaggatgagcgtcttagttactgtggccgtgggcgtacaactacaccgcgcggttacccctgtacccgcgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggttacgcgttgtcctcgggacaagagactggcggtgtgatgccgcgcctcttcggcctttcgctgggctaagccggacctccatgcagactgtcaaacccccctagggtcggcacagcctctctgcggggaggcttagtgcccctctatagagaaacggcttaggcaacggctgtgcccggggcctttgcaacagcgggctgaaggggggcaaggagacctcgcagagctattacttcccccgaccccgatctccgactcctgactttggaacgccccaaagctgcttatccggtagccctacaaagtgtcggtcattgtgccacgttcttggaaccgtggactcattttctcct

SEQ ID NO: 576431 - DNA, 900 bp, Homo sapiens
gggggggttgacggcttctggcgggtggctgtgtgttgaagtgcgagagcttgcttggcccgtgtcgcttctgtcccaagaaccgtgaccggagagtgagtggcacgaggtgtcgctgtctgtgggtgctgtctgtcttccactgtacactgtctgtctgttgatggatgctgcagtcctggactcttccctgcaaccccttccgtgctccctttcctgcactgcctctgaggctggctggctggccacctgatgacatgcagctgcaccttctggcacatcccttcgctcctttgttctgctggtatcaaaaaggattagctaactttcactaatcactctactacaactacttacacactctacattaacatacatactttactttacatttatataacttcacactatttattgtaactcatctcatccaattaagaaacacaataagaaatattataacactaatataatatacataaaacactacataatattatcattaaccacactcgaaaacaatatttatattcttaaataaatcatatgatcctcaacatcttcttcaaaataaaccatttaataaatttatcattaatcaaacaataaatatctacttaccatctacttatagaattaattaatagtttctctctaatcctacatactcaaaccaatactaaatcactacttacttatttctatactttcatctttatatatataattctactattttattctatcatctattacatcgaacaatataccttctcaccaactctaatttgaaatatttattatttacatattacttcacatctaactacctacatctcttatgcttatacaaattattttcattatatgttatctaatcttcaaacattcttaattaca

SEQ ID NO: 576432 - DNA, 853 bp, Homo sapiens
  misc_feature (805)..(805): n is a, c, g, or t
catttttattactaccctactctcataaccaggatttctatcgacgagcaaattcttgtatctaatctctgctatctccgctctcttcctgaacccgtactactttccatacgatcaacaatatcatatctggtcggcacatctatctatttcgcgtatatagcataactgctacgccgcgccgcgattgcatcaaccgctattccagttactcatttagttatgtttatgctgtcttctacttacattccaccgccggccgtttaaaataccaggagcctctctgactaaacaatgtaaaatagacaatatccacacatcttaattcgtcttgggaataactcatgtaacttcggcatagattccgcatcgctttttataaatggtaaatacaccctaaaccggctgaaagttcaaaatatactcgtcacctgaccatattcttcaacttctctgttattatcattctttcagattaattgttttatctgtacaaacctactaattataatattcattatttctcttcctacatgaccctctggatcttctacttttcaagaaaaaacaattttatacttcccccgctttaccaaagttaattaaattaatccccttttcgcgtcaaatataggctttctatacattgctgagttatttatccctatatcaaccaatagcattcacccgttttatttcctgtccttagtgtctgaagatgctcaccagttttttgtgcacagtaaggcagcatgctaaaatgcttttgttcagttctgtatatttgaaaatagcagtgtgttcnctgatggttacctgcagtggcaccctgtacaaaaataaaacttattgc

SEQ ID NO: 576433 - DNA, 102 bp, Homo sapiens
ccccctcagcttgatactatcaagtgatctgactgcctccgcctcccaaagtgttgggattacatgtgtgagccactgcgtccaggccctatcttaactatt

SEQ ID NO: 576434 - DNA, 144 bp, Homo sapiens
tgcaccaagagaagtacacggagcagaatctaactgcatcccatgtaaatgtgtacatccattttattcctcactcgcctctaagacttatcatttaactttacattgtttcacttttaagaatccatgaagggagagggggat

SEQ ID NO: 576435 - DNA, 168 bp, Homo sapiens
caggagaatcatgtgaacccgggaggcagaggttgcagtgagccgagattgtaccactatactccagcccggcggacagtgcaagagaatccatctcaaaacaaacaaacaaaacctgtaggctcttagtgttagaaggagtcttagaagtcccccagtccagaattg

SEQ ID NO: 576436 - DNA, 296 bp, Homo sapiens
  misc_feature (288)..(288): n is a, c, g, or t
ttgcggtacgacgtcgcccgacacacgccagctatttctggagggcggacgcgacgccgacgtcttctaccgcaagtgttggtcccatgacaaggtcgtgcgctccatccacggagtgaactgcaccggctcgtgctcatggaagatctacgtcaaggaaggaatcatcacctgggagtcccagcagactgactacccctccaccggcccggacatgcccgactacgagccgcgaggatgcccgcgtggcgcgtcattcagctggtacgagtactcccaggtcgtggntggagcat

SEQ ID NO: 576437 - DNA, 663 bp, Homo sapiens
  misc_feature (271)..(271): n is a, c, g, or t
ggaacgttcagggcagagataatgccttcatggagaggccagcaaggttgaaagttattcctccacatcggccaaaaaccccggaaccttcggaatgagcgcaccggcctaaagtgaagcaagttgctagtagaacaaaattttatcaccgtcaggtaacagctgtagatgccactacaatcttaagtgtgaagctcacacatggcaatagcgatcatgcaagccatgcttgttagaggcgcctcagacaattccacatgaggcaagtctncagctcgtgacatagccattcagatgcggtggtgctcagcaagctaatgacaagaatggcagcttatctgacacgctctcccagtggtatccagtagctctaaatgttcaatatatgtaactcattaacccgagcactgcgctctttgtcagtcgtggaggtcaggtctcagcacggtatgtctagcttgtccaaagaagcttaatagtaaatgtcaggtaaacgatgccaacgatccgtttaaccttcccaagaaaagaatcatcttatgtggacctctttggccaacatcatagagtaaggcagagttgagttaatagttcttgaaatcagaacagttcaatggatcctgcacatccctaaataggtcacatatgtttagtgcgcaataa

SEQ ID NO: 576438 - DNA, 2011 bp, Homo sapiens
  misc_feature (947)..(947): n is a, c, g, or t
  misc_feature (1922)..(1922): n is a, c, g, or t
tggaaaatgggaacacaaaatttttttcttttggggtgggaaaaaaaaattaggggggtgggtggggtacaggaccccaattccctctaacccctctcccaaaacacaaaaaaaacaagaagggccacacaaagggcctccctctctgtgccaagggagaaagcacgaaaggctcaggggacgggcggggaaatgtgcagtggtggatgtcgcgcaacagtgtggacaactagtgtgggacatgtgtgtgtgtgtgtagtgcgaggagaacaggtgtggtgtgtgtgtgcacagtggtgtgagccttggtggcccgagaggtagagaggtgtgaaaataaatgggtggtgtaaactagcattagggagtagatacaccggggggaggaaacatgacatagtgagaaggacgaatctgcacgagagatagtgtagcaatcgtgggcgaccccccgacaagaaacaaccacaagggaggggacaccaccacaacccacaccacgacgagtagaaaacagtggcgcgacatacgacacatgtgaagaagaactgatggacgcgaaacgcagggaatacaccaccccaccacaacatgattgtagaaagaccacacaacaacacaggagaggtggaggaaagccacaccacccacaacaccacgactgatgtagaccccaagctgggaaagaagcccaaggaggcgtgatcagcgaaggaaacacaccacagccgaagccggttgacataaactaacacaccgcactccggaagtccatcgtatgctagcaagctcacagacagcacaggtggctgaggagctaattgcacagaacacaccacgccgaagagagaaacgaacattcacacaaccaccatagacagcaaccgaagaggagagggagcgaaccatcacgcttagagagtggtgcgcagagacgaccacaccgnatagatagataacgaacgacacccacaccaactaaaacgacgaataccgagaagagaaaggacacagacagagagcatagtgttgaaagtcagggcaactgcgagacatcaacgtctagcatagataaagaagcgaagaataggacagaacagaacccatgaaacaaacgcgaaggcagagacaacaaccgactagtagcgatacacccaacataagatggagcgagggaccctacacaagagcggaaagatacacgaggctagactgttgatcgaaccacatagaagagccgcacccacaaggaggcgaccacccccacttagagtgcggcaccacaacaccaccgatccacaagactgagcgacagaagcaacgagcagaactacaagaacaaaggcgacgcccacacaagcggagaacaacacctaccgtcagtgagtgcgcgaacgcacacacagaagtagacatgatagaagaacgaggagcagacaaacacaagagctggaaggagagacaccatagaaggtacagacaccaacgaaaaagacgactcgccaccaacaaacaacaacactcacactgaagaaagtacaaagaacgaacacaaacaagagaagagaaaacaaagacctaaacgagagagacatagacaatcaaacacaaacaacagagttgaggcaagcactgaaacaaagtagcgcaccccactccaacgaagggaagggtagaaaccccaacacaaatgtgatcgaacaaaggaggagagcgagcgagcgaccaaattgcatgaataggcacacacaatagagcagacacaaccggacccacacaagctacacaaaagagcggagagacgacgatccacgagagcaacaaaggaagccaataccaaccacggagaatcaccacaccgaagcagaaaacacatcgcgactaaacacaccaacaggcagaaaacataagccacaccacgnagaggccaaccggacaaagacggaagccagacaaccagaagaaagaaaaagacgaacaactagacaagacgaacaagaaaaaagacggt

SEQ ID NO: 576439 - DNA, 388 bp, Homo sapiens
tcgagctgatagaaatctcatcatctgtgcagccatcttaaagcgacactatgaccagagggaggattatccttgacctttgaagaccaatactaaactgaaatttaaaatgttcttcgggggagaagggagctatgacttacactttggtaatcatttgcttcctgacacttaggctgtctgctactctgaattgcctcggaaagagtctagaaccattttgtccttgacatccattcatctctttctaagggaatcagaggccatgagcccgtatatacttcaactcaagaagactgcgttaattctagcggtgcaacatataaccattcaagctataacagcagaggctcctagacccgccacaggcgcgggggtactgagcgcg

SEQ ID NO: 576440 - DNA, 1005 bp, Homo sapiens
ggccggagcatgcgggcggcggtggaggcgtgcgcccggtgagcgtctcttcgcttccctcggggtcttgctcggacctcggccaccgggctgggatccccacggactcgtgcgtgcagcatgggcggcgtcggggagccgggaccgcgtggagggacccgcgcagccgggggcgccggttgcccaccttctgctgggagcagatccgctgcgcacgacctagccctgggtgacaatgtggtgtggtctatctgagtcgcctgctgtctactactatctagtcgctgggcacagcgtgcacccagggggcagccgcctcatcggccaccacggtgctgaggacgccacgtgatgccttccgtgccttccatcaggatctcaacttttgtgcggcaagttcctacagcccctgttgagttggagagctggctccggaagaatccagccaggatggatcccttgaatgcgcagtctggtcgatggacttgcgagccctgcgaccaggcagaccgaggcacatgaagctgtttgatgccagtcccaccttctttgcgtttcctactgggccacatccttggccatggaggtgctggtccctggctccttatctacctccgtgggtcctggctggtgtgcccagtgccctggccgccttcatcctggccatctctcagggctcagtgcctggtgtctgccgcatgaccgtggggcatgcctccatcttctgtatgtcctggtggaatcacgttggcccagaagtcgtgatggggcagtacagggcttctccgcccactgggtgggaacttacggccattcgagcagccatgccaaggcccagcatctttccacagaaggacccaggaccgttacgggtgtggcagccacgtcttcctccattgtgggagttgatcgcaatgtatgggaagaatgcaaggcgatacgtaaccctacaaaacaggatgcgaacgtgtactattcctgaaagggccgggggtgagatcacct

SEQ ID NO: 576441 - DNA, 145 bp, Homo sapiens
gggccttcctgttctcgtggggtagcagtgagtgtggcacccctcacgcgcgctggctcagagcctgctctccagcctcgctattctctcaaccctgtctttcagactcagctcattcctggtcttcaccatgcgtggattgcca

SEQ ID NO: 576442 - DNA, 140 bp, Homo sapiens
tcgagatcatgcactgtactccatgcctgggcgaccgagcaagactccctctctaaagaaaaaaaaagaaaaacaaagaaataccaatacaaggagtcataggactatctgtgaaccattatatttcactgacagaagga

SEQ ID NO: 576443 - DNA, 451 bp, Homo sapiens
  misc_feature (99)..(99): n is a, c, g, or t
  misc_feature (415)..(415): n is a, c, g, or t
tcccaattcattccagcgtaagctcagaggtgctgctgcttcggggcaggacctgagcgtccgctgggtgcgtgtcttgcgcttctgtaggcctctgcnttgagggtgcgtgcccagaggggctttgaagctttgggtgtggggtgggtgctctggaaatgtgctggctggcaggttacccttcttggaagggtatggctgagccaccttttggctccctctggccttgaacagcctcttaggcgttagacaccaagagaatgcgtccttgttaagattcccagttggagcactaggcgaggctttcgaggggagcgtcctggacatgttcaaggagaatggttggaagagaagggctcctgggctctagcgcggcctgggaagacccagagggcagtgtcagctcccgggtttnttgctgggcacggagaaggggaagctgtctttctgt

SEQ ID NO: 576444 - DNA, 894 bp, Homo sapiens
gaacgcgcacaacgaactgtgactctagtaaagcctgtctcgaagcgggcgaggacggagcgtaccatgatagactatgcagagaaagatgaatataatatcaagcatgaaaaaggacaaaacaaaggaagaacacacaaggatacaacgaagcaaaacacagaagacgaaacagaagcaacacagagacaagagacggcaccagccacacagaaccacaaccaagacagcagcaaagagcgaacagccacacagcagagacaaagaccaacaaggacaccagagaccaagacacactgaaaaaaaaagccacaaaacagaaggacaaaatacaacaagacaaaaaacccaagaagcgcacaaaaagccaaacagacagaaaaaaccggcacgcccacgaccaccccaacgcgcacacatcacacccaccacggcaacaacacaaaccaccaaagaatccacagaaagaaaacaccaacagacgggacaacacaccaagccacaagaggagggcacagaagaacaaaaaaccagcagctaaaacaagctgagaccgacacagaaagcgagacccaaaaacgagaagaccgaaaaccacagaacacgaacacacggatacacaaccacaagcccgcaaagagacaaagcggcacgcagggcaacaacgacaaagaaacgagccaacgcgtggtacacaacagcagccaccaaaacgaacacaaacaacgaagcacacaaccacaccacccaagtacacaacaacgacgcacctcaacaacaaccaccagcacagacaccgaaacatgacacaagaaaacgaaaacaaacaccagcacgtgaacacagaaaacacccatgacacaaaaccaaccacacacaaacacacacaagcgc

SEQ ID NO: 576445 - DNA, 234 bp, Homo sapiens
gtatacccacaacatgaaagaaatggtgctacccagctcagcctgggactttgaattaggacacaaaaccctctagcttggaactgaatatgctgcacttttcagaccctgccttctgatggatcagctggcaccacccagaccagtaaactggctcatctggtcttctggcccccacccaggaaccaactcagtgcaagaggatagcttcaactccttatgatttcatccccg

SEQ ID NO: 576446 - DNA, 349 bp, Homo sapiens
aaaaaaaaaaaaaaaaaaaaaaaaaaaaaaaaaaaaaaaaaaaaaaaaaaaaaaaaactcgaaaaaaaaaaaaaaaaaaaaaaaaaaaaaaaaaaaaaaaaaaaaaaaaaaaaaaaaattcatgggccgaggtttaacaacggggggacgggaaaaacctgggggtacccaaattaaaccgcctggaaggaaatccccttttggccagcgggggaaaaaccaaaggggcccgaaccgatggcctttccaaacagttgcccacccggaagggcaaagggaaaatggaaagcgtaaaaatttggtaaaaattcgggtttttggtaaacccagctaatttttccatgggccg

SEQ ID NO: 576447 - DNA, 196 bp, Homo sapiens
cacctgaccgactccagcaccgtgctctgacacatagtgctccagccaacagagccatttttatttcgatgagatggaggatttaggagactctcagtcatttgaggctagttcagtccaaccaaccactattcagttttgttctaaaagcatgacacatagcgagcaacgttcagttcacaggctctccaagatc

SEQ ID NO: 576448 - DNA, 115 bp, Homo sapiens
cacacggatgcagacaagttacataagttgctgcagatcatagcactgcatacagtggtggcacccggacgctctgatttcagagcttctgttcttaactgtgattgtctcctga

SEQ ID NO: 576449 - DNA, 166 bp, Homo sapiens
  misc_feature (6)..(6): n is a, c, g, or t
  misc_feature (44)..(44): n is a, c, g, or t
  misc_feature (81)..(81): n is a, c, g, or t
  misc_feature (136)..(136): n is a, c, g, or t
  misc_feature (153)..(153): n is a, c, g, or t
caaaanttactctgcaaaattaatatatgatttacctgctgttntcataagatttccaaatagacaaactcggtatgcttnggatttgctttacattctaagtggatttggaggttcaggcaggcgccaaggagtnagccgaagtttcatcangcggagatgttgg

SEQ ID NO: 576450 - DNA, 231 bp, Homo sapiens
ggctcccacttggttgctaggaatggggagggtgacagggaaagggggaataactagttatgagtatggggtttctttgggggtgataaaaatgttctaaaatggtggtaatggttgcacaactctgtgaatacactaaaaacccttaaatggtacacttttttttttgggggccacggacgtgtgcacccaggggggaggccgggatccgagcttcgaatcgaagtcagg

SEQ ID NO: 576451 - DNA, 106 bp, Homo sapiens
ggccctcaccaagacccgggccggtaggcctaaccggctaacattactggcaggccacctactcatgcacctaatgggaagcgccaccctagcaaatagtaattcg
